United States Patent 6,812,339 (POLYMORPHISMS IN KNOWN GENES ASSOCIATED WITH HUMAN DISEASE, METHODS OF DETECTION AND USES THEREOF) - sequence listing, part 101

SEQ ID NO: 139206 - DNA, 601 bp, Human
tcttcttctcttgttggtatttttttaaatttgccttaaaataggcttaaatgtaaaaggcttaaatgagaaagcagccacatgatataataaagatctgtagcagggcatcgtggaatgcacctgtaatcccagctacttggaaggctgaggcaggggaatcacttgaacttgggaggcggaggttgcagtgagcagagatggcaccactgcactccagcctgggcgacagagcaagactctcaaaaaaattaaaaataaaaataaaaaataaagatgtgtatttaaaaaaaatcacacraagtaaaattagaattcttaagcacattttataactatttcaggtaaagtcaaaaattgacacaggaaaatgtcccactcatttgcagaagactgcagttgttttaccagaaaaataaagtagtaaatgtgatttattaaatagacttgactcagaccaaaagtacccaacaggcactaggcaaatgttaagaaatctaatttaacaaaggtatcacacagagagtaggtacttgaattcactttctggcaagccaaccccatagaagttacctcccggaatcaggatgtgaaaggtact

SEQ ID NO: 139207 - DNA, 601 bp, Human
gttggcaatattctgcatactgccacacattaagatgctagcaagacaaaacattcctgagaacagtggaaacttcgtgtttgggaaccctcccagaccttgttggctggttatgatttttatatcctttggctataataaaactgtaatactaagtttaacattttcctgagctctgtgagtcgttctaaggaattaaccctcaaatttgtagctagctagtcagaaatgagggtaacctggggaccaccaaaattgagactggtgtctaaagtaagggcaatcaagtgcaggactatgytcttagcctctgaagtttagctaaactatgggcacttagtattagaactcctttcaatataaaaaaaaaacttttttaaataaaagaattcagagccttctgaggctaaagaagagaacattagcaagtctaagtaaagagaaatgtttgaaatgatggtttaattttcagttcctctataaatttcaaatgaaagggtattcttcgttttctctctagcaaggcagtgcataattattagcttttacaaagatctaaagagcaggaaaaaattctgattgaagaagaggcggttcagtt

SEQ ID NO: 139208 - DNA, 601 bp, Human
tgttgcacaaactgtgcacaaattgttttactctgttccttttaccaaaagagaaattaacattctccttccttcctctctccctccttccttccttccttctttctttctgagaatgcactattatactgcatactcaaaatgggtaaggtaaattttttgttatatttttgacaatctaaaaaaaaaaaaatctctgaacaccaaaagcttggggagctttgggttggcaatattctgcatactgccacacattaagatgctagcaagacaaaacattcctgagaacagtggaaacttmgtgtttgggaaccctcccagaccttgttggctggttatgatttttatatcctttggctataataaaactgtaatactaagtttaacattttcctgagctctgtgagtcgttctaaggaattaaccctcaaatttgtagctagctagtcagaaatgagggtaacctggggaccaccaaaattgagactggtgtctaaagtaagggcaatcaagtgcaggactatgctcttagcctctgaagtttagctaaactatgggcacttagtattagaactcctttcaatataaaaaaaaaactttt

SEQ ID NO: 139209 - DNA, 601 bp, Human
ctggagggaagtgggagagggaaaagggagctgttcaatgaatagttttaattttgtaagacaaaaaaagttctagaaaaattaaagaaaaaaaaaagatttggatatctgttctggagatgttgcacaaactgtgcacaaattgttttactctgttccttttaccaaaagagaaattaacattctccttccttcctctctccctccttccttccttccttctttctttctgagaatgcactattatactgcatactcaaaatgggtaaggtaaattttttgttatatttttgacaatctaaaaaaaaaaaaatctctgaacaccaaaagcttggggagctttgggttggcaatattctgcatactgccacacattaagatgctagcaagacaaaacattcctgagaacagtggaaacttcgtgtttgggaaccctcccagaccttgttggctggttatgatttttatatcctttggctataataaaactgtaatactaagtttaacattttcctgagctctgtgagtcgttctaaggaattaaccctcaaatttgtagctagctagtcagaaatgagggtaacctggggaccaccaaaat

SEQ ID NO: 139210 - DNA, 601 bp, Human
taaaatggaatagtactcagccataaataaggaaactttgtcatatgctacatcatgaataaaccttgaggacattatgctgagataaaccagttacaaaaagacagctacttcaggtatctaaaatactcaaacttttagaaacacaaagaatggtgattaccaggagctggagggaagtgggagagggaaaagggagctgttcaatgaatagttttaattttgtaagacaaaaaaagttctagaaaaattaaagaaaaaaaaaagatttggatatctgttctggagatgttgcacaaamtgtgcacaaattgttttactctgttccttttaccaaaagagaaattaacattctccttccttcctctctccctccttccttccttccttctttctttctgagaatgcactattatactgcatactcaaaatgggtaaggtaaattttttgttatatttttgacaatctaaaaaaaaaaaaatctctgaacaccaaaagcttggggagctttgggttggcaatattctgcatactgccacacattaagatgctagcaagacaaaacattcctgagaacagtggaaacttcgtgtttgggaa

SEQ ID NO: 139211 - DNA, 601 bp, Human
tgacaaatggaactctatcaaacttaaaaacttcacagcaaaggaaataatcaacaaagtaaaaaggcaatctacaaaatgagagaaaatatttgcaatccatatatctagttaaaagctgaaattcggaatatgtaagatcttctacaactcaataaccaaaaaagtaaaaaataaaaaacccaaacaaaaaaatttaaagatgggcaaaggacttaaatagacatttctccaaagcagatctgcaaatggcctgtaagcatatgaaaagatactcagtatcactaataacgggggaaaygcaaataaaaaccacagtgaaatataatctcacaccctttaggatggccactaccaaaaaaacagaaaatgaatattggcgaggatgcagaaaaactggaagctttgtctgctgttagttggaatataaaatggtacggctcagctaggtgcagtgggctcatgcctgtattcccagcactttgggaggccaaagcaggcagaacacctgaagtcaggagttcaagaccagctggccaacatagtgaaaccctgtctctactaaaaatacaaaaactagccgggcatggtggtgcacgcc

SEQ ID NO: 139212 - DNA, 601 bp, Human
tggcttttttttataaaaatagaaaaatacactaaaatgcatacataatctcaaaggacccagaacagtcaaaacaatctcgagaaaaaaaaagaaactagaggcctcacacttcttttaaaatatattacaaggttacagttatcaaaacagcatgataatgcataaaaaaacagacatatagaccaatggaatagaacagaaaacccagaaataatccctaaggtatatgattaaatgatcttcaacaatggtgcgaaagctacacaagagggcaaaaagaacagtctcttcaacaaayggtgctagaaaaattggatatccacatgcaaaagaatgaagttagacccttaccaatactactatatgcaaaaatttactcaaaatagattaaagacctaaacataaaacctgaaactataaaactcatagaagaaaacagggagaaaaaagtttatgacattggatttagcaatgatttcttaaacatgataccaaaggcacaggcagaaaaaaagcaaaaattgacaaatggaactctatcaaacttaaaaacttcacagcaaaggaaataatcaacaaagtaaaaaggcaatctaca

SEQ ID NO: 139213 - DNA, 601 bp, Human
ctaagcaatctacagattcaatgtaatctctatcaaaatcccaatggcttttttttataaaaatagaaaaatacactaaaatgcatacataatctcaaaggacccagaacagtcaaaacaatctcgagaaaaaaaaagaaactagaggcctcacacttcttttaaaatatattacaaggttacagttatcaaaacagcatgataatgcataaaaaaacagacatatagaccaatggaatagaacagaaaacccagaaataatccctaaggtatatgattaaatgatcttcaacaatggtgsgaaagctacacaagagggcaaaaagaacagtctcttcaacaaacggtgctagaaaaattggatatccacatgcaaaagaatgaagttagacccttaccaatactactatatgcaaaaatttactcaaaatagattaaagacctaaacataaaacctgaaactataaaactcatagaagaaaacagggagaaaaaagtttatgacattggatttagcaatgatttcttaaacatgataccaaaggcacaggcagaaaaaaagcaaaaattgacaaatggaactctatcaaacttaaaaact

SEQ ID NO: 139214 - DNA, 601 bp, Human
cacagggagtggaacatcacacaccggggcctgtcggggggtggggggctagggcagagatagcatcaggagaaatacctaatgtagatgacaggttgatgggtgcagcaaaccaccatggcacgtgtatacctatgtaacaaatctgcacattctgcacatgtatcccagaacttgagtataataataataaaaataaaaaagaaaacttacagccaacatcatacacaaaaatgagaagctgaaagcttttcctctaacatcagaaacaaagcaaggatgcccactcttgccgcttctrttcaacacagcactagatgtcctagacacagaaaacaggtaagaaaaataaaaagcatccaaagagaaaaggaaaggtaaaattctgtgtttgcagatgagatgttgtcatatgtagaaatccctaaagattctgcacacacacaaaaaaaactcttagaataaatcagttcagcaaagttgcagaatacaaaatcaacaaacaaaaataagttgccttttaatacagtaacagtgaacaatgtgaaaaggaaattatggaaataattccagttaaaatcaaagagaataaaatacttaa

SEQ ID NO: 139215 - DNA, 601 bp, Human
aatactatgcagccataaaaaggatgagttcatatcctttgcagggacatggatgaagctggaaaccatcattctcagcaagctaacacagaaacagaaaaccaaacaccgcatgttctcatcataagtgggagttgaacaatgagaacacatggacacagggagtggaacatcacacaccggggcctgtcggggggtggggggctagggcagagatagcatcaggagaaatacctaatgtagatgacaggttgatgggtgcagcaaaccaccatggcacgtgtatacctatgtaacaaayctgcacattctgcacatgtatcccagaacttgagtataataataataaaaataaaaaagaaaacttacagccaacatcatacacaaaaatgagaagctgaaagcttttcctctaacatcagaaacaaagcaaggatgcccactcttgccgcttctattcaacacagcactagatgtcctagacacagaaaacaggtaagaaaaataaaaagcatccaaagagaaaaggaaaggtaaaattctgtgtttgcagatgagatgttgtcatatgtagaaatccctaaagattctgcacacacac

SEQ ID NO: 139216 - DNA, 601 bp, Human
tgatgactaaaacaccaaaagcaatggcagcaaaagacaaaattgacaaatgagatctaattaaactaaagagcttctggacagcaaaagaaactatcagcagagtgaacaggcaacctacagaatgggagaaaatttttgcaatctatacatctgacaaaaggctaatatccagaatctacaaggaacttaaacaaatttacaagaaaaaaacaaccccatcaaaaagtgggagaaggatatgaacagatacttttcaaaagaagacatttatgcagtcaaaaaacatatgaaaaaaagyttatcatcactggtcattagagaaatgcaaatcaaaaccacaatgtgatagcatctcatgccagttagaatggtgatcattaaaaagtcaggaaacaacagatgctggagagaatgtggagaaacaggaacacttttacacttttggtgggagtgtaaattagttccaccattgtggaggacagtgtggtgattcctcaaggatctagaaccagaaataccatttgacccagcaatcccattactgagtatatacccaaagattataaatcagtatgtttattgtggcatgattcacaat

SEQ ID NO: 139217 - DNA, 601 bp, Human
aaggacttcatgatgactaaaacaccaaaagcaatggcagcaaaagacaaaattgacaaatgagatctaattaaactaaagagcttctggacagcaaaagaaactatcagcagagtgaacaggcaacctacagaatgggagaaaatttttgcaatctatacatctgacaaaaggctaatatccagaatctacaaggaacttaaacaaatttacaagaaaaaaacaaccccatcaaaaagtgggagaaggatatgaacagatacttttcaaaagaagacatttatgcagtcaaaaaacataygaaaaaaagtttatcatcactggtcattagagaaatgcaaatcaaaaccacaatgtgatagcatctcatgccagttagaatggtgatcattaaaaagtcaggaaacaacagatgctggagagaatgtggagaaacaggaacacttttacacttttggtgggagtgtaaattagttccaccattgtggaggacagtgtggtgattcctcaaggatctagaaccagaaataccatttgacccagcaatcccattactgagtatatacccaaagattataaatcagtatgtttattgtggcat

SEQ ID NO: 139218 - DNA, 601 bp, Human
ggaccagaagattttggatttctttgaattttgaaatatttgcattatacttaccattggagaatcccaaatctaaaaatctgaattccaaaatgctccaatgagcatttcctttaagtgtcatgtcagtgctcaaaaagcttaggattttatagcattttggatttcagaatttcagatttgggatgctcaacctatatttataccacaagaaactagaaaaagaataactaaacccaaagttggcaaaaggaagaaaatcataaagattagagcagaaataaaagaaacaaggaacagaaaaaaaaaaaatcaacaaaactgcatattggctcattgaaaaagtgaataaaattgacaaccctttaactataaaaaaatagaaaagactgaaataacaaaaatcagaagtgaaaggagacattacagctgtcacagaaagagtctgagactgctatgaaaaattatgtatcaacaaattgaataacctagaagacactgataacttgctagaaacaatcttcaaaatcataaagaaataaaaaatatgaacagctctataactagtaatgatactgaatcagtaatcaaaaacttctaa

SEQ ID NO: 139219 - DNA, 601 bp, Human
ggatgcctgtggggcatcgagaacaaaggagagtacacaggctcatggcagtaccagaaaatgtgtaacatcccagagggaagttgacacagcttgctacaactaagaaaacacacccagctcctgattttttaacaggttgagtactcctcatctgaaatgcttaggaccagaagattttggatttctttgaattttgaaatatttgcattatacttaccattggagaatcccaaatctaaaaatctgaattccaaaatgctccaatgagcatttcctttaagtgtcatgtcagtgctcmaaaagcttaggattttatagcattttggatttcagaatttcagatttgggatgctcaacctatatttataccacaagaaactagaaaaagaataactaaacccaaagttggcaaaaggaagaaaatcataaagattagagcagaaataaaagaaacaaggaacagaaaaaaaaaaaatcaacaaaactgcatattggctcattgaaaaagtgaataaaattgacaaccctttaactataaaaaaatagaaaagactgaaataacaaaaatcagaagtgaaaggagacattacagctgtca

SEQ ID NO: 139220 - DNA, 601 bp, Human
tagtgtatgtgtacatgtagtgttacgtatgaaaaaaatgatacaaagccctaggtcgttttctcaattgtattattttttaacataaagtgcgtttcaagtgctccatattgacagaaacaataaaagagtgggaaataaaacattaaaagacttttgttattttaaatgcaactattttccaaataaaatttttttacaatgaacatactactcttacatccagaaaaaaaaacaggcatgacaacttttttttttaatcaaaagactaattccacttttctttctttcttttcttttctttttttttatatggagtgtcgttctgtcacccaggctggagtgaaatgatgcgatctcagctcactgcaacctccgccccccaggttcaagggattctcctgtctcagcctcccaagtagttgggattacacgcatgcaccaccatgcccagctaatttttgtatttttagtagagacagggttttaccatcttggccaagctggtctcgaactcctgaccttaggtgattcacctcccaaagtgctgggattataggcatgacccaccatgcccagcctaattccacttttctatcct

SEQ ID NO: 139221 - DNA, 601 bp, Human
aatgtagtgtatgtgtacatgtagtgttacgtatgaaaaaaatgatacaaagccctaggtcgttttctcaattgtattattttttaacataaagtgcgtttcaagtgctccatattgacagaaacaataaaagagtgggaaataaaacattaaaagacttttgttattttaaatgcaactattttccaaataaaatttttttacaatgaacatactactcttacatccagaaaaaaaaacaggcatgacaacttttttttttaatcaaaagactaattccacttttctttctttcttttcttttctttttttttatatggagtgtcgttctgtcacccaggctggagtgaaatgatgcgatctcagctcactgcaacctccgccccccaggttcaagggattctcctgtctcagcctcccaagtagttgggattacacgcatgcaccaccatgcccagctaatttttgtatttttagtagagacagggttttaccatcttggccaagctggtctcgaactcctgaccttaggtgattcacctcccaaagtgctgggattataggcatgacccaccatgcccagcctaattccacttttcta

SEQ ID NO: 139222 - DNA, 601 bp, Human
gggacatggatgaagctggaaactatcattctcaacaaactaacacaggaacagaaaaccaaacatcacatgttctcactcataagtgggaactgaacaatgagaacacatggacacagggaggggaacatcacataccagggcctgtcagggggttggggcaaggggagggatagcattaggagaaatacttaatgtagatgacaggttgatgggtgcagcaaaccaccatggcacatgtacaactatgtaacaaacctgcactttctgcacatgtatcccagaacttaaagtataattaaaaaaaaaagaaaaaaaacttaacaccaaatatgtaaacatatgtatgtgaaatataacctatgcatttttcataaaaactgaggggacattaaaagtattgcttaaagcataaacactagaaaatcctgaaaacagatatttgaaagaaaaagcctaagaaaagggaaagtctaagctctagccctactgcaagacaataaaaaagaaagctggccaggcacagtggctcacacctgtaatcacagcacttcgggacgccaaggcagaaggactacttgagttcaggagtcaagaccag

SEQ ID NO: 139223 - DNA, 601 bp, Human
tatacacaaaaacttataccacaatagcaacaacttggaaccaacccaaatgcccatcaatgatacactggataaagaaaatgcggcacatataccatggaatactatgcagccataaaaaaagaatgtgttcatgtcctttgcagggacatggatgaagctggaaactatcattctcaacaaactaacacaggaacagaaaaccaaacatcacatgttctcactcataagtgggaactgaacaatgagaacacatggacacagggaggggaacatcacataccagggcctgtcagggggytggggcaaggggagggatagcattaggagaaatacttaatgtagatgacaggttgatgggtgcagcaaaccaccatggcacatgtacaactatgtaacaaacctgcactttctgcacatgtatcccagaacttaaagtataattaaaaaaaaaagaaaaaaaacttaacaccaaatatgtaaacatatgtatgtgaaatataacctatgcatttttcataaaaactgaggggacattaaaagtattgcttaaagcataaacactagaaaatcctgaaaacagatatttgaaagaaaaagc

SEQ ID NO: 139224 - DNA, 601 bp, Human
caattaaagcaatggataaaaaagtaaaaaaagaagaaaataatggcttgcctgcaaggaaaatagatttaaaatatacacaaaaacttataccacaatagcaacaacttggaaccaacccaaatgcccatcaatgatacactggataaagaaaatgcggcacatataccatggaatactatgcagccataaaaaaagaatgtgttcatgtcctttgcagggacatggatgaagctggaaactatcattctcaacaaactaacacaggaacagaaaaccaaacatcacatgttctcactcrtaagtgggaactgaacaatgagaacacatggacacagggaggggaacatcacataccagggcctgtcagggggttggggcaaggggagggatagcattaggagaaatacttaatgtagatgacaggttgatgggtgcagcaaaccaccatggcacatgtacaactatgtaacaaacctgcactttctgcacatgtatcccagaacttaaagtataattaaaaaaaaaagaaaaaaaacttaacaccaaatatgtaaacatatgtatgtgaaatataacctatgcatttttcataaaaact

SEQ ID NO: 139225 - DNA, 601 bp, Human
attatggagatatataagacagtgtcccatccattctacacaatttacagaaaataaaggggacacaggaatattttaaatgtttaaccacttaaaccatggagatataaaatccagactacgaaaaacaatgaataataatcacctcagtttcttcaacaactgaactgaaagaaaaaagatgacagcaaaaaagagaaacctgtaagttataaaagacctatgagacttatcagtcaacaacaatgaagggaccggacgcggtggctcacgcctgtaatcttagcacttcaggaggccratgagggtggatcacctgatgtcaggagttcaagaccagcatggccaacatagcaaaaccccatctctactaaaacaaaatacaaaaattagccgggcatggtgacgtgcgcctgtagtcccagctagtcggtaggctgaggcaggagaatagcttgaactcagaaggcagaggttggagtgagccaaggtggcaacactgcactccagcctaggtaacagagcaagactccatctcaaagaaaataaataaaataacaatgaagaaccgtatttggatgctgactcaaacaaattgtaa

SEQ ID NO: 139226 - DNA, 601 bp, Human
gcagaggtttcagtgagccaagatcatgccactgcactccagtctgggcaacagagcaagactccgtctcaaaaaaaaaataattcttgcacttgctgtacttcaataccacaaacttattctgacatagttttctcattaagaaatgtttaaggagaatggtgtgaacccgggaggcagagcttgcagtgagccaggatcgcgccactgcactccagcctgggcgacagagcgagactccgtctcaaaaaaaaactaaaaataaaaatcaataataaaaaaaaagaaatgtttaacttcraagtccaatattcaaattcttcttttaaggtgagtcattaggccaggcgcggcggctcacacctgtaatcccagcactttgggaggcccaggcaggcagatcacttgaggtcaggagttctggagcagcctgccaatatggtgaaaccctgtctctactaaaaataccaatgaaaagttagctgggcatggtggtgcatgcctgtaatcctagctacttgggaggctgaggtgggaggattgcttgaacccaggaggcggaggttgcagtgagccaagattgcgccactgcacactccac

SEQ ID NO: 139227 - DNA, 601 bp, Human
aaacaatgtaggccgggcgcagtggctcaagtctgtaataccagcactttgggaggacaaagagggcggatcacttgaagccaggagtttgagaccagcctgggcaacatggtgaaacactgtctctattaaaaatacaaaaattagccaggtgtggtgacgcatgcctgtaatcccagctactcgagaggctgagacacaaaaactgcttgaactcaggaggtggaggttgcagtgagccgagatcacaccactgcactcctgcctgggcgacagagtgagactctgtctcccccccacaaaaaaaaaaaagcactaaggaatgtaatcttttgttttgacctatttcaaataaagaataatatgaaagtaccattttattatgaaagtttttcactatgtcacaactcacctaaaaaaacaaaaactaaaaccaaatgtttaggcttaaacatttgaaaactacaaagtaattctgatcaatccattatgacatcaattttctaatgctaggctctatttccactcatcaccatcatgcaaaatgctataatcttagattattcctccatgtattcttgtaaatcaagtattttcttcc

SEQ ID NO: 139228 - DNA, 601 bp, Human
gctgccactgctcaggaaccctatagagaattctttcctctttttcagttgctatctaaggttgtaacacattcttttgattttcaataacaaaaaatcttaaattctttgaagatgaagaagatatttgcaaagagtcaaatgccaataagtaaagtgaatgatcaagctaaacaatgtaggccgggcgcagtggctcaagtctgtaataccagcactttgggaggacaaagagggcggatcacttgaagccaggagtttgagaccagcctgggcaacatggtgaaacactgtctctatyaaaaatacaaaaattagccaggtgtggtgacgcatgcctgtaatcccagctactcgagaggctgagacacaaaaactgcttgaactcaggaggtggaggttgcagtgagccgagatcacaccactgcactcctgcctgggcgacagagtgagactctgtctcccccccacaaaaaaaaaaaagcactaaggaatgtaatcttttgttttgacctatttcaaataaagaataatatgaaagtaccattttattatgaaagtttttcactatgtcacaactcacctaaaaaaacaaaaacta

SEQ ID NO: 139229 - DNA, 601 bp, Human
gaagttctggttgacaagttttttactggatcaagcatctatcatgtttcaagttccatgagcaattctgaaccactggtacagaggatacatgtctatgtgtttattctaacagtgctgccactgctcaggaaccctatagagaattctttcctctttttcagttgctatctaaggttgtaacacattcttttgattttcaataacaaaaaatcttaaattctttgaagatgaagaagatatttgcaaagagtcaaatgccaataagtaaagtgaatgatcaagctaaacaatgtaggcygggcgcagtggctcaagtctgtaataccagcactttgggaggacaaagagggcggatcacttgaagccaggagtttgagaccagcctgggcaacatggtgaaacactgtctctattaaaaatacaaaaattagccaggtgtggtgacgcatgcctgtaatcccagctactcgagaggctgagacacaaaaactgcttgaactcaggaggtggaggttgcagtgagccgagatcacaccactgcactcctgcctgggcgacagagtgagactctgtctcccccccacaaaaaaaaaaaagc

SEQ ID NO: 139230 - DNA, 601 bp, Human
gcatcgtatttcagaaaaaggctgtaaagcttgaccatgttttctgctgctgattccacaatattaggtggaaatcccatcttctgtgcaagctgaaatcaatatgtctttttattataggtagtttgcatatgtctaatcaacattactataaataaaaagccttgtagtttatcacttaaatgataaacatgagtcatttatagtcaaacattactgaaatagcagctaccattactaaatggttaaacaaaactttttattcaaaatcttcaaaagatagatattatgcccattttayagataagaaagagattcagagagatcaagtaacttgccattcattggcctagattccagttccatagtgtccatactgcctaagctttactgccaacctaagctgaaagaagaggtttatattttattaaaactatatataaaatgtgagccgggcacagtggctcacacctgtaatgcctgcaatttgaaagactgaggggccagatcacttgaggccaggagttacggaccagcctggccaccacagtgaaaccccatctctactaaaaatataaaatgtggactgacaacccttatg

SEQ ID NO: 139231 - DNA, 601 bp, Human
gtaaaatattaattgattaaagacttaaaagtaaaaatgaaacaatttaaaaaatagaacatctctaactaaactgacccaaaagaaaaaaacagaacacattgaggatgaatatttactgatcttaagatggagaataaaaaaatctctcagcataaaagtaatggaactcggctgggcgcagtgactcacgcctgtaatcccagcactttgggaggcaggggcaggcagattacctaaggtcaggaggtcaagaccagcgtggccaacatggtgaaacctcatctctactaaaaacacaaaaaaattatccaggcgcggtggtgcatgcctgtagtccaagctacttgggaggctgaggcagaagaattacttgaacccaagaggtggagatggcagtgaacccagatcacgccattgcactccagtgtgggcgacaaagcaaagcaagactcagtctcaaaaaaaaaaaaaaaaagtaatgagatttgagtacatgcaaaaacaaaaatatttccccaaaaatcaaataacattaaacaataaaggacaatctcagaaaaagattcacaccaaatgtcagaaaaaagattgacatccc

SEQ ID NO: 139232 - DNA, 601 bp, Human
aggctgggtgtgatggctcacacctttaatcccagcacttcaggagctgaggtaagaggatggcttgagtacatgcgttggatgagcctaggcaacatattgagggcccgtctctacaaaaaattttaaaaagaattagccaggcatggtggtggcatgggcctgtagtcccagctactcaagaggctgaagagggaggatcgcttgagcccagaagtttaaggctgcagtgagctgtgattgtgtcagcgtactccagcctgggcaacaaagcaaaaccgtgtctcaaaaaatttaaaawtataatattttatattaatttccaatgttattgctttgtgtttacagatcattatctgtgttataaattcttggatatctgctgaaactttttaatttgtgactcagtattaaggttttttaaatcagtatttggattaaaaaagtgtttttctaaatgttgggtagcccattaaatttttaaaaagttgggggaagaggggcataaggaacatctagtgaaggcaatttaatctaattttagttttactagaaagcttaaaaaaagaaaataaagttctcactgcagaacctttacttt

SEQ ID NO: 139233 - DNA, 601 bp, Human
ttctttaaataaaaaaaaaaaaataggctgggtgtgatggctcacacctttaatcccagcacttcaggagctgaggtaagaggatggcttgagtacatgcgttggatgagcctaggcaacatattgagggcccgtctctacaaaaaattttaaaaagaattagccaggcatggtggtggcatgggcctgtagtcccagctactcaagaggctgaagagggaggatcgcttgagcccagaagtttaaggctgcagtgagctgtgattgtgtcagcgtactccagcctgggcaacaaagcaaraccgtgtctcaaaaaatttaaaaatataatattttatattaatttccaatgttattgctttgtgtttacagatcattatctgtgttataaattcttggatatctgctgaaactttttaatttgtgactcagtattaaggttttttaaatcagtatttggattaaaaaagtgtttttctaaatgttgggtagcccattaaatttttaaaaagttgggggaagaggggcataaggaacatctagtgaaggcaatttaatctaattttagttttactagaaagcttaaaaaaagaaaataaag

SEQ ID NO: 139234 - DNA, 601 bp, Human
aagtaattgccgtttttaaaaaaaaaaaaaaaaaggcaaaaactgcaattacttttgcaccaacctaaatattaagaaactgacccctttgataatgagtattcctcacaattcctacattccttgcagttgttcagtttgaaatattttctcatttccattattatttcttcattaattcagaaattattttcaagtattttctttaaataaaaaaaaaaaaataggctgggtgtgatggctcacacctttaatcccagcacttcaggagctgaggtaagaggatggcttgagtacatgmgttggatgagcctaggcaacatattgagggcccgtctctacaaaaaattttaaaaagaattagccaggcatggtggtggcatgggcctgtagtcccagctactcaagaggctgaagagggaggatcgcttgagcccagaagtttaaggctgcagtgagctgtgattgtgtcagcgtactccagcctgggcaacaaagcaaaaccgtgtctcaaaaaatttaaaaatataatattttatattaatttccaatgttattgctttgtgtttacagatcattatctgtgttataaattcttgga

SEQ ID NO: 139235 - DNA, 601 bp, Human
cttttactttccatataaattgcataaggatccactcttggatggttcttggacagtttttagttaatccttagataattacatttaagttagataggctggtgcaaaagtaattgccgtttttaaaaaaaaaaaaaaaaaggcaaaaactgcaattacttttgcaccaacctaaatattaagaaactgacccctttgataatgagtattcctcacaattcctacattccttgcagttgttcagtttgaaatattttctcatttccattattatttcttcattaattcagaaattattttmaagtattttctttaaataaaaaaaaaaaaataggctgggtgtgatggctcacacctttaatcccagcacttcaggagctgaggtaagaggatggcttgagtacatgcgttggatgagcctaggcaacatattgagggcccgtctctacaaaaaattttaaaaagaattagccaggcatggtggtggcatgggcctgtagtcccagctactcaagaggctgaagagggaggatcgcttgagcccagaagtttaaggctgcagtgagctgtgattgtgtcagcgtactccagcctgggcaac

SEQ ID NO: 139236 - DNA, 601 bp, Human
aactcaattcaatgtgtgatcctggtggtcctggggaaaaatagtataaaggacatcagtaggacagctggctacatttgaatatgtattatgaattagataatattttctcagtattaaatttcttggttttaataaatgtagtcaggttatataagagaacgttcttggcttgcgcctgtaatcccaggactttcggaggccgaggcaggcagatcacgaagtcaggagatcaagaccatcctggctaacatggtgaaaccccatctctactaaaaatacaaacaattagccgtatgcrgtggtgagcacctgtagtcccagctactcggcaagctgaggcagaagaatggtgagaacccgggaggtggagcttgcagtcagccgagattgcaccactgcactccagcctgggcgacagagcaagactctgtctcaaaaaagaaaagaatattcttgtttttagacactagaagaacaatgtctccaacttactcttaatggttccaaatatatttgtatttttatacacacaaatgcatgtgtacacagacagaaagagagcagaaagagaataaaacacagggtgaaatgtaaacaa

SEQ ID NO: 139237 - DNA, 601 bp, Human
aaaaacaggaacaacaaaaaataaggtcaagaaataaatcaaacttccagatctgttccaggtcaaatggatgtgacaactcaattcaatgtgtgatcctggtggtcctggggaaaaatagtataaaggacatcagtaggacagctggctacatttgaatatgtattatgaattagataatattttctcagtattaaatttcttggttttaataaatgtagtcaggttatataagagaacgttcttggcttgcgcctgtaatcccaggactttcggaggccgaggcaggcagatcacgaartcaggagatcaagaccatcctggctaacatggtgaaaccccatctctactaaaaatacaaacaattagccgtatgcggtggtgagcacctgtagtcccagctactcggcaagctgaggcagaagaatggtgagaacccgggaggtggagcttgcagtcagccgagattgcaccactgcactccagcctgggcgacagagcaagactctgtctcaaaaaagaaaagaatattcttgtttttagacactagaagaacaatgtctccaacttactcttaatggttccaaatatatttgtattt

SEQ ID NO: 139238 - DNA, 601 bp, Human
cgtctctactaaaaatacaaaaaattagccgggcgtggtggcgggcacctgtagtcccagctgcttgggaggctgaggcaggagaacggcatgaacctgggaggcggagcttgcagtgagctgagatcgtgccactgcactccagcctgggtgacagagcaagaccccgtctcaaaaaaaaaatgtcatcactgggtgaagggcatgcaagactattaatttaacaacctcctgaaagtctgtatttgtttcaatattgtaagttaaattataattttatttataatttttcatttatttaaaaaaaaaaaaaagaggccacaggagcaagcctgaaagtggcctctgctggccaaatctgggacagtctgcgtaacaaaataaggattaaaatggataactcattgattaaagaatggatgagcccatcctgatacaaacgaatggggcagaagagaaagctcttccgtataatacaaagccaactagtaaatatagagggaatgatgtagttagaaaatcatcagcagatgccaaaactaatgggtaaaagtttgacaaggaatataatattttcccacaaatttcatagtaattacaa

SEQ ID NO: 139239 - DNA, 601 bp, Human
agaggtctcctgtgttgatggaacagtctgtatcttgattgtggtagtggctactcaaatctatgtatggaataaattaaataaaattatacatatacacacaaataactgcaggtttaaaatgttaaaaaaaatgttgaaaactaagtaaaatatttagtctagctaacaataatgaaccaatgtcaactaactgtttgggtatatacagctaaataagatgtcatcattgggccaggcgtggtggctcacgcctgtaatcccagcactttgggaggccaaggcgggcggatcacaaggycaggagatcgagaccatcctggctaacacggtgaaaccccgtctctactaaaaatacaaaaaattagccgggcgtggtggcgggcacctgtagtcccagctgcttgggaggctgaggcaggagaacggcatgaacctgggaggcggagcttgcagtgagctgagatcgtgccactgcactccagcctgggtgacagagcaagaccccgtctcaaaaaaaaaatgtcatcactgggtgaagggcatgcaagactattaatttaacaacctcctgaaagtctgtatttgtttcaatattgta

SEQ ID NO: 139240 - DNA, 601 bp, Human
agggcacagggacagggtaggaaagaattggtagacaatgtgaatgcaaagaggtctcctgtgttgatggaacagtctgtatcttgattgtggtagtggctactcaaatctatgtatggaataaattaaataaaattatacatatacacacaaataactgcaggtttaaaatgttaaaaaaaatgttgaaaactaagtaaaatatttagtctagctaacaataatgaaccaatgtcaactaactgtttgggtatatacagctaaataagatgtcatcattgggccaggcgtggtggctcamgcctgtaatcccagcactttgggaggccaaggcgggcggatcacaaggtcaggagatcgagaccatcctggctaacacggtgaaaccccgtctctactaaaaatacaaaaaattagccgggcgtggtggcgggcacctgtagtcccagctgcttgggaggctgaggcaggagaacggcatgaacctgggaggcggagcttgcagtgagctgagatcgtgccactgcactccagcctgggtgacagagcaagaccccgtctcaaaaaaaaaatgtcatcactgggtgaagggcatgcaaga

SEQ ID NO: 139241 - DNA, 601 bp, Human
caaaaaaatgtatcgaagaactgcaactcaccagatcaccacatccagacaatgagactcttaccacgtattcatcatgactgcttccttgcccctccctagttcttgttttcttacacattgttacgtttcttccctgccatataaacccctggttttagtcagggagatagatttgagactgagatcctatctcctcagctgcagcacccaattaaacccttcttctttggcaatacttctcagtgattggctttctgtgcagcaggaccttgaccaaacccctggtgttttggtaacraaaggaataactatattgaagctaataaaaaccatttatgtaaatgttgaataagaaaattataaacatagaaagtggtaaagctagaatgaaccttgaagaactcaagtggaattagagttatcagtataaatttggagatttttaaaaacacagatagaaggccaggtgcagtggctcacgcctgtaatcccagcactttgggaggctgaagcaggcggatcacctgaggtcaagagtttgagaccagcctggctaacatggagaaacaccatctctactaaaaatacaaaaaagtag

SEQ ID NO: 139242 - DNA, 601 bp, Human
acttaggagtttttcctcaggaagggaccttgggacctctcaaaaaaatgtatcgaagaactgcaactcaccagatcaccacatccagacaatgagactcttaccacgtattcatcatgactgcttccttgcccctccctagttcttgttttcttacacattgttacgtttcttccctgccatataaacccctggttttagtcagggagatagatttgagactgagatcctatctcctcagctgcagcacccaattaaacccttcttctttggcaatacttctcagtgattggctttctgygcagcaggaccttgaccaaacccctggtgttttggtaacgaaaggaataactatattgaagctaataaaaaccatttatgtaaatgttgaataagaaaattataaacatagaaagtggtaaagctagaatgaaccttgaagaactcaagtggaattagagttatcagtataaatttggagatttttaaaaacacagatagaaggccaggtgcagtggctcacgcctgtaatcccagcactttgggaggctgaagcaggcggatcacctgaggtcaagagtttgagaccagcctggctaac

SEQ ID NO: 139243 - DNA, 601 bp, Human
ctccagaatttggaaactgtgaatattcttaattcatggaaaatgtgtttatttgcatatatttaataaaaacctgttttcttttgtaatgggacacagccagaggaactggctattttcctaggactttgactcaaatgaccttgtgaaatgttccagcaaagccaatttggaagaatctatgggcaatgattcttgtcgcactgtgtgtgggtaatcaggccaagtatatgggactgaagattattttgcaggtagattggtagaagcttattttgcaggtagatcctgctgtgatttstctttggtggaagtggtacaccagagagagaaatattatgtgtcagaagaaactctctattagatgaaactttgattcctgggtggctacatggtcacctatggtatggagctgcctatgacacccttcctcagcatgaagcagccagaaagaccaatgactggattcctcatgattgaggaactgataaatagaaagggaagactgaaactgacccaacagtcccatagactgttcttttggataaacacagaaattgacctttctggtcttaaagcttaaaacttaggagtttttcct

SEQ ID NO: 139244 - DNA, 601 bp, Human
ctttaataagtagaatttgaggcatatttctctctctgcctaatttctccagaatttggaaactgtgaatattcttaattcatggaaaatgtgtttatttgcatatatttaataaaaacctgttttcttttgtaatgggacacagccagaggaactggctattttcctaggactttgactcaaatgaccttgtgaaatgttccagcaaagccaatttggaagaatctatgggcaatgattcttgtcgcactgtgtgtgggtaatcaggccaagtatatgggactgaagattattttgcagstagattggtagaagcttattttgcaggtagatcctgctgtgatttgtctttggtggaagtggtacaccagagagagaaatattatgtgtcagaagaaactctctattagatgaaactttgattcctgggtggctacatggtcacctatggtatggagctgcctatgacacccttcctcagcatgaagcagccagaaagaccaatgactggattcctcatgattgaggaactgataaatagaaagggaagactgaaactgacccaacagtcccatagactgttcttttggataaacacaga

SEQ ID NO: 139245 - DNA, 601 bp, Human
tacaaagttttaatgttcagaaaagacgggccctgtcattaaggaaattatattgattaggatttctcttcaaactaatttagttgtgtggaccattattaaaattaagtgacattcatttgaattaagtagttaaaaaaaaaaaagagagactttctagtgacttttgatcccaagaagtttatcaatgatgggctttcatctgtacttgtaaacagaatatgtgcaggtgtcgcactggtttgaagatgaacactcataatgaactgcttttatgagacacagggccagaagttaaaaygattcaatccctctaggcccagggatcactgcggaagaggtagccatgtaagactgtaaaggccgattttgagggataagatcagagtttttctataaattaaacattaataccaaaagcacactgatgcaaggccagcatctgggtctatgtgttagaagaacatggttttcttggagcactgatatgctctttaaaaagaaaattggggccagttattaaaagtttatggaaatcttaccttatggtcaaactgattaaaattagatagatttgtttatacagttttattaactttaa

SEQ ID NO: 139246 - DNA, 601 bp, Human
agcaatttagcaattcttaatagttaagcatgaagccagatctagtgtggacccatatttcacatacatgcttacattgcttcacactatgttagctgttttgcatggatactgctggagtatttactgatcatgggcctagagtgaatttcttgattgcacaagatgtatggtgatattggtggacttaaggttattgaattgtgtaccaggaataaaatattcatcatgtggtttttttgggaggttctgggtaacactgtagcctccagggtagactgagtaggggaaagattgaggsctgggtttcctgtttgttttttgcttctaattttcatttgtttgctgttgttctcctgtgggttttgcttgtgtatacatatatataaaaccgtaaactttttaagtttctaatggaaagcttttgtttggttctacaatttgccctatttatctaaagttcctaagctactgtggtcaagcctttaaaaattgatagaggacaccagccatttaaaatttggtggattttgcttacctctaatgatctaaagaactacaagagctttaagatttctggcacacacacaaaaataataat

SEQ ID NO: 139247 - DNA, 601 bp, Human
gtgtaaccatgtaaactcagtgagtttgtattgctatctcatggctagagttccaaggtaaacactactggattttcatttgtgtgtgtgtatacatacatgtctagatgtgtttatttgtatgaacacttattgttatatgttgtgtctaccaaattggcttataagtaaaagagcactcataaattaagtccaagcaatttttaagttcatgtgagttaagtaaatctttactaaacaagctagctttaaaatagttagtaaaatgaaaatagcaacgtcctcagaattgtcagcatayatttttgcctggattttatatttgtctctggtaggtattttgaggtgtcagggtttggcatagaaggttataaaactataaacccagccaaaacaaaatgatctttgtgcaaattttttgaaaagagtaattaagttattggtttaatgaaaatagttattggtgaaaatgcctatgtagttaactttaaagttattatttcagtgaatgactgatattcatagattataaaatggttaataaggaaataactttaaatgatggcatctaatatatgttttcagaagtaatctagataaa

SEQ ID NO: 139248 - DNA, 601 bp, Human
gtaatccacccgcctcagcctctcaaaatgctgagattaaaagtgtgagcaactgagcccaacttgtgcctgttttcaaatggcctgtaagctaagaatggattttacacttttaaaggattatgaagtcaaaaggggaaaagaaagagaagaagaagaagcaaaacagcagcatcaaaaactatatgtgatccataaagcctaaaatacttattaaatgccaacccctgtgcttaaactccttgtaccaaatttttttcctgccattctctcttatacccactctaatcaggcttttacycccagcactctaccaaaatggctcttaacaaaggtcacctctctgacttcacctttcagtaccctaccccttcctcactccaatctaaccacaacattctccttgcagctcctgaaaagatacagggttgaaagaagcaagcaatttcagctgctgcccaacacaggagaaaaagtttggagcccagctaagttaagtacccttaataccaaaagtcaatattctttcagaggaagataacagaattcagtctttacaccatagctcccaaaatgcacagtgtatgagtcaaacttacta

SEQ ID NO: 139249 - DNA, 601 bp, Human
ccacattgacaccctgggtttccattctgtttccaactctgatgcccatcatgtcagtcccctacactgtaactcttcatatacttttctccattcttgcacctgggccctaaaagccatgcttagaaaaataaacaactagaattctaattctagttgtaagtactcaactcaattctagtagtaagtactcaacagttagataattagattgtctttaatactctgcttctcgagtttgtcaaaagaagctatagaaatatagttctaataaaatgtttacttgttttagtaattactraacaagggaaataatgcacattttacatctcatttagtttaatcctccttgcaaaattaataaatatggaaaataaggctgtaggctcaaaggaaaaggcattgaaataaatttatattttaaacaattttacggtctaacaccacaaataaaaatatacattgccagcagcatcatcaataataaatattgattaatgacctacatatgtactgggcattataccagacactacgagaagcaacaattagtaagatatcatccctatcagtgaagaattctcggtttaaatccagtaag

SEQ ID NO: 139250 - DNA, 601 bp, Human
ggccctctctggattctatgtctttgtacattttcttcctcttgccctcatttaattttcaagacagcttaaggtatcatccattcagtgaaggccaccctgattctcccagtttttgcctctgtcctctgttcttccacagcactactttgtgtcaatcaccccagtaaaactataagtaacttaagagaagggcccatgtatttccaagtccaagcacagtgaccatcacaaaatatatggccacttcaatgctatccacattgacaccctgggtttccattctgtttccaactctgaygcccatcatgtcagtcccctacactgtaactcttcatatacttttctccattcttgcacctgggccctaaaagccatgcttagaaaaataaacaactagaattctaattctagttgtaagtactcaactcaattctagtagtaagtactcaacagttagataattagattgtctttaatactctgcttctcgagtttgtcaaaagaagctatagaaatatagttctaataaaatgtttacttgttttagtaattactgaacaagggaaataatgcacattttacatctcatttagtttaa

SEQ ID NO: 139251 - DNA, 601 bp, Human
cttaccaccccatgaacataatggccctctctggattctatgtctttgtacattttcttcctcttgccctcatttaattttcaagacagcttaaggtatcatccattcagtgaaggccaccctgattctcccagtttttgcctctgtcctctgttcttccacagcactactttgtgtcaatcaccccagtaaaactataagtaacttaagagaagggcccatgtatttccaagtccaagcacagtgaccatcacaaaatatatggccacttcaatgctatccacattgacaccctgggttwccattctgtttccaactctgatgcccatcatgtcagtcccctacactgtaactcttcatatacttttctccattcttgcacctgggccctaaaagccatgcttagaaaaataaacaactagaattctaattctagttgtaagtactcaactcaattctagtagtaagtactcaacagttagataattagattgtctttaatactctgcttctcgagtttgtcaaaagaagctatagaaatatagttctaataaaatgtttacttgttttagtaattactgaacaagggaaataatgcaca

SEQ ID NO: 139252 - DNA, 601 bp, Human
ctccaatataagaagtacaatatcttttcaatgaactgtctactagatatagtcaccacaatccaaacttgacattcattctgaaatacctattcctcgactttgcctctgacagcatgaaagtcatcaccacccaatgattctccccagcccaaagtcctaatgttaacttaaccaacccttctatgaggctcccagaaaagaagaaaaaaaatgaatttaatgaccctatctcagaaatgcctctaatttattcttactgatattgcctttgtcagggatctcttccacaagagaattyattatgaattctcttgtgtatgtgctggggtagggagttaaaatccaaactccttaactatagataatagggatcttcacaaatgtggtcacaatttgccaacattatctcttatcatttatcccaataatgccatattcttacacataagcatcttaccaccccatgaacataatggccctctctggattctatgtctttgtacattttcttcctcttgccctcatttaattttcaagacagcttaaggtatcatccattcagtgaaggccaccctgattctcccagtttttgcctctg

SEQ ID NO: 139253 - DNA, 601 bp, Human
tcttacgaaggttcccactcacctctttcagttcttactctgtctgaatagtcctacaacatttgacattgtttcccaatgccttacttctcaaaactcttcaccttggtccttcgatgtcaccactctctcccgatctgttcttatctctgtcatttgttctctgtttttcatttgggttttccttctctattcaacccttcaacaaaaatggaggggccaggttccattcttggttcctcatctcacttgcacagatcacctcaccaactcctaagacttcaacttttctccaatatargaagtacaatatcttttcaatgaactgtctactagatatagtcaccacaatccaaacttgacattcattctgaaatacctattcctcgactttgcctctgacagcatgaaagtcatcaccacccaatgattctccccagcccaaagtcctaatgttaacttaaccaacccttctatgaggctcccagaaaagaagaaaaaaaatgaatttaatgaccctatctcagaaatgcctctaatttattcttactgatattgcctttgtcagggatctcttccacaagagaattcattatgaatt

SEQ ID NO: 139254 - DNA, 601 bp, Human
ctctaacttttagcatacaaccttcctttctttagtggcacctcaagaaaggagtaaccacctttccaaagctgacctggccagataattatctccatctatttactacatagtatttcctccaggtcttcacccctctagctacattcactctctttattttcaaatctcttctcttcctccaactagaaagagctcatcttcttgatcttctaaacaagcaagaaaacatacaccacaaaactctcctcagtcctactgcctttgactgatagcactgcatcccttccatgcctttgtaaaaaaaaaaaaaaaaaaagtcctggaagagtaatctctcctggatatctctattccctcaattcctcatcaaatcaatccattacaatctggcctatgcccccatctcttctactattcttacgaaggttcccactcacctctttcagttcttactctgtctgaatagtcctacaacatttgacattgtttcccaatgccttacttctcaaaactcttcaccttggtccttcgatgtcaccactctctcccgatctgttcttatctctgtcatttgttctctgtttttcatttgggtttt

SEQ ID NO: 139255 - DNA, 601 bp, Human
tcagtgtcactgccacctgcatgctcaattctgtcatacctattcctctgccatcctacttcaaacaatgcatctttggatgattccagccatagcttattcagggaaaagtaaaaaagtaaaaactgaaaacaaaactggaaacactagcataacctgaagagcaataaaataataattcatcagcaatcctcaacttagcagtcggcctcatacctttaactctcttcataagccttctatcccatgcaagctctctaacttttagcatacaaccttcctttctttagtggcacctcargaaaggagtaaccacctttccaaagctgacctggccagataattatctccatctatttactacatagtatttcctccaggtcttcacccctctagctacattcactctctttattttcaaatctcttctcttcctccaactagaaagagctcatcttcttgatcttctaaacaagcaagaaaacatacaccacaaaactctcctcagtcctactgcctttgactgatagcactgcatcccttccatgcctttgtaaaaaaaaaaaaaaaaaaagtcctggaagagtaatctctcctggat

SEQ ID NO: 139256 - DNA, 601 bp, Human
tagtccctcaatccctctctaatcttctactctattagctctcaatggaactgactttcttcactatagagcctgggacatatggctaagcaattcagtgtcactgccacctgcatgctcaattctgtcatacctattcctctgccatcctacttcaaacaatgcatctttggatgattccagccatagcttattcagggaaaagtaaaaaagtaaaaactgaaaacaaaactggaaacactagcataacctgaagagcaataaaataataattcatcagcaatcctcaacttagcagtcrgcctcatacctttaactctcttcataagccttctatcccatgcaagctctctaacttttagcatacaaccttcctttctttagtggcacctcaagaaaggagtaaccacctttccaaagctgacctggccagataattatctccatctatttactacatagtatttcctccaggtcttcacccctctagctacattcactctctttattttcaaatctcttctcttcctccaactagaaagagctcatcttcttgatcttctaaacaagcaagaaaacatacaccacaaaactctcctca

SEQ ID NO: 139257 - DNA, 601 bp, Human
cttgggtacatttcacatccaaatctcaggacctgtttgggtcagcattctttcaacatcacaatgatagttctgaatcagtgttctcctatcctttccaaataatctctctttttttaaaaaaagaggtttagttcactcagctataccagggcttctcaaacaatgagattaaaatgcattgtagatacaccaaaatatcgttcccctcaattcttggggcagctagtaatgttctggggcagcaggagcctcagggccagtggactctgactacaagcaatcttctccatctacctcyaaggccccattgaaataccttctgtgaatgccatgacatgaaaaggggtgagacacactgagctatactatacattctttaccttaccactattattcccagacctttaagaaatgaagctctggaattcataacagactagaactcatagcagcctttggcatctctcatctctctccctctcacctcattctggatagtttccatattcaccaccaggcaccatctaacactccagccttaaagttcttggatctttactctaccaagccactttcacctgtagtcaatttaaacgaa

SEQ ID NO: 139258 - DNA, 601 bp, Human
gaaacaatgcctgtagcataaatgacaactcataaagatgtttacctaacttcctcaatggtcacaagtttgacaagagggtctgagatgtgaccagctgtgcaagtgttaccaagaaaaaaagctcactacataaaggataatttctggagggctagtgtggggatccaccatctcgcagccacccaagccatagcttctgtttctaagtccctatataaatttagtttctttctgagaactggatttgccagcctctttctctggcctctcagatcccctggcctctgggggtacataygcatagacctgctcactgcaaaacaatccccatcaatgtaatcaacgttttacacaaaccaggccctaagaatcacccagcttctcctgtatggccctctcttgggtacatttcacatccaaatctcaggacctgtttgggtcagcattctttcaacatcacaatgatagttctgaatcagtgttctcctatcctttccaaataatctctctttttttaaaaaaagaggtttagttcactcagctataccagggcttctcaaacaatgagattaaaatgcattgtagatacaccaaaata

SEQ ID NO: 139259 - DNA, 601 bp, Human
cactaggggtcttgcaacacattccctgcagataaggggggactactgcacacatacatatagttatatacatacaattagcttatgtttttaagaagtggaaagataaaccaaaactttcttaaaaaacaaacaaacaaaaaaggtaaaaaggttgcctgttggggaagaagtaaagagggaaatatataaaagctagattccctgataataccttgttctatactttccactttggaatcatgtaaatacaaaataaaaaacaaaaggttgtgtttttttttttaaaaaaaaagcaatmcctttaaaaacaatgaaactatacaaagctgagacaaaacacacagagaattatttcacatgaattttaaaatccactaagttgtgggacataccctaaaggacagaaagaaatgcagatataattgctttcagtaatcagactgttggtattcttattataaaactgtcatatctgtactaagggacaaagcaaatgaataattatgatagtatggcatgaacgaaggtacaaacagatgtcagataagaaaaaaaaatctatactcctggacttgcattgaaaatatcagtatgaact

SEQ ID NO: 139260 - DNA, 601 bp, Human
tggaactatctgtgattcaggcacccactaggggtcttgcaacacattccctgcagataaggggggactactgcacacatacatatagttatatacatacaattagcttatgtttttaagaagtggaaagataaaccaaaactttcttaaaaaacaaacaaacaaaaaaggtaaaaaggttgcctgttggggaagaagtaaagagggaaatatataaaagctagattccctgataataccttgttctatactttccactttggaatcatgtaaatacaaaataaaaaacaaaaggttgtgtttttttttttaaaaaaaaagcaatccctttaaaaacaatgaaactatacaaagctgagacaaaacacacagagaattatttcacatgaattttaaaatccactaagttgtgggacataccctaaaggacagaaagaaatgcagatataattgctttcagtaatcagactgttggtattcttattataaaactgtcatatctgtactaagggacaaagcaaatgaataattatgatagtatggcatgaacgaaggtacaaacagatgtcagataagaaaaaaaaatctatactcctggact

SEQ ID NO: 139261 - DNA, 601 bp, Human
ccacattcacatttatcacggtatattgttataattgttctactttattattagttgttgttaatctgttactatgtctaatacataaactttatcaaaggaatatatgtacaggaagaagcacagtatatacaggtttggaactatctgtgattcaggcacccactaggggtcttgcaacacattccctgcagataaggggggactactgcacacatacatatagttatatacatacaattagcttatgtttttaagaagtggaaagataaaccaaaactttcttaaaaaacaaacaaamaaaaaaggtaaaaaggttgcctgttggggaagaagtaaagagggaaatatataaaagctagattccctgataataccttgttctatactttccactttggaatcatgtaaatacaaaataaaaaacaaaaggttgtgtttttttttttaaaaaaaaagcaatccctttaaaaacaatgaaactatacaaagctgagacaaaacacacagagaattatttcacatgaattttaaaatccactaagttgtgggacataccctaaaggacagaaagaaatgcagatataattgctttcagtaa

SEQ ID NO: 139262 - DNA, 601 bp, Human
ctactatgaagtgttctctgatacacattattgttaagtaaaagaaacaaagtatagattaccattaatctaaagtgggaaaagggagcacacacacacacacacacacacacacagtcccccccttatccaatttcactttctacagtttcagttacctgcagtcaactgtggtccaaaaattttaaatgagaaattccagaaataaaaaagtcattaagttttaaactgtgtgttgttctgagaagtgtgatgaaatcttgcaccatcctgctccaagtggaatgtgaaccatctcttygcccagcgtatccacgctgtataaactactcttccattagtcatcaacattatctactcttgacatccaacaatcaacatcatggctcaatgatccaggatgaaccaaagcagatgattctccttctgttacatcattaggtcagtagtagcctaacactatgtcacaatgccttcatcattcacctcagttcatctcaccaagtaagcattttatcatctcattatcaccacaaaggtgagtatagaacaataagatattttgagagaccacattcacatttatcacggtatattgtta

SEQ ID NO: 139263 - DNA, 601 bp, Human
ctagcctgtttcttcatctataaaaatggaaattttatcaccaaattcatattaaatgagataatccttgaagaaaacagcttagcattgcatgcacagtaaacactcaataaacagtagtaactgctaatatcatcatcatctcattcaatattattattgttatgacttctataatctcccagtcaataaaaacactgtagtcataatttaaatcaactgttcacttttacctctcatgatctatttgatcaaggtcctactggttcttctccttcttttcatgtcctccaagcttttyttaatttaagttttcattccaaaaaagtgcactttcagagacaagttataacctatttattaccttcaccttttctcatatctaagtattgcactagatggactcctactatctctccccttttcccttcaatatatcccacatctcaaagtcaaaataggctttctgaaatactttctcctactattcccttgctcaaattctttatttttaattcaggtttaagtttaaattcttctgtctccaagctagagttaaattttgtttactagtaagtactttcccaaagaaggacataag

SEQ ID NO: 139264 - DNA, 601 bp, Human
aggttgatttctaaatgacttgccttgccttgaaataggaacagtgaactgattccctaaaaggattaaaggttttggttttcgtattggtattgttttcctgaagccattgcaaacaatcttggtctttaaagaaaatgtttggaatgcacagatgaaaattgcagtagcaaattattatgttagctctttgtttatctaacattcgttgtacctaaaatagattgagagtcaagtatccagtcacaacagtctcaaatatatgtagtcttaatgctatcacatatatatatatatatayacacacatacatttaaaaatcctattaacaaatataactgctcccatttagaaaggagagagtgagcgagcattggatgatgtcacttcagacagcttttctctgttccgctgtagtggagatttgaaactctggacaaacatcagaattacatttgctgagcaccattaaatctgacttctgacaatttttgtcatttctgaaatagtgactctgccagattctcaaaattgctcacgagttcaccatatttaaattttgtggtcattgcagctataagtaatcattggtagctccgtg

SEQ ID NO: 139265 - DNA, 601 bp, Human
attttttgtatttttaatagagacggggtttcaccatgttggcccggttggtctcgaactcctgacctcttgatcaactactattattaaagtcccagttttctctcctcatcattcttgttttggaatattacttcttatattactgttactgcttatccctgcctcacatgtcagtaacaatattgttggtacttttttcacagcaaggcattctggtaaagattgattcctgcaacataaaaacccttaggattcagtagctgtaccgatttcatttaaaaatgttatttattcattrcataataggtgttaatagaatttgagttttaccaaagtaatactaaattttaatatgcaaatatatagtcctgccctatgtcagaggaacatactttaaaaaaattgtagcatcattgtatacagtaaaatgcatagatcatgagtgtacagttagataattttaagtctgtatacctgggctctaactcccaatcaagctgaacattgttatcaactcagaaagttatcttgtgtccttttacaatttgttctccttagaggtaaccactattctaatttttctccccatagattaatt

SEQ ID NO: 139266 - DNA, 601 bp, Human
aacacttttaataaatctcttagattaaaaacttttaaatcttgagcatactttaatcccttctccatgactcggattgtattatggaacatcatttatctatcatacgtgatgttaattcttgactataaatcgctcaaagtacgagccatgtcttaatcacatttgatttcccacaggatctagcacagtatattgcaaatagcaagccttacttaataaatgctgaactaggctactgctcttgctaaatagccacagtttgttttacgttatgaattatgttgcatctctcccttcycttattatcacgctggctgctggtataacttttatgaatcataaaaaattaaataaccaggctttttaaaaaaatagatctaagttggccgggtacggtggctcaagcctgtaatccgagcactttgggaggccgaggcgggtgaatcacgaggtcaggagattgagaccatcctggctacacggtgaaaccctgtctctactaaaaatacaaaaaattagccgggtgtggtggcgggcgcctgtagtctcagctactcgggagacagaggcagaagaatggtgtgaacccaggaggcgg

SEQ ID NO: 139267 - DNA, 601 bp, Human
gataagtgaagtatttgtaagtgaaattcctcaagaaattgaattttaaaaaaatattcaatagtgctgagaagtgatttttgaatgaacatgagaagtcaaactctagcatggtttacaaaggtcttttgtgacctgcaccagcttcttgtccatcatttctcatactcatctccaccatattgggcactccagccaaagcacatgtggctcttggaaatgtcatgcattttagctccataaattttgaaaaatcattgccatatataaaatttcctttaactctatcttctgctgaggyaatgagtatttgtcctttaacattccactaaagtattttctcccttgggaagtcttcctgaaactcatcccctcttatgtgctctctgtgcattttcctattagagtttgtatcatatttattttctttttgtatatttatctgttttccggactgatctaacaggtctctttcttggcagagcatacatttccagtgcctagcacagctcttggcacatagtagacatttataatttattctcaaaatgattgttgaacagttaaaaatgatatattacaatgccttgaaacttgtcat

SEQ ID NO: 139268 - DNA, 601 bp, Human
gctacagaaaccatgacattctcatagcaatgcactgattcttagaatacacattgtttgttgttcagtgttaaattctatgtttgaaatctcaacctaggaacacactgtatcgtatcacattgttcttggttgcttcaacatctgggattagacctttttcagttgtatcatgttaaagttcctcattttagaattaaaaacatataatcttaggtttcattcgtaactgaattcttgcttcaaccaaatctatgttctaataccggggtccccaaccgccaggccacagaccagtacyggaactggtcttggctaggaacttggctgcacagtgagcattgctgcctgagctccgcctcctctcagatcagcgggggcattagattctcttaggagcgcaaaccctattgtgaactgtgcatgttagggatctaggttgtgcgctccttatgagaatctaatgcctggtgatcttctgaggtggaacggtttcaccccgaaaccatatcccaacacccctcagtctgtctgtggaaaaattgtcttccacaaaactggtccctggtgccaaaaaaggttgtgtagtgctgttccaatg

SEQ ID NO: 139269 - DNA, 601 bp, Human
agacacaactcctttggtctttgtgtcttcatttattaaaatgataatcattaaggtttttctagtcctgagccttctgttattctgtctggagataagatatttaactgtctttttcatattttaggacccagatgatgtggtaccagttggccaaagaagagcctggtgttggtgcatgtgctttggactagcatttatgcttgcaggtgttattctaggaggagcatacttgtacaaatattttgcacttcaagtaagtggaaaaattattttgtgtctctgatttttttttttttttgcctctcccgatgtgcattacaaaattgtttacaacttgcgctaagcttgtactttttatctgtgaccttcagccagagtggtagttctattttaaagctgtgtttaaacatctctccatgatatgtttgctgagcccatcacacacagtcactaaaagcagagtaacttgaaatgttggtgactaagggatttatttaggtcattgggtgattttactaacctttattttcctactataattaagggttgagaggaatagtattatcaattgccagttgaataaatacatcagccacaa

SEQ ID NO: 139270 - DNA, 601 bp, Human
tgtttgctgagcccatcacacacagtcactaaaagcagagtaacttgaaatgttggtgactaagggatttatttaggtcattgggtgattttactaacctttattttcctactataattaagggttgagaggaatagtattatcaattgccagttgaataaatacatcagccacaaatgttttcatgttgataggccataacttgatagtcagcttggactcccctatggtcctgctgtacccttgggcccagaatacagtaagaccatgtctctgcttcttttccagtcatggtttcacyaaagaactgggtgacttcagcagtgatattgaaataacataggatgaaagttgtttataactttgagtgtttaatagtaatcccagtgggttaagacaaaggtcttccttgtgattgattataatttacaatctattttgtaatatatttctcttggcaataatacacaatttttttttttaggagttttgaaggggaaattactttcaaggttttatgactacttcagctgtttcaaaatttggagaaacagttgacaactagacttattaaaataatttaactaattttgaaacattc

SEQ ID NO: 139271 - DNA, 601 bp, Human
tcactgcaccctctgtctcccgggttcaggcaattctcctgcctcagcctcccaagtagctgagattacaggcacctgccaccactcctggctaatttttgtacttttagtagagacagggtttcatcatgttggccaggctggtctcaaactcctgacctcaggcgatccacccaccttggcctcccaaagtgctaggattacaggcgtgacacaccatgcctggccctgtgcattcacattttgtatacccttagtctttattgtgtgtgtagtgtgtgtagtgtgtgtgtgtgtgtgygcgcgcgcgtgtgcgtgcgcgcacgtgtacatgtactgtgtgtttggctttttttgagatggggtctcactctgtcatccaggctggagtgcggtggtgcaatcacagctcactgtagcctcaacctcttgggctcaggcaatcctcccgcctcaacctccccaggagtagctgggactacaggtgcgtggcaccatacccagctaatttttttattttttgtggagacagggtctcaccatgttgcccaggctggtcttgaactcctgggctcaagcagtccatctgtctcaggcctcc

SEQ ID NO: 139272 - DNA, 601 bp, Human
caccttggcctcccaaagtgctaggattacaggcgtgacacaccatgcctggccctgtgcattcacattttgtatacccttagtctttattgtgtgtgtagtgtgtgtagtgtgtgtgtgtgtgtgcgcgcgcgcgtgtgcgtgcgcgcacgtgtacatgtactgtgtgtttggctttttttgagatggggtctcactctgtcatccaggctggagtgcggtggtgcaatcacagctcactgtagcctcaacctcttgggctcaggcaatcctcccgcctcaacctccccaggagtagctrggactacaggtgcgtggcaccatacccagctaatttttttattttttgtggagacagggtctcaccatgttgcccaggctggtcttgaactcctgggctcaagcagtccatctgtctcaggcctcctccccacaaagtattaggattacaggcatgagttactgcacccgaccttatgtactgttttttctttttgtaaaagtgagacagtagcataaagatttgctgtaatctaatattttccactgaattgtgatataaagggaaaagtagaactacgtatatgcatatagaaatttc

SEQ ID NO: 139273 - DNA, 601 bp, Human
aactctctatagccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaaggtgagccaagtgtccagaattgtagaaagaatgcaggttctgtagtttatgctttttgtagttttaatttcaatatttgctmatttattatatttagagtttagtttaataaactgtcagcatttggtgggctctgctatgtctgaagcagaccctgctgatgcagccttctcatatcttatctctccttccccttgccttacctactcttaaagcccacctcatgactgttcctcctttgctggcaaactaatattttttatatgttcccacattttcttagataagaggtaatttatgttcctgtttcttggtagcattttcaaaatcaataattttgttaatctgtttttaagttctcattctatatttttccccagct

SEQ ID NO: 139274 - DNA, 601 bp, Human
caactaatgttgtagctttgccaaatcatttaacttttattttctcacctgaaatataagaattacagtatctccccatttccttttaagagcattgtgaaaataaaaagaaagtacatgtggcagctgtggaaagtaagaagtgccattcagatacactgtggtgtgatttctttggaattgtgtcacccagtaaaagtgctttcctggctttttgctagcattttaaataatactgttctctcatctccggcggttgagtcatctgaaaccagcttgatttctttttttttttttttttccaacttttattttagattcaggggtacatgtgcaggtttgttacaaagggtatattatctgatgtgaggtttggggtacagatgatcccatcactcaggtagtgagcaaagtacccaataggtagtttttcttttcttttcttttttttattatactttaagttctgagttacatgtgtacaatatgcaggtttgttacataggtatacaggtgccatggtggtttgctgcacccatcaacctgtcaccaaattaggtatttctcctaatgttatccctcccctaggcccccacctccc

SEQ ID NO: 139275 - DNA, 601 bp, Human
tggggctgcggccccgaccccgcgcctgctatgaaagtaaagggaactaacgcgactttctccgcggtggacgctcggacacgcgtgaccgcctcaaacccactccaggctgccattggtactcgcccctttttacagatgaggaaatggagaatcagaccgggtcacgcagatagtatcaggcggggttggcaccggagcctggctggagccacagaggacacctccggagctgaggcgcagggcagttccctcagccgaacaccccgggagggagactcgcctggaagtgtctcggagmgacccttgctcgggtgctgccccttcagtgtcccggacgtgccgggcaacgcgatgaccagaccctgagcgctcttcgacccatgccccaagggccttggaggcgccccacaccccctgggaacctaggagcggggctatggaggggagggatgagagggacttgtcagaattcattattgactgcgaaagtcaccaccctctttccgggccctaaaagagacaatggcagggctgggaaggtgtatatcaaagcaagccaggccgcgtccccccctccacccccacaccttgacagatg

SEQ ID NO: 139276 - DNA, 601 bp, Human
gcttgcatcctcctgcttcagtctctccacagatttagatggcccctgcagccagattttctaactctcatggtcctctgccaggcagtggcccgcccggagggagctaggcggtccccacctgcctctcagagagccccagcgtggcggctagctcggctttcctccggatggtgatgtagcgactgtagtgaaactccttctccagctccagccgctggtggtccgtgtacaccactcgatatttgtctttcgtcctggttttcactgtggaggaaggagaagtgagggctgagaacarcaaggcagcccatcagtcatgggtaatgacaaacctccctaacccagggacatttctcttcctccaccaccctggggggcccgggtttggctggttcctgccaagtctgacaagaccccccagagggtcctgtggggggagggtatgaggctagtggaggcaactaaactaaccttggtattaagtggtttttaaaaattaaggaaagtgaaaacctcattcacacagaagacagcagaatgtaaccaccctttcggtaaaccaaatacagtactggcatatatttgacaccaagggaaa

SEQ ID NO: 139277 - DNA, 601 bp, Human
ccatatggcctgaaaagcagaaaatttatttactatctgatcctttacagaaaaagtttgccaacccctgttttagagccacataatgaaggatgtatttataaatgaaacagcagaatatcagaaattttaaaatgatgtagtggaaggaggggggaagatgaaacaaaaataagatatctctacttctgtgtacatttgatttctatataaaattttaaaaatctgtatccctctgtattgaagacttctcacacaaacacacatacaggcacacaaacatttaaaaaattctttctgyttttggtcgggcacagtggctcatgcctataaacccagaactttgggagactgaggcgggtggatcacctgaggtcaagagttcgagaccagcctggccaacatggtgaaatcccatccctactaaaaacacaaaaatgggccaggcacggtggctcaggcctgtaatcccagcactttgggaagtcaagttgggcagatcacaaggtcaagagatcgacaccatcctggccaacatggtaaaaccctgtctctactaaaaatacaaaaattagctgggtgtggtggcgcgcgcctgtag

SEQ ID NO: 139278 - DNA, 601 bp, Human
accatttcccagtaaaagaaaaaaaaaaacaggacttcttggcaaaagtgctggtttgaggtctagagcaagaagtgtacaaactgaacctagaacattctgtaataaagcaaggaagactactgaaggtcttataaaaaggtgacaggagccaatttaaagaggtttccaatggccagatatggaacaatttgagaactgaaaaaaaaaaaaaaaattcaggaaacaactccttctgcaaaccagtaaataaattgggagaagggtcaaggaaagcatttattctgtcttttctgtataraagtcccacatggtaaccagttgatgtggaaagatctatacagaaaagtcttggcgatcaaatgcagaaataatattagaattacagtacaatcattttgtaaaccttaataaaatattgaatctaggcaatgattatcagtagctgctaaaaattaccattatgtgaaaggctgatgggaactttataatgaaagaaagatacaacacttgaacccactgatcaatcttaatatcacaaaaagatattgtgtgcttcctgatgtgatacaatagaaaatacagaataccacctatactg

SEQ ID NO: 139279 - DNA, 601 bp, Human
gtttcaccgtgttagctaggatggtctcgatctcctgaccttatgatccgcccgccttggcctcccaagtgctgggattacaggcatgagccacttcgcccagccaaccagtgccttattaaccatgttgccctttgactgctccaacaactactgaagcatgtgtggagagaaagccccattagcctgggtccctgagaaaatctgatgaacagagtccctttattaatccatgttgaacatgtagggttaatgagaaatactcatatgttacatcactgagatttttttttttttttttgagatgggagttttgctcttgttgcccaggctggagtgcaatggtgcaatcttggctcactgcaacctccgcttccgaggcacaagtgattctcctgcctcaacctcccacgtagcttggattacatgcatgcgccaccatgcccggctaatttttttgtatttagtagagacagggtttcaccatgtcagtcaggctggtcgtgaactcctgacttcaagtgatccacccacctcggcctcccaaagtgctgggattacaggcatgcaccaccatgcccagtctgagatcttaatagtt

SEQ ID NO: 139280 - DNA, 601 bp, Human
attttagtagagatggggtttcaccgtgttagctaggatggtctcgatctcctgaccttatgatccgcccgccttggcctcccaagtgctgggattacaggcatgagccacttcgcccagccaaccagtgccttattaaccatgttgccctttgactgctccaacaactactgaagcatgtgtggagagaaagccccattagcctgggtccctgagaaaatctgatgaacagagtccctttattaatccatgttgaacatgtagggttaatgagaaatactcatatgttacatcactgagatttttttttttttttttgagatgggagttttgctcttgttgcccaggctggagtgcaatggtgcaatcttggctcactgcaacctccgcttccgaggcacaagtgattctcctgcctcaacctcccacgtagcttggattacatgcatgcgccaccatgcccggctaatttttttgtatttagtagagacagggtttcaccatgtcagtcaggctggtcgtgaactcctgacttcaagtgatccacccacctcggcctcccaaagtgctgggattacaggcatgcaccaccatgcccagt

SEQ ID NO: 139281 - DNA, 601 bp, Human
ttagcatcactcagaggagacttttggattgtttgatgaagctgaatcgttgatgaccagaaagcatgctgtggtaactctccctttttggacacatgggagaatggtactttcctcctccatttgaagttaggcatagccatgatacttgcattagtcaccagacaaaacggtagctgacactttcagtcacacacatgtttttggtgtttttttaaaattgatttttttaattctctactactgtgacattcaaggaaggcacatgcttttaaaagccagtgccttattattattattwttttttttttttttttgagacagagtctcgctctgtcgcccaggctggagtgcagctgtgtgatctcggctcaccgcaagctctgcctcccgggttcacgccattctcctgcctcagcctcccgagtggctgggaccacaggcgcccgccaccacgcccagctaatttttttgtattttagtagagatggggtttcaccgtgttagctaggatggtctcgatctcctgaccttatgatccgcccgccttggcctcccaagtgctgggattacaggcatgagccacttcgcccagccaacc

SEQ ID NO: 139282 - DNA, 601 bp, Human
agacctcatctctactaaaaatacaaaaaaatagctgggtgtggcggtatgcgcctgtgttcccagctacttggaaggctgaggtgggaggattgcttgagcccagggcacagaggttgcagtgagctgtgatcatataccactgcacttcacgcctgggtgacacagcaagattctgtctttaaaaaaaaagaaagaaaagaaaaattagccaggtggagtggctcatgcctgtaatcctagcattttgaactgagctcaggagtttgagaccagcctggggcaatatagtgagactccrgctctaaaacaaaaattttaaattagtcagacatggtgtcacgcgcctgtcgtcccagtaagagaattgcttgagcatgggaggccaaggctgcagtgagctgtgagagcagcactgcattctggtatgaccaagaaagtgagaccctctctcaaaagataaaagaaaaaaaaagaaaaattatcttaggaaagaagagtatcattggcggtcgaagcacagccataaagaaccttggattgggaaacctttttcctagaccagaaggaagcaatcacaaaagtctctctaccctgagct

SEQ ID NO: 139283 - DNA, 601 bp, Human
agaacaaaacattctctgaagcttgtgaagtcagatttcctatgttcagtatctgttgacttaagagtagctatcacagattaataatgacttgatacatatatatagactatatactgaagcagaaacagaaggatgtttagtcatcatccactttccatcaaaagatactttttttgtttttctttttttttttgagatggagtctcactttgtggcccaagctggagtgcactggcactacctctgctcactgcaacctgtgcctccagggttcaagagattcttgtgcctcagcctyccgaatagctgggattacaggtgtgcatcaccactcctggcgaatttttttgtatttctaatagagacagggtttcaccatgttggccaggctgatctcgaactcatggccccaagtgatccacccacctcagcctcccgaaaggctgggattacagttgtgagtcactgcacccagccaaaagatacttttatctgtacaaagggacttcttgcatattatctagggtagttaccaacttttaaggaaaaaattcaaaaaggaaaaacaacaccaattaaaattaacagtaaatactta

SEQ ID NO: 139284 - DNA, 601 bp, Human
tctacataaggatttgagacaggaatataatacaaagtcctcgtaaaacaaggaagagcactagcacctgaaaaatgttgagtcagaaatgatgagaggaaaacattaacagtaaagtgcctatctcaaaatgttatttagaggaggcattttatttcctcctacaccagtctccagaactcacgttaatattactaggattagattccacttcctaggggccagaatttggactagtaccattaggattacaatttacagactggtatgagcacctaactgcatttataacatgagataygatgtatacgatgttacaaacaattaacttaaaatgaacgtgtagaatacacatcacatataaactaaaactacccatagggttcacttttagatttgatgcatgactgaccaatttagcctcatgtgaaaaaaagatttactaaattttgccaaaatataattttttaaaagaaacactatataaaagaacttacaagtttatttttgtttcaaataactgaaattccattatagtatgattgtatttttgaaagacaacaatttactattatttctgtaaaatacagaattacttcat

SEQ ID NO: 139285 - DNA, 601 bp, Human
ttttttttaaaattttttgatttttttcagacggaatcttgcactatcgcccaggttggagtgcaatggtgcgatcttggctcgctgccacctctgcctcccaggttcacgtgattctcctgcctcagttttccaaggagctgggattacaggcgcacatccatcacacctggctaattttttgtatttttttttttttttttttttagtagagacagggtttcgctatgttggccagactggtcttgaactcctgaccttgtgatctgcctgccttggcctcccaaagtgctgggattayaggcgtcagccaccacacctggcctgataattctatttaaatcaacatgcaggtaacattagttttattttatgaatgggcaatgaaattttgaagtagaatgaggagataatttgggaatgtggagtagctgtcagggaagaaaaggtggatctacataaggatttgagacaggaatataatacaaagtcctcgtaaaacaaggaagagcactagcacctgaaaaatgttgagtcagaaatgatgagaggaaaacattaacagtaaagtgcctatctcaaaatgttatttagaggaggc

SEQ ID NO: 139286 - DNA, 601 bp, Human
agtactacaatctgtgttcactcttgaactacagtctgaaattccaacaacaaaaatatccacatactaaacaattattttctttttaagtgcaagtatttggaggatcagatcatctgtaattcagtagtaagttactttgataattttttttaaaattttttgatttttttcagacggaatcttgcactatcgcccaggttggagtgcaatggtgcgatcttggctcgctgccacctctgcctcccaggttcacgtgattctcctgcctcagttttccaaggagctgggattacaggcrcacatccatcacacctggctaattttttgtatttttttttttttttttttttagtagagacagggtttcgctatgttggccagactggtcttgaactcctgaccttgtgatctgcctgccttggcctcccaaagtgctgggattacaggcgtcagccaccacacctggcctgataattctatttaaatcaacatgcaggtaacattagttttattttatgaatgggcaatgaaattttgaagtagaatgaggagataatttgggaatgtggagtagctgtcagggaagaaaaggtggatc

SEQ ID NO: 139287 - DNA, 601 bp, Human
cccacatgcaaaatagcttacacagtactacaatctgtgttcactcttgaactacagtctgaaattccaacaacaaaaatatccacatactaaacaattattttctttttaagtgcaagtatttggaggatcagatcatctgtaattcagtagtaagttactttgataattttttttaaaattttttgatttttttcagacggaatcttgcactatcgcccaggttggagtgcaatggtgcgatcttggctcgctgccacctctgcctcccaggttcacgtgattctcctgcctcagtttyccaaggagctgggattacaggcgcacatccatcacacctggctaattttttgtatttttttttttttttttttttagtagagacagggtttcgctatgttggccagactggtcttgaactcctgaccttgtgatctgcctgccttggcctcccaaagtgctgggattacaggcgtcagccaccacacctggcctgataattctatttaaatcaacatgcaggtaacattagttttattttatgaatgggcaatgaaattttgaagtagaatgaggagataatttgggaatgtggagtagc

SEQ ID NO: 139288 - DNA, 601 bp, Human
atcccacatgcaaaatagcttacacagtactacaatctgtgttcactcttgaactacagtctgaaattccaacaacaaaaatatccacatactaaacaattattttctttttaagtgcaagtatttggaggatcagatcatctgtaattcagtagtaagttactttgataattttttttaaaattttttgatttttttcagacggaatcttgcactatcgcccaggttggagtgcaatggtgcgatcttggctcgctgccacctctgcctcccaggttcacgtgattctcctgcctcagtyttccaaggagctgggattacaggcgcacatccatcacacctggctaattttttgtatttttttttttttttttttttagtagagacagggtttcgctatgttggccagactggtcttgaactcctgaccttgtgatctgcctgccttggcctcccaaagtgctgggattacaggcgtcagccaccacacctggcctgataattctatttaaatcaacatgcaggtaacattagttttattttatgaatgggcaatgaaattttgaagtagaatgaggagataatttgggaatgtggagta

SEQ ID NO: 139289 - DNA, 601 bp, Human
aacaaaaaacaaaaaacagtaaggatgctgaaaaagttaagagtctcagaagggcaaaacaagccaagtgcttcctagatttccagacaaagtcagctgctttaattcctttcctgtatcccacatgcaaaatagcttacacagtactacaatctgtgttcactcttgaactacagtctgaaattccaacaacaaaaatatccacatactaaacaattattttctttttaagtgcaagtatttggaggatcagatcatctgtaattcagtagtaagttactttgataattttttttaaaawtttttgatttttttcagacggaatcttgcactatcgcccaggttggagtgcaatggtgcgatcttggctcgctgccacctctgcctcccaggttcacgtgattctcctgcctcagttttccaaggagctgggattacaggcgcacatccatcacacctggctaattttttgtatttttttttttttttttttttagtagagacagggtttcgctatgttggccagactggtcttgaactcctgaccttgtgatctgcctgccttggcctcccaaagtgctgggattacaggcgtcagcca

SEQ ID NO: 139290 - DNA, 601 bp, Human
aactttaaaaaataagatcgctgggcatggtggctcacgcctgtaaacccagcactttgggaggctgaggcgggtggatcacctgaggtcaggagttcgagaccagcctgaccaacatggataaaccctgtctctactaaaaatacaaaattagctgggcatggtggcacatgcctgtaatcctggctactcgggaggctgaggcaggagaattgcttgagcatgggaggcagagtttgtggtgagctgagatcgcaccattgcactccagcctgggcaagaagaacaaaactctgactcraaaaaaaaaaaaatctaagatcaaactaccaccaagatcatttatttaattagaatccttgggtgagagatcagagcatgaataattttagttttaacctcctcattaatctagtgaatcagaatctcttggccatagaaccctgggataagtaatttaaacaagcttcccagatcattctaataaacattagcagtttaaggactgcataaattaataaggaaaagaaagaagaattaagactgactttaagttgtagccagatagggaaatcttttggccccagtgccactgacaaag

SEQ ID NO: 139291 - DNA, 601 bp, Human
taccattataattcacaatattttagaagcagaaggttgaataacttgcccaaggcattaagctgttaaaaggtaaagtacactctcacacttttctaaatatggttttctgaccacctgaatgaatcacagattcaatacacagattcccagagtccacccataacccagggttactccaaactggctccactttagaaacacttggggaactttaaaaaataagatcgctgggcatggtggctcacgcctgtaaacccagcactttgggaggctgaggcgggtggatcacctgaggtcrggagttcgagaccagcctgaccaacatggataaaccctgtctctactaaaaatacaaaattagctgggcatggtggcacatgcctgtaatcctggctactcgggaggctgaggcaggagaattgcttgagcatgggaggcagagtttgtggtgagctgagatcgcaccattgcactccagcctgggcaagaagaacaaaactctgactcgaaaaaaaaaaaaatctaagatcaaactaccaccaagatcatttatttaattagaatccttgggtgagagatcagagcatgaataatttta

SEQ ID NO: 139292 - DNA, 601 bp, Human
acagaataaatggatttgttgaaatttaaccatatgccagttaatcatcttctatgcatatattcattaaagtattatatagataccattataattcacaatattttagaagcagaaggttgaataacttgcccaaggcattaagctgttaaaaggtaaagtacactctcacacttttctaaatatggttttctgaccacctgaatgaatcacagattcaatacacagattcccagagtccacccataacccagggttactccaaactggctccactttagaaacacttggggaactttamaaaataagatcgctgggcatggtggctcacgcctgtaaacccagcactttgggaggctgaggcgggtggatcacctgaggtcaggagttcgagaccagcctgaccaacatggataaaccctgtctctactaaaaatacaaaattagctgggcatggtggcacatgcctgtaatcctggctactcgggaggctgaggcaggagaattgcttgagcatgggaggcagagtttgtggtgagctgagatcgcaccattgcactccagcctgggcaagaagaacaaaactctgactcgaaaaaaa

SEQ ID NO: 139293 - DNA, 601 bp, Human
gagcctggtctaagattaaatctaaattataaattttaaaaaagtcaaagaataccatatgattatatgaaactttccattttcatcttctctaaggcatgctgatctctccttttatgtcttttactgcttattccaaaggatgtagtaggtattatcattttctctaatctttttctgcatcatctttataaatccccaagttgtaaatccctgaaggacaggagtcctagtctttcttttttttttaagtattttattaagttccagggtacatgtgcaggatgtgcaagtttgttamataggtaaatggatgccatggtggtttgctgaggagtcctagcccttttgtttttttgagacagagtcacgctctgttgcccaggctggagtacagtggcgtaatctcggctcactgcaatctccacctcctgagttcaagcaattctcctgcctcagcctccagaatagttgggattacaggcatgagctaccacgcccggctaatttttgtatttttagtagagacagggtttcaccacattggccaggctggtctcgaactcctgacctcgtcatccacctgccttggcctcccaaa

SEQ ID NO: 139294 - DNA, 601 bp, Human
agctcactacagcctcgacctcctgggctcaagcaatcctcccacctcagcctccgaaagtgctgggattacaggtgtgagccaccgagcctggtctaagattaaatctaaattataaattttaaaaaagtcaaagaataccatatgattatatgaaactttccattttcatcttctctaaggcatgctgatctctccttttatgtcttttactgcttattccaaaggatgtagtaggtattatcattttctctaatctttttctgcatcatctttataaatccccaagttgtaaatcccygaaggacaggagtcctagtctttcttttttttttaagtattttattaagttccagggtacatgtgcaggatgtgcaagtttgttacataggtaaatggatgccatggtggtttgctgaggagtcctagcccttttgtttttttgagacagagtcacgctctgttgcccaggctggagtacagtggcgtaatctcggctcactgcaatctccacctcctgagttcaagcaattctcctgcctcagcctccagaatagttgggattacaggcatgagctaccacgcccggctaatttttgta

SEQ ID NO: 139295 - DNA, 601 bp, Human
aaatcaagttcattaaggaatgcaaaagtctaaatacctgttagattttcacaagtttttttaaaaaaaatctaaaagtgtgcatatactacattattcaaaataaagcaattaagaaaatattaatgagtgatttttataaatttttacaatactgactctgccttatactctggtaagtatgttacgttatgttaacccaattaattctcatcataatctttgtggcaaacaaagctaataagtactcttagtccaagacaacaacaacaacaaaacactgtattttgttttgaggaayacaaacagaaaaagcaatcaaagtcactaaagcagattaatttctttttttttttttttctccttgagatggagtcttgctctgttgcccaggctggagtgcagtggcgcgatctcgggctcactgcaactcctccacctcccaggttcaagtgattctcgtgcctcagcctccagagtagctgggattacaggcgcccaccaccacgcccggctaatttttgtatttttagtagaaacggggtttcaccatgttagccaggctagtctcgaactcctgaccttaggcagtccgcccgcc

SEQ ID NO: 139296 - DNA, 601 bp, Human
ttatttaatggacatactgccctttcttcccatgttctcatttcatgaaacaatttccttcaaatccttcgcatgtatctttagtatcagtatcctttgtatcatgactttgagttactgtgtttctttaaaaatctttatctcaagaataaaaaagtccaaattccgataataaggaaaattatccaaatttacaccattgaaatcaattataaatggaaactagggcctgtttcactaatctcaggtattaacagctttaactctaataaataaaaatcaagttcattaaggaatgcaraagtctaaatacctgttagattttcacaagtttttttaaaaaaaatctaaaagtgtgcatatactacattattcaaaataaagcaattaagaaaatattaatgagtgatttttataaatttttacaatactgactctgccttatactctggtaagtatgttacgttatgttaacccaattaattctcatcataatctttgtggcaaacaaagctaataagtactcttagtccaagacaacaacaacaacaaaacactgtattttgttttgaggaacacaaacagaaaaagcaatcaaagt

SEQ ID NO: 139297 - DNA, 601 bp, Human
tccggcctccattttggatgactttcaaagcagtatcatgtgtaatatatattcaagtgtaagtcaataacctagtttctccatgagaaaatttataacaactttttagccaatttatgtcaaattctacagctgtcaatgaaatagtcaaagagttaaatgcctactgataacatttaatttatgacttagttccatatgcatatttgatgtcacattattttaaaaatttatttaatggacatactgccctttcttcccatgttctcatttcatgaaacaatttccttcaaatccttcrcatgtatctttagtatcagtatcctttgtatcatgactttgagttactgtgtttctttaaaaatctttatctcaagaataaaaaagtccaaattccgataataaggaaaattatccaaatttacaccattgaaatcaattataaatggaaactagggcctgtttcactaatctcaggtattaacagctttaactctaataaataaaaatcaagttcattaaggaatgcaaaagtctaaatacctgttagattttcacaagtttttttaaaaaaaatctaaaagtgtgcatatactacatt

SEQ ID NO: 139298 - DNA, 601 bp, Human
cgggcgcggtggctgaagcctgtaatcccagcactttgggaggccgaggcgggcggatcacgaggtcagaagatcgaaaccatcctggctaacacggtgaaacccagtctctactaaaaatacaaaaaatgagccgggtgtggtggcgggtgcctgtagtcccagctacttgggaggctggggcaggacaatggcgtgaacccgggaggcggagcttgcagtgagccgagatctcgccactgcactccagcctgggtgacagagcgagactccgtctcaaaaaaaaaaaaaaaaaaaaaargaaaagaaaaagaaaaagaaaagaggccacttagtaaacaactattcagagggccactatgagcccctactctgctagaaccagatactacttctacattatcccgatcatacaatattctcaaccatgcccatttcacagatgaggttcagggaaatcaagtctcttgcccactgacacagagctagtaagtggcaaggctgggagggcatctcagagctgtcagaccccaaaggcgacttaagaccaggggcttggttgggttaaagacacaaatgactgatcttatcccaagctgat

SEQ ID NO: 139299 - DNA, 601 bp, Human
gtgcggtggctcacgcctgtaatcccagcactttgggaagctgcggtgggaagactgcttgagctcagaagttcaagaccagcctggccaacatagtgagaccccatcttaataaaaataaataaataaataaataaataaataaaggctgggcacagtggtcatgcctgtaatcctagcactttgggaggccgaggcaatagggtcccctgaggtcaggagtttgagaccagcctggccaacagggtgaaaccccatctctactaaaaatacaaaaattagccgggtgtggtggcgggcrtctgtaatcccagctactcagcaggctgaggcaggagaattgcttgaacctgggaggcagaggttgcagtgagccaagatcatgccactgcactccagcctgggcgacagagtgaggctctgtctcaaaaaaactaaataaataaaaaataattttaaaaaaaagaaataattttaacttacctccattggtctcttgatatacaacagacttccccaattcagcaccaaggcgcctatagatcaaaaagaacaaaaaagggaaattaagattactctttttaaaaaaattccagttcat

SEQ ID NO: 139300 - DNA, 601 bp, Human
cgcggtggctcatgcctgtaatcccaacactttgggaggccaagacgggtggatcacctgaggtcaggagttcaagaccagcctgaccaacatggcaaaacccccgtctctgctaaaaatacaaaattagccgggtttggtggcgtatgcctgtaatcccagctacttgggaggctgaggcaagaggattgcttgaacctgggaggtggaggttgcagtgagccaagatcatgccactgcactccagcctgggtgacagagcaagactccgtcaaaaaaaaaaaaaaaaaaaaaaaaaaaagaaagcagacagagtgaggggaaagagagagacaggaggtcagggagccaaggggccaggacttgcaggactctggatttcatttcttactcgctgaagagtctggaatttattctagcagtgacaggaaagccactggaagatttaaggttgggaagggtttcatctacttgttttaaaaagactgctggctactgtgtgaagaaaaccgtggcagggcaggagtggccacggggaggccatggcgtctgttttggaaggtgtctagcaagcagcaaacggcaggctggacttaagtgg

SEQ ID NO: 139301 - DNA, 601 bp, Human
gatgccactgagatggcgcccctcaaaagagcagtagttccgtttctagactgtggatcttcagataaactctgccatattcatttcacttccggaaagtcagggtcagcttgtgaaaagttgttaaacaacatgctaaatgttcactgggttttacagtggctttctgatttttggttgtgcactgaaaaagggagtttggccgggcgcggtggctccgcctgtaatcccagcactttgggaggctgaggcaggagaattgctcgaacctgggaggcagaggctgcagtaagctgagatygcaccactgcactccagcccgggcgacatccttattattttttcaacaaatgctgaagcctcctccatgtcaggaactgtactgggaaccccaaaatgcaggacttggaagaagggacaaagactgacccaggagagatgatacaacaacaaggccagcaaaccctccgggcccaatatgccagagacgctagccatgacgaaggagaaagaacaatggggctggaaaaaagggcctcactgcaatccagaacgagcagcgcagaagggggtttgggaacatgggaagatgtgggatccg

SEQ ID NO: 139302 - DNA, 601 bp, Human
aaagtacttcatgccgggcgcggtggcacatgcctgtaatcctagcactttaggagggctgaggaaagcagatcacttgagcaccagagttcaagaacagcctaggcaacatgacaaaatcctgtctctacaaaaaatacaagaattagctgggcgcggtggctcacgcctgtaatcccagcactttgggaggccgaggtgggcagatcacgaggtcaggagatcgagaccatcctggctaacacagtgaaaccccgtctctactaaaaacacaaaaaattagccgggcgtggtggcgggygcctgtagtcccagctactcgggaggctgaggcaggagaatggcgtgaacctgggaggcagagcttgcagtgagccgagatcgcgccactgcactccagcctgggtgacagagcaagattccgtctcattaaaaaaaaaaaaaaaaaaaaaaaagagttcttcgagaccagcccggccaatatggtgaaaccctgtctctactaaaaatacaaaaattagccaggcatggtggcgcacaactataatcccagctactcaggaggctgaggcagaagaatcacttgaacctgggaggcaga

SEQ ID NO: 139303 - DNA, 601 bp, Human
gcagtggctcacgcctataatcccagccagcactttaggaggctgaggcaggcggatcacttgaggccaggagttcaagaccagcctggccaacatggtaaaaccccatcactactaaaaatacaaaaaaattacccgggcatggtggcaggcacctgtaatcccagatactcgggaggctgaggtagaatcacttgaacccgggaggtggaggctgcagtgagccaagatcacaccactgcactccagcctgggcaacagagtgagactccgtctcaaaaaaccaaaacaaacaaaaacraaacatataaagcatccagcacactggtagcactcagtgccattcttattactaatatggtctggggaatgtacactgatcaggacatgaaggtctggatttttcagagacacagatggtgtaatggcccactccctgtcaggcgatgagaaaggagatagtcccatagaagcatgaacgttctcactcaagcaggccaggattccccaggtgtcagccccctgccctgagggaagcaagggcgacgatctctgaaacagagataggctagaaacaggccacggtgcaagataaaatgca

SEQ ID NO: 139304 - DNA, 601 bp, Human
cttcttagtccaggagttcaagaccagcctgggcaacatggcaaaacctcatctctactaaaaatacaaaaaattagcccaggatggtggcacacacctatggtcccagctactaaggaggctgaggtgggaggatcgctttgagttcaggagcttaaggctgcagtgagccatgatcgtgtcactgcattcctgcatgagtgacacagcaagaccctgtctcaaattaaaaaaaaaaaaaaagaaagtcaaataaaggccatgaggaactgctccaaactaaagaagactgaatagggcygggcgcagtggctcacgcctataatcccagccagcactttaggaggctgaggcaggcggatcacttgaggccaggagttcaagaccagcctggccaacatggtaaaaccccatcactactaaaaatacaaaaaaattacccgggcatggtggcaggcacctgtaatcccagatactcgggaggctgaggtagaatcacttgaacccgggaggtggaggctgcagtgagccaagatcacaccactgcactccagcctgggcaacagagtgagactccgtctcaaaaaaccaaaacaaacaa

SEQ ID NO: 139305 - DNA, 601 bp, Human
ggcatggaccctcacaaccagaaatttcttaggatcttcctacagatacacctgaaacaccgacaatatgatgtatatacgatgaggctcacagcagcctctattgtatcagcataagactagaaacaaactgacacacaagagactgaataaaccgatgcatccacacaagatgtcatgaagcagcaggaagacaagacaacaggaacacagcttccttccgaggtacctgaatctcatcatagtgaaagagccatcacggtgaaacccaaattgagggacattcgacaaagtaatcggyaaaatgtcagtcttcaaatgtgtcaaagttttcaaagtcaaggccgggtgtggtggttcatgtctgtaatcccagcactttgggaggctgaggcgggtggatcacttcttagtccaggagttcaagaccagcctgggcaacatggcaaaacctcatctctactaaaaatacaaaaaattagcccaggatggtggcacacacctatggtcccagctactaaggaggctgaggtgggaggatcgctttgagttcaggagcttaaggctgcagtgagccatgatcgtgtcactgcattcctgc

SEQ ID NO: 139306 - DNA, 601 bp, Human
ggttaggagatcgagaccatcctggctaacatggtgaaaccccgtctctactaaaaatacaaaaaattagccgggcgtggtggtgggcgcctgtagtcccagctactcgggaggctgaggcaggagaatggcgtgaactcgggaggcggagcttgcagtgagccaagattgcgccactgcaccccagcctgggcgacagagtgagactccgtctaaaaataaaagatggagagtcaaacaaaaccaccaggcaaaaaagactccagtcaccaggaggcaaacaatacaaaaccaaaactgytggagaaaatgtgaattagtatatcctcaatgagggcaacgcagccccttccctcaataccacagggcatggaccctcacaaccagaaatttcttaggatcttcctacagatacacctgaaacaccgacaatatgatgtatatacgatgaggctcacagcagcctctattgtatcagcataagactagaaacaaactgacacacaagagactgaataaaccgatgcatccacacaagatgtcatgaagcagcaggaagacaagacaacaggaacacagcttccttccgaggtacctgaat

SEQ ID NO: 139307 - DNA, 601 bp, Human
catgtgatatcaaagccaagaattttataaaattcaacttcgtatcacaaaggacactaacaatatgctgtttctatgctcgactagtttgaaataaccatgaacggcctcgcacggtggctcgcgcctgtaatgccagcactttgggaggccgaggcgggcagatcacttgaggttgggagttcgagaccagcctgaccaacatggagaaaccccgtcactactaaaaatacaaaattagccgggcgtagtggcacatgcctgtagtcccagctactcgggaggctgaggcaggagaatygcttgaacctgggaggcgggggttgtggtggggtttgcagtgaaccgagatcgcgccattgcactccagcctgggcaacaagaacgaaactccatctcaaaaaaaaaaaaaagcggggggtagggggggactgtctttcacaaaactggtccctggtgccaaaaaggttggagactgctggactatctaacaaaatggggtctctgccgtgagaaggttataacgtcttagctcctcccctgactcatagatgatccctaaatacatgtaacaaaacaaagatgccaagagcacagctgc

SEQ ID NO: 139308 - DNA, 601 bp, Human
agaatagagacagggtcttagtatattgcccaggctggtcttgaactcctggcctcaagtgatcctctcaccttggtctcccaaagtactaggattaaaggcatgagccaccacacctgaccatggtccaatttcctaatactcaagatacaagtgagaaaaacggtaagtgtttcccaattggctattaactaagtcatttcttcatgcttcttttgtcccttccctggaagacacttgcacactgatgatcctttgtttgtcaagttcagtctttactacccccagcatcactctagaytgcacgtgttaaatacttatattgagcactcttggttaccatgtgatatcaaagccaagaattttataaaattcaacttcgtatcacaaaggacactaacaatatgctgtttctatgctcgactagtttgaaataaccatgaacggcctcgcacggtggctcgcgcctgtaatgccagcactttgggaggccgaggcgggcagatcacttgaggttgggagttcgagaccagcctgaccaacatggagaaaccccgtcactactaaaaatacaaaattagccgggcgtagtggcacatgc

SEQ ID NO: 139309 - DNA, 601 bp, Human
cggacaaattggacaccaggcagttactttgtgaactagcagggcgaagggaaatcggctggcagtctctgctttatctgttccctaagaatgttgcaagtacaccctggctagctcttgtagtctttacctctaagtaggacattcttaattgttttaccaactacttttctttcttttttttaaatagagaaaggtctcaccatgttgcccagctggtcttgtactcctgggctcaggcaatcctcccgccttggcctcccaaagtgctgggagtacagcttgagccatcatgcccagmcaaccaactacttttctttcccctaagaaaaccacatcctatattaagtccagcccttactgctctagcattttggacaggcaaaaactaacctgaggtgtgctctcttcagcagcacatatactaaaattggaatgatacagagaagattagcatggcccctgtgcaaggatgacacgcaaattcgtgaagtgttccatattggaaaacaacaacaacaacaacaacaacaaacaactaacctgagatgaggaaacaggcatggtatacgcattcattaaactagccaggctcgcaaaa

SEQ ID NO: 139310 - DNA, 601 bp, Human
tatcagctctacactgacacgtaggtgatgctgccctcattacagcaaagcagaaagcctgccatacacacagcagagttagcgtttgctgaataggtggctgaatgaaatactcagcaagagatgctttctagcttgaagggtaatcgagccatttccttccagtctcttccaatttatgtttacacttctctctaaggcagagtgcatttgggagtgagcgatttcaaagacatccttttattctgacaatgttttccacttccaggttcaactcctggaacttccaatttcaccctcrtaatttggatttttcttaactattgcaagcattctatgattaaaaaaaacaaaaacaaaaaatgtctccctgaggagactgatgcagggctcaacttcaagacaactaagacattccttttagactgctaatccattccattgttttccagttaccttttattttttctctcaataaattggagcatttttctccttcagacttccaaattaataatgccaagtctggcatcaaaaggtcagataatctttggtagaatcaaagcaattatcaaacactttcaagaaagttgggaattca

SEQ ID NO: 139311 - DNA, 601 bp, Human
tgctctgcttgctgtaggggaagtaggggatgaccccaataatgttcctggcacaggcagtcttcagtgcgtaagccatgatgagcaactccatcacagctgtattcacatctctgaaacagtcaaagtttgtatttggggattaattccatgtatcaaccctagaaaagatcttgactttatcaacttaacatgggctgcccagatgggtgttgtgggaattttaccatcacactagcttacaatggcacctcatgaaggcaggggaagctttctgactttttgtagctgagtaagcccyagctttcatctgaggttactcctattcacagcacagttaacccaccctcacatttgcctgggtctcctgtgtcataccccgttactgcagtgacatctgaagcaactgctggtgaccagagttacccaacacctgctggcagcctcccagggatttgggcttaggccagcttgaatgccaagggaaacccaactgcccttccatttagctgccattaacagaaagatttggtctctttccattgagtgtggggaggtcttggaatataattttttttttttttttttgagacggagtctc

SEQ ID NO: 139312 - DNA, 601 bp, Human
aacccctcttcctcatcttgctctgcttgctgtaggggaagtaggggatgaccccaataatgttcctggcacaggcagtcttcagtgcgtaagccatgatgagcaactccatcacagctgtattcacatctctgaaacagtcaaagtttgtatttggggattaattccatgtatcaaccctagaaaagatcttgactttatcaacttaacatgggctgcccagatgggtgttgtgggaattttaccatcacactagcttacaatggcacctcatgaaggcaggggaagctttctgactttytgtagctgagtaagccctagctttcatctgaggttactcctattcacagcacagttaacccaccctcacatttgcctgggtctcctgtgtcataccccgttactgcagtgacatctgaagcaactgctggtgaccagagttacccaacacctgctggcagcctcccagggatttgggcttaggccagcttgaatgccaagggaaacccaactgcccttccatttagctgccattaacagaaagatttggtctctttccattgagtgtggggaggtcttggaatataattttttttttttt

SEQ ID NO: 139313 - DNA, 601 bp, Human
gctaagtccaactaggaaagagccctaaaggatcatgctggaaccccagggcccccgcgcacactcacctgctttcgccagcatggatgctagcagcttgcacacaatggaacccctcttcctcatcttgctctgcttgctgtaggggaagtaggggatgaccccaataatgttcctggcacaggcagtcttcagtgcgtaagccatgatgagcaactccatcacagctgtattcacatctctgaaacagtcaaagtttgtatttggggattaattccatgtatcaaccctagaaaagatsttgactttatcaacttaacatgggctgcccagatgggtgttgtgggaattttaccatcacactagcttacaatggcacctcatgaaggcaggggaagctttctgactttttgtagctgagtaagccctagctttcatctgaggttactcctattcacagcacagttaacccaccctcacatttgcctgggtctcctgtgtcataccccgttactgcagtgacatctgaagcaactgctggtgaccagagttacccaacacctgctggcagcctcccagggatttgggcttaggccagctt

SEQ ID NO: 139314 - DNA, 601 bp, Human
tacgtctgcaactcaccctcaaatggtggaaaaaaaaaaaccccatgtatataaatgttaaatttggggactccgagtgaagagcatatgctggaaatctgtactattctttcaactttaagtctaaagtcagttgaaaataaaaagctaaaaatgcagattacggcttggcacggtggctcacacctgtaatcccagcacactgggaggtcgaggcaggcggatgacctaaggttagcagctcgagaccagcctgaccaacatggtaaaaccctgtctctactaaaaatacaaaaattakctgggtgtggtggtgtgtgcctgaagtcacagctacttgggaggctgagacaggagaactgcttgaacccaagaggcggaggctgcagtgagccaagatcatgccactgcactccagcctgggcgacagaacgagttcagtctcaaacaaaataaaaataaataaaaataggccgggcacggtggctcacacctgtaatcccagcactttgggaggctgaggcaggcggatcacaatgtcaagagatcgagaccatcctggccaacatggtgaaagctcatctctactaaaaatacaaaa

SEQ ID NO: 139315 - DNA, 601 bp, Human
tttgagacagagtctcgctctgtcacccaggctggagtgcagtggcgcgatttcagctcactgtaagctccacctccattctcctgcctccatgccattctcctgcctcagccacccggtagctgggactacaggcgcccgccactacgcccggctaattttttgcatttttttagtagagacgcgatttcacagtgttagtcaggacggtctcgatctcctgacctcgtgatctgcccgcctcagcctcccaaagtgctgggattacaggcctgagccattgcgcctggccaactgctastattttttagcagtaaagtatttttaaattaaggtacgtacattggtttttagacacaatgatattgagcatttaacagactacagtataaacataacttttacatgtgctgggacatcaaaaaattcatgagactcactttattataatattcacctactgcaatggtgcagaactgaacctgcaatatttaaggtattcctgtgacgacaatgaattataacccactgaatgaaataggcctatgaatccatactgatataaatgaagaaatgaatagggaagaagagaaagctttct

SEQ ID NO: 139316 - DNA, 601 bp, Human
tctttcggctgggcgcagtggctcacgcctgtaatcccagcacttttggaggccgaggcgggcagatcacctgaggtcaggagttcgagaccagcgtggctgacatggtaaaaccctgtctctactaataatacaaaaattaggcgggtgtggtggcacacatctgtaatcccagctactcgggaagctgaggcaggagaattgcttggacccaggaggcagaagttgcagggagccgagatggtgccactgcactccagcctgggcaacagagtgagactgtctcaaaaaaaaaaaaaaagaaagtagttctttcttctaggtaaaatgctatcaaacagatcattttgtagttcataagtgtgatcattgggtgttcacgcttacatgtgagatgtgccatccttgaaccttgttagaacatcagtacatcacctggctgacattttaaaaaatgctgtcagccgggcgcagtggctcacgcctgtaatcccagcactttgggaggctaaggcgggtggatcatctgaggtcaggagttccagaccagcctgaccaacatggtgaaaccctgtctctactaaatacaaaaaaaattagc

SEQ ID NO: 139317 - DNA, 601 bp, Human
ctggaacctgaagctgtgactgggctgcttcaatcttatgataaaactgtaatggataaggagttgctttgatagataagcaaagaaggttttttgtttttttttttgagatgaatctactgctgaagatgctgtgaactctgctgaaatgaaaacaaggatttagaagtattacaaaaattatttgataacacagtggcagggtttgagaacagtgactacaattttgaaagtagttctttcggctgggcgcagtggctcacgcctgtaatcccagcacttttggaggccgaggcgggcrgatcacctgaggtcaggagttcgagaccagcgtggctgacatggtaaaaccctgtctctactaataatacaaaaattaggcgggtgtggtggcacacatctgtaatcccagctactcgggaagctgaggcaggagaattgcttggacccaggaggcagaagttgcagggagccgagatggtgccactgcactccagcctgggcaacagagtgagactgtctcaaaaaaaaaaaaaaagaaagtagttctttcttctaggtaaaatgctatcaaacagatcattttgtagttcataagtgt

SEQ ID NO: 139318 - DNA, 601 bp, Human
gtactccagcctggacagcagacagagaccccgcctctaaaataaaataaaaagaaatacatttggctgggcgtggtggctcacacctataatcccagcactttgggaggctgaagcacgcagatcacctgaggtcaggagtttgagatcagcctggccaacatggtgaaaccctgtctctattaaaaatacaaaaattagctgggcgtggtggtgcacacctgcaatcccagaaactcgagagaatgaggcacgagaatcacctgaacctggaaagcagaggttgcactgagccgagatygcgccactgcactccagcctgggtgacagagcaagactctgtatcaaaaaaaaaaaagaaatacattttataagactatagatgccatagatagtgattcctctgaaggacccaaagtaaactgaaaatctctggaaaggatgcaccattctagatgccatgaagaacacgcgtgattcatgggaggaggccaaaatatcaacattaacaggagtttggaagaagttgattctaaccctcatggatgactctgaggagttcagggcctccatggtagaagtaactgcagatgtggtggaa

SEQ ID NO: 139319 - DNA, 601 bp, Human
ctggacaacaagacaagaccctgtctctactaaaaatttctaaaaattagctgggtgcttgggcacagtggctcatacctctaatcctagcacttcgggaggccaagatgggttgactgcttgagcccaggagttcatgaccagcctgggcaacatggcaaaactccgtctccacaaaaaatacaaaaattagtcaggtgtggtggcacgtacctgtggtcccagcttccaagctactcaggaggctgaggtgggaggatcacctgagcccaggtggtagaggctgcagtgagcagtgatygcaccactgcactgcaggtctgggtgagagagggagatcctgtcactgtactccagcctggacagcagacagagaccccgcctctaaaataaaataaaaagaaatacatttggctgggcgtggtggctcacacctataatcccagcactttgggaggctgaagcacgcagatcacctgaggtcaggagtttgagatcagcctggccaacatggtgaaaccctgtctctattaaaaatacaaaaattagctgggcgtggtggtgcacacctgcaatcccagaaactcgagagaatgaggca

SEQ ID NO: 139320 - DNA, 601 bp, Human
cattctcagctggtctgatgctaatgggttatcaatacttattaatattagtgtcactaaaaagttggcatacaatccagcactgctaaatctgaccgatttattttatttttttttctagacggagtcttgctctgtcacccacgctggaatgcagtggcaccatcttggctcactgcaacctccgcctcccgggttcaagccattctcctgcctcagcctcctgagtagttgggattacaggtgcccgccaccatgctcggctaatttttgtaattttagtagagacggggtttcaccrtgttggccaggctgacctcgtgattcgccctccttggcctcccaaagtgctgggattacaggcgtgagccaccgtgcctggcctgactgatttttaaaaataaataaataccattctccactaaaggtataagggctccttggagaaatggccaagtacagtgctaagaaagcacaagatgaacacggggcgtggttatagcacaaaagtaagggagtctccaaaagtgttggggacatgccaaaagaacacaggaggcagctgcaaggagctctctctggccaaatatgagacaaactg

SEQ ID NO: 139321 - DNA, 601 bp, Human
gggcgccggccgcccctcgagcctgctcgggatgcgttcagtgggtctggcctttggctcctgtttaaacagcgattgtcatgcaatggaggccgtccggctcctggatgccacttggtcgttgtcactccggatgcccgcgtagggcgtttatctggaccagagcatcggcagctgagacctggctgtggttcacaagctcgtgaattagcaggttcttaagtgagtgtagccagttctgccaggcggtggaatcctgaatggatgttaccgtttcttaaacgagcattacgcttttttrcttcttcccccaactcttgtttgtacccggttatcgtcctcatatctgggagagtaccctaaaattaatattcccaattaaatttttaaaagatgattggattcccactgtgcaccaacactgtaaggtttgcaaaagaaaaagaacgtggtcccagcacatcaggatgtgtcagtcgcataatcaagatgaatattagaaaagcttcaagttgagtttggagaacttgggagtttggctctcattctcatggttttagaggtggaagtctttcaagatcatctccccgaaaacctcatt

SEQ ID NO: 139322 - DNA, 601 bp, Human
ttagaaaagcttcaagttgagtttggagaacttgggagtttggctctcattctcatggttttagaggtggaagtctttcaagatcatctccccgaaaacctcattttacagagatgaaactgagtcctagggaagtcaaatggcttactcgtggtcacccagagtcattccttagccgttttcacactgtcagatggcgatgttttccaccatgacctctcctctgagaggtatgccagacataccagagaaagttccaaacctgtttaaaccttagtactatagatgggaattctatacyaggcgccgtgactcatgactataatcctagcactttgggaggctgaagtgggcagatcccttgagcccaggagtttgagaccagcctgggcaacatggggaaaccttctacaaaaaatatatatggtggtgcgtgcctgtggtcccagctacttgggaggctgaggcaggaggatcacttgagcttagaaggtggaggctgcagtgagtggagattgtgccactgtgttccaccttgggcaacagagagacaccctgtctcaaaaaaaaaaaaaaaaaaaaaggaatcttggaagtttct

SEQ ID NO: 139323 - DNA, 601 bp, Human
agtttttccgttatttacctgaagaatttggctgaaaataagcattttactagatgcaaagcaaaccttttccagtcatttttagattaccgtagggtatttcttcttttcctttctcttttgtgttattattaagatataacatacataccagaaaatataatacagacaggagaatgtgtctttcatgagcacacacctgatgaaaacgtgtgtcacactcagcacacctgggatactggcaccaaggtcaggaaccagaacatggcaacccaggaagaagtctcccctggttcaagtsagccactgttttgactcctaatacacagaggactgttacctgtttctgttccttctataaatagaaacgcaggtgttttagcagctggctgcttctgctcagcgtatgtttgtgggatttatatagatcaatagttttgaaaaacaagaagtcctcttacgggaagaatttacatgacagggtttgttttaaaatttattttatttatttttttgagacagcgtctcactctgtcactcaggctggattgtagtggcgcgatctcagctcactgcaacctccatctcctgggttcaagcg

SEQ ID NO: 139324 - DNA, 601 bp, Human
gaggtcaaggtcaggagcccttaaggagagttgtgggagagagggaagaacatgagaggccaccttctgaacccgatttttgtggtgacagccgcaggcgagatagtggcttggactctggtctttcttctgctgaggacagctgtcctcattgtgaccagtgggaacacacgatagaagaggctccattagctcctgtgcatcccaggagttgccaccctgtccagtgccgtttctgtctgggcttatttccattacacagcagatgtggtcacctcattctttgctctctcctttcctygccctcatcccagtttcactgtgccctaggagtgctggctttctccaggaaccccttcagtgtctctgtcccttcagcagacacaccctttagactgtgccttcaggaaccaaggcacctggttctgtccctgtctgtcccagcactgccatcgttgcagcgtaagcccctccctttgcagggaaagaccaggggtcccttgttcctttgcgcactcacatctttcatcccttaggtcactttgtgctcccctgccacacactttccattgtgtgtgtcctgtgttgaaggctttcctgt

SEQ ID NO: 139325 - DNA, 601 bp, Human
caagtgatccaccctccttggcctcccaaagtgctgggattacaggcgtgaaccactgagcctggctagcagttctgtttaaacatttgctggcagagatggaaactaatagttaaaaccagctgctccccttttcttcctaggattgttctatataattttgagttgcaaataagatgcaaaatatttttttcccaaattaaactaggccattctatttatggttactccttatttatttatttttgtagttactttttaacactgaatgggtcctcattttgtactgaaagcaggtgaragggattaatttattggcagcgtttctatgtagtgcatgcagcaggcacttggcaggagtctggcctggggctgaggaggtgggtggtgtttgtggtctgaggtgtccagttgtgctgggcagtcagtccttgccctcttctgttgtctcttttattagagctctggatagggctgttgggctgcctggggaagcttccccagagaagttcactgtagagaggattttggttggcagatgttataattgatccatctctcttgatttttgacctgtacgctagtgaagcagacactttta

SEQ ID NO: 139326 - DNA, 601 bp, Human
caaaaataatacaacaataaactgtaatacaaataaaacgcatgcaacaactatttacatagcatttacattgtatttggtattataagtaatgtagagagaatttaaagtgtacgggagggctgggtgtggtggctcacatctgtaatcccagtgctttgggaggccaaggcgggagaatcacttgaggccagtagtttgagactagcctgggcaacttagcgagactctgtctctatgataaactgaaaaaaaattagctgggtgtggtggcgcatgcccgtagtctcagctactcagragacttgagacaggattgtttgagcctaggagtttgaggctgcagtgccactctggcctgtgtgaacagagcgaggccctgtatctaaaagatgtgtgtctgtgtatatgagaggatgtgtgtaggttaaatataaaatgtaaatgccactccatttttatatcagggactggggcatccacaggttttgggattggagggacatcctggaaccagtcccctccagataccgagggaggactctactggccccttctggttttttttgttttttttttgtttttttttaagaaaagtctg

SEQ ID NO: 139327 - DNA, 601 bp, Human
catgttgtagctttagtttttgggtagtacttgaccttttgtgtaactgggttttttcacttagcctaatgtcttcaaggttcatccatgttgtagcatgtgcagaattcccttcctcttcaggggtgaattgtactcaattgtatatgccacattctgaattgaattgtactcaattgtatctgccacattctgctcatccattgacttaccgatggacgttgggttgtttctaccttttggctgttgtctgtactatacatttttaaagtttcaattacattttatagctttctttccyttttttttttttttttttttttttttttttttgagacagtctcactctgttgcctaggctggagtgcagtggcacgatctcgactcactgcaacctccacctctggggctcaagcaattctcgtgcctcccaagtagctgggattacaaatgtgcaccaccacgcccggctaatttttgtaattttaatagagacagggtttcaccatgttggccaggctggtctaggacgcctggcttcgtgtgatccacccagctgtagtattttttttgttttgttgtttctgaaataaactctcac

SEQ ID NO: 139328 - DNA, 601 bp, Human
tcctttttttttttttttttttttttttttttttttgagacagtctcactctgttgcctaggctggagtgcagtggcacgatctcgactcactgcaacctccacctctggggctcaagcaattctcgtgcctcccaagtagctgggattacaaatgtgcaccaccacgcccggctaatttttgtaattttaatagagacagggtttcaccatgttggccaggctggtctaggacgcctggcttcgtgtgatccacccagctgtagtattttttttgttttgttgtttctgaaataaactcwcactctgtcacccaggctggagtgcagtggcacaattttggctcactgcagcctccacctcctgggttcaagcaattctcctgcctcagcctcccaagtagctgggattacaggtgtgagccaccacacctggctaatttttgcatttttagtagagatgggggttcgccctcttggccaggctggtctcgaacttctgacctcaggcgatgggcctgtctgggcctcccaaagtgctggggttacaggcatgagccaccacacccggcctcttttcttcttcttctttttttttttttt

SEQ ID NO: 139329 - DNA, 601 bp, Human
ctttttttttttttttttttttttttttttttttgagacagtctcactctgttgcctaggctggagtgcagtggcacgatctcgactcactgcaacctccacctctggggctcaagcaattctcgtgcctcccaagtagctgggattacaaatgtgcaccaccacgcccggctaatttttgtaattttaatagagacagggtttcaccatgttggccaggctggtctaggacgcctggcttcgtgtgatccacccagctgtagtattttttttgttttgttgtttctgaaataaactctcwctctgtcacccaggctggagtgcagtggcacaattttggctcactgcagcctccacctcctgggttcaagcaattctcctgcctcagcctcccaagtagctgggattacaggtgtgagccaccacacctggctaatttttgcatttttagtagagatgggggttcgccctcttggccaggctggtctcgaacttctgacctcaggcgatgggcctgtctgggcctcccaaagtgctggggttacaggcatgagccaccacacccggcctcttttcttcttcttctttttttttttttttt

SEQ ID NO: 139330 - DNA, 601 bp, Human
attttaagtgcttcaaggtctatgaagtacaacctgcacagtagatatttaataaacagtgagtgatcagtattttcctgatggattaaagcactcctattggcagcctactgactctgtggagttattattctggttcatgaaaccagataatatttccatagctcattgcattcctttatgtgggcaaacacatggcatctttaaaagctgacagctgcagttccctagaacaccaaatgcttttctgaagtccacaaatttctcttttacactctggaaagtaaaaccgtactctgcyaagtccaggcggatctgaaggggaatatgcacactgctattttgttgttagagagagatttgtactcagtttgctctttattagaccaaaaatttttcagattaggaatggtttttgaatatcatgcatgttttggtttcctttggatgctttcagcatcatgtgattgctttaaacacatgaaaagcaaagagaaataaaacctttcatagccctgtagacattcttgtttgcctagggcttaagtgattgtggcatgcaaagtatttgacattcaagatttattgacggagaccaggt

SEQ ID NO: 139331 - DNA, 601 bp, Human
tggaaaggttaaaaaaatgtgttgtggaccaggtgcggtggctcacacctgtaatcccagcactttgggaggccgaggcaggtggatcacctgaggtcgggagttcgagagcagcatgaccaacatggagaaacccgtctctactaaaaatacaaaatgaactggcgtggtggtacgtgcctgtaatcgcagctactcgggaggttgaggcaggagaatcgcttgaaccggggaggcggaggtgtcggtgagccgagatggtaccattgcactccagccagggcaacaagagcgaaactckgtctcaaaaaaaaaaaatgtgttgtggattctcatagtcatgttttctttttcatgaaggacattttggagtgctttgtaggtgatgttaagatcctcacctaaaactatatcatgtttttacctttaaaagcttaaaacacttaaagctatttagtttgagaatattggccacgtaccagggagacaggggagttcggtatgccatcggccaataggacacaattctccagcagcttctgcctcctggactcttgttacttcctggaggggattgacgtagctcctgccgctgtgcttg

SEQ ID NO: 139332 - DNA, 601 bp, Human
gcattcagaaggtccccctcctcatcttgtgcatagctcagctggttcctggactgtgggcctgacagcggctttacttcattgccaatagtgtcttcctccttgagaggttcatgtgttgcacagaacagtagccacacttattgagtattgtacttattctttgtttttgagatgagatcttgctatgttgcccaggctgctgtcgaactcctgggctcaagtgatcctcccaccttggcctctcaaattgctgggattacaggcctgagccatcatgcttggccccctacttattctstgtcagggcctgccaaacattttatgttttcttatttaatctttcaacaatgctgcaagttgaagatgatgaagaaattgaagcttaatgaaattaaatagcctccccaaggaccacttttaatggtggaactgggatttgaagccagatctgcctcttctaaagcctgtgctctgaaatagaatggtaactggagtggggcagacctgggttcatatcctgggttcaaattctctcagcctctgttttctcattttaaaatgggagaaacacttatgtcatggaaagatgagacctatt

SEQ ID NO: 139333 - DNA, 601 bp, Human
agaaggagggggtaggagtggtctgtccattacggtacggggcatgtcgggccacaagcgtgggagggttgttcggaggctagaaacaagggagtataaggaggttgggcttctgaacaaagagcaagaacgttacacagttaaaccctttgaagaggaattcatcatctctggcaatttccccctttgtcttttgataattcttcctcttcacatttttttaacatgatttggctctgctgttcttctcgatcacctaggaacaagagcctatttgagtatagaggaggagaggtagggraggttttgtgagagctgtttctataagtccttgcattaacccatggatacagggtatgatgcagcatcctacatatgagtacacctgtaacaattgcaagagaggttaatattgaagtcataatccctttccattcaccaaaccacttttccatgagacttgtgatggggtcatttattctggaatttttggctaacttatctgatatggaggtaaggccttgtaaagccttcataattgttccattgggagctgtgttgttagggctgaaagtacagcattggactctggtcttgacac

SEQ ID NO: 139334 - DNA, 601 bp, Human
atattgaagtcataatccctttccattcaccaaaccacttttccatgagacttgtgatggggtcatttattctggaatttttggctaacttatctgatatggaggtaaggccttgtaaagccttcataattgttccattgggagctgtgttgttagggctgaaagtacagcattggactctggtcttgacacagactttgcctttttttgctaacattatgttaagggctcttctattttcccagggcatttggctggtgggcctaattgttcagctatccctttaatggcatcgtctgcrtaattgacaaaccgctgttgattatagtaaatgtaatttatccagtctacatttttgtttatagttgaccaccagaacagtgcagatttgaatctgaatcctgcagctatttggtttcggggtttaaatttatctggtacctcttgtgggaccccagtagcagctacataaatgtgagggtcaaaagacccgtgaggagcatctttttttttttttttttttttttttttttgtgatcctctgtcctgttatgttgacggaatgccagagtgaaagggccagttggactagggctcacgt

SEQ ID NO: 139335 - DNA, 601 bp, Human
aatttttggctaacttatctgatatggaggtaaggccttgtaaagccttcataattgttccattgggagctgtgttgttagggctgaaagtacagcattggactctggtcttgacacagactttgcctttttttgctaacattatgttaagggctcttctattttcccagggcatttggctggtgggcctaattgttcagctatccctttaatggcatcgtctgcataattgacaaaccgctgttgattatagtaaatgtaatttatccagtctacatttttgtttatagttgaccaccakaacagtgcagatttgaatctgaatcctgcagctatttggtttcggggtttaaatttatctggtacctcttgtgggaccccagtagcagctacataaatgtgagggtcaaaagacccgtgaggagcatctttttttttttttttttttttttttttttgtgatcctctgtcctgttatgttgacggaatgccagagtgaaagggccagttggactagggctcacgtgccgctccagtttctcagcagagtgcctaatagtttaccgcagtaccaccatacatttgcttgagaatagacaaa

SEQ ID NO: 139336 - DNA, 601 bp, Human
cgcagagcaggtgcagacccgttattaggtaatcttcccgattttatttctgtgaggatatctccgtttactactgagtacccgttatgccttttttcttttattacttgcctcgatttccttcttttgaccatacatctggatggatgtatcctttatctagggtagtgagcaaatttagggaggggaggaatttttcttggttaacatagaggtctgggtttaattttagcattaaatctcttcctaaataggtttgttcctgcctccgggattaacagaagtttaatatttactgagyggtccttatatttaatttctgtttcttctaagatttttgctttaaacccctcttcttttactcccgaaataaaaagtttttcctgtgaacaagttacaccagggggaagataacaaactgaggagcgagcagctcctgaatcaatgaaaaaggtgataagctcaggtttgggtcccacctctaaatttatcaagggctcttggtgggacttgaggtaaaaaaaagagtggagcccttgaccgccgtattcttcctccaaggtcatgagtagaatgacttctttctctttttcccatctgg

SEQ ID NO: 139337 - DNA, 601 bp, Human
tccttgctttttgtttttgcttttcttttcctcgtcttttcgtacatataccttttgagcgtctctcaaaagctgctctatagatttatctttccagttctctattttctataacgtgttttgtgatgtctggccaactattggtaacaaaatggagctttaacatcccctgcccaagagggtcttctaaacctagacctgcatatatcctcgcttgctccttgagcctttctaagaactctgtaggtccttcatccttcccttgttgtatatagaaagctttgggaatgttttggatgcrgaatacagatttttgagttcctttaattatcagttctccaaggtcttgcatattcctccagtaggctgcgttgttactatcccattgaggatctgtggccgcaagtttttgctcagctgctgggacgttctgacctgggggatgctcacgttcccaaattgtcatagcagccctgcgaatcatgctcctgtcttctcctaaaaagcgaatacctaggatagacattagctcagcccaagtatatatctggggtctgagaaattgattaatctggtcagccactatataagggtcacttaa

SEQ ID NO: 139338 - DNA, 601 bp, Human
ttgctttttgtttttgcttttcttttcctcgtcttttcgtacatataccttttgagcgtctctcaaaagctgctctatagatttatctttccagttctctattttctataacgtgttttgtgatgtctggccaactattggtaacaaaatggagctttaacatcccctgcccaagagggtcttctaaacctagacctgcatatatcctcgcttgctccttgagcctttctaagaactctgtaggtccttcatccttcccttgttgtatatagaaagctttgggaatgttttggatgcggartacagatttttgagttcctttaattatcagttctccaaggtcttgcatattcctccagtaggctgcgttgttactatcccattgaggatctgtggccgcaagtttttgctcagctgctgggacgttctgacctgggggatgctcacgttcccaaattgtcatagcagccctgcgaatcatgctcctgtcttctcctaaaaagcgaatacctaggatagacattagctcagcccaagtatatatctggggtctgagaaattgattaatctggtcagccactatataagggtcacttaagag

SEQ ID NO: 139339 - DNA, 601 bp, Human
tttctttttttctttttttttttttaaggtggagtcttgctctgttgcccaggcaggagtgcaatggcacgatctccgctcactgcagcctctgcctcctgggttcaagcgattcttctgcctcagcctcccaagtagctgggactacaggcacacaccaccacacctggctaattttttgtattttatttatttatttatttccttggtagagatggggttgcaccatgttggccaggctggtcttgaactcctgaccttgtgatctgcctacctcagcctcccaaagtgctgggattayaggcatgagccactgcgcctggcctcttgcactctttctttagaggcccaaccccccttacttgagatttcttgcattcttttgcttctgcttaatccttctctggctgcttcctttgtgggaattttcaggtcccccttagcgttggtgggtcggtatgatcccccgacaggcaagacaggcaagctgtcctaagctgtatgaggtgaccacggaaccacagatccggactccacactcaattgtgcgtctcattcacacactttcaacctccaggatgtcctgaccaccaaggaaata

SEQ ID NO: 139340 - DNA, 601 bp, Human
ccttctctggctgcttcctttgtgggaattttcaggtcccccttagcgttggtgggtcggtatgatcccccgacaggcaagacaggcaagctgtcctaagctgtatgaggtgaccacggaaccacagatccggactccacactcaattgtgcgtctcattcacacactttcaacctccaggatgtcctgaccaccaaggaaatactgcactgccattgtgttttttcttaacctttgtctctgcacagagttacctggtcactgtggtatttgtaggcctttttctcccgcgttgctaagygtccgggtttattcgtcacaccaggtgggtctcgatccctaacccttgaggccaccacaacgaggcagtgggacctgtctcctcacgagtgaggactggagacccttccccagaggagaatgggaatcctggatgggcccccagattgttgggaacaagtaagctgtgctcaagagaaaaactagcactgagacaaaggatttctcagcaaggcaatttacttttgcagaagggtgccgcctgcatctgttacgactgcaagagcacactgaacaaaggagggaaggggtttttatccct

SEQ ID NO: 139341 - DNA, 601 bp, Human
ctgtttcctaagagaaaacgtggaatttggaagagattttgaagtttctttctcctgtcctctagcaagaatatatatcatgtctggaactcttggagcaaaggagtgggtgtacgaatggaagaagctccgatgggttgatgcagaatatctcacagccctcccggtgttggcccattccctgtctgttgtgtggtatgatgtgtgttgaaatggctccttgatcaaaagtaaacatagctgctttataccattgcgtggtaaactgtgaaggcaggcattgagagaggggtggtaaaaagaacctattcctggtcaaaaatgctaaaatacttggaagtgcaaatgttttggtgcgtggcatgtgagcaacatgtttactgtctgttctttcagctataattaatgccttccacgatactcatcataatcataccttaatgagaaggccctagaaaagaaacccaaccttttttgttgggttacttcgcatctatcatgatactttttcctttgattttatagcactttaggatgaacttacttttccgtgctaaatgttagctttggagaaagtgtatcatcagaaccatggagtttg

SEQ ID NO: 139342 - DNA, 601 bp, Human
ttctgatgaggaaacgaggtggggtacaggagcctacagaggactgaattgtgattacaagtagtcttcctgtgtccttgtcactcttacggtctagaagtagcttcgatgtttatttgcttggagtttcagcagcagaccgcggtgcttgaagctgttcatggaatgaccgcttgtgtctgagccagcgtctgaggaaactgatgttctataagtaggtctgagaggcttctctggagttggcccatgtcttgctccctcttgctgatgctctccctgccaggaatgttcttctctctcygggtttctctttagagccctctgcagacatcaccaccccagcaaagccctctgtaaccatccaacctgaagtggtttccccctgaatagcttaagcagatttctttttgttaatacagtccagttggtattaatcaccttctttctcagtcttcttttctattgctgtatatagttatacatttgtttttgtttttgagacagagtttcgctcttgttgcgcaggctggagtgcaatggcacaatctcagctcactgcatcctccgcctcccggattcaagtgattctccagccttgcct

SEQ ID NO: 139343 - DNA, 601 bp, Human
tcttcctgtgtccttgtcactcttacggtctagaagtagcttcgatgtttatttgcttggagtttcagcagcagaccgcggtgcttgaagctgttcatggaatgaccgcttgtgtctgagccagcgtctgaggaaactgatgttctataagtaggtctgagaggcttctctggagttggcccatgtcttgctccctcttgctgatgctctccctgccaggaatgttcttctctctctgggtttctctttagagccctctgcagacatcaccaccccagcaaagccctctgtaaccatccarcctgaagtggtttccccctgaatagcttaagcagatttctttttgttaatacagtccagttggtattaatcaccttctttctcagtcttcttttctattgctgtatatagttatacatttgtttttgtttttgagacagagtttcgctcttgttgcgcaggctggagtgcaatggcacaatctcagctcactgcatcctccgcctcccggattcaagtgattctccagccttgcctcctgagtagttgggattacagtcatgcaccaccatgcccagctaattttgtatttttagtagag

SEQ ID NO: 139344 - DNA, 601 bp, Human
tgtggtcccagctacttgggaggctgaagtgggagtatcgcttgagccaggaggcggaggatgcagtgagccaagactgtgccactgcactccagcctgggtgaccagagtgagaccctgtctcagaaaaatacaaataaaaaataaaaaagtgttattcaatatgaaacgcatggttgcatttccttggttgttccccagatgtttcgatagctatttttattccaatccaagagctaatgcagcattgcatttggttgttctctctttagatgcctttattctagacagttccttgctkcttctgtttatctttcaagactctgacattttttttttcgtttaagcgtctagggtggttgtgtagactgttccataatttgggtttgtctgatgatttcctcccgagtagctgggattataggcatgcgccaccacgcccggctaatttttgtatttttagtagaaacatagtttcaccatgttggccaggcgggtctcgaactcctgacctcaggtgattcgcttgccttgacctcccaaagtgctgggattacaggggtgagccaccatgcccggccttatttccccatgattagct

SEQ ID NO: 139345 - DNA, 601 bp, Human
ttccagaaccctccacagttagaattgtgtatgctgacagtatgcagaatctactgaccttaacatatctctgaaagacgggtcagggtaagagagtgcagaaacaaaaggcaggacttatctttttattgagtaagattgtattgtatgcttcaaaacatgttttttggacaaggactttgttttaggcattgaagtcctcgttctcctgaggataaaaagtctctgccctgcagcctagcagtgcatttggtggcagagtgacaggcttggaagagaatgtggagggagtaagggaggygcttgctaactgcccctgacgctgacagagctctggagaggtcagtgcagcttctgagttagctgctccttagcctggataccttaaatgccatctggttgggcatgccaaggtaaagtgaacgtctgtgcaaatatgagtctacgtggatggagaattttacagggaagggaacgtttttagtgtggttgaaattcaaggtgaggctgcgtgggtgacaccttatgctgaccactcttgtttcaggaattggaaggatggtgtgtgtattttgaaaatggcctagttctagctaaggct

SEQ ID NO: 139346 - DNA, 601 bp, Human
taattggctaccacatgtgggttttgcatcctttccagaccatcctgcgcatgagtctcttattaattttctgaaaatgtgactctggccacctgttcgcgctccctccatcccagctcctggagaggaaggccagggccttctgtctgcacccggcaaggcatggtctatgccacatcgtcatgcaccacagtgacccctggcctcacctctcaccacttccctcccctgggggctgtgggtcctgccgccacctgaggttgccttgcagtcgcactcctgagttctttcctggaaacgstctccgcctcgctggctgtgaacagaccctggcacgctttgaggcccagcctgcatgcctcctctctctcaaaggctttccccacgctgcctctccacgcagagcgtgttctcccccttctgcctcctggcacctgcttatccttctgaccctcatggatgtcattgactcccttccctccctcctgtactgactaccatggtcccttgtgcgtaggcagctggagtgtagcatgtgcttttcacatcgatttaaccttgtaacgttgtggagagaaagtgagatacaggcaagaaaact

SEQ ID NO: 139347 - DNA, 601 bp, Human
tgtattacttctgttcagaagggcagtcctgttgaaggtaaacatcagggaattgctgccagaaagggagtgtttttagtataataatggtctgaagctacttgtaccttgtcagaagtaaaatcaaagccatttgtgccattttcattaatatttttaacaccaaaggtttcttccttaactctgtttttggttgtgattaatttaagatgggaattcacagttctaacctcgcctcatttttagtacaggttgagcatctcaaatttggaagttcaaagtctgaaatgctccagatcaraaactttttgagcactgatatgatgctcaaaggaaatgctcattggagcattttggatttcagatctgtggatttgagatgctcaaccagtaagtataatagagctattcccaagatccgaaaaaattctgaaatcagaagcacttctggtcccaggcattttggagaagggatgctcaacccatacaaccttacagaggggtgacatctatcagtcaagcaagagtcatcctgcagtaccttcctttataatggggccgaccacaggggcaggcactgggtttcctttttcaggttcct

SEQ ID NO: 139348 - DNA, 601 bp, Human
accgtgcccagctaatttttgtatttttggtagaaatggggtttcgacatgttggtcaggatggtctcaaactcctggcatcaaatgatctgcctgccttggcctccctaagtgctgggattacagacgtgagccactgcacccggccttattcttattaccctatatcctatgacttccagttcacatgcaccatgggctactggaattttttttttttttttttggagacagggtcttactcttactctgttacccaggctggagtgcagtggtgcaatcacaggtcactgcagcctgyacctcctgggctcaggtggtcctcccatgtcagcctcctgagtagctagaactacaggcatgtaccaccacacctggctaatttttatattttttgtagagatggggttatgctatgttgcctaggctggtctcaaactcctgggctcaagtgatctgcacgcctgggcctctggatcgcttaggttttaatatgaattctgcaacatctttagtttggtaatctttgtggattgctacagagtaaattaaattatttacaaagaataatattgaataatttaattattcacaaggaata

SEQ ID NO: 139349 - DNA, 601 bp, Human
ggaataatcttgaaagatctcatgtgttctttactcatcttcccccagtgataacgtcttgcagaactgtgtgcaccagcacagtcaggatgctgccgtgcgcatagtcgagacgcagagtgcttcccaggcatctctctcatggcccttttacagccacacctgcttcgctcctgtccccaccccttccttagccccggcaaccactcttctgttttcggtttctctagttttgtcttttcaagagtgttatggacagggaatcataccgtatgtaactgctgaggctttttttttttttagcttagcataattctcccacgattcatccagttcctcacctggatcaatagttcattctttttttttgctgagtagtgttccgtggtgtggctgcagcgcagtccatttagcctcactcaggaaggacatctcggagttgtttccagtttctattatgagtaatgctgctatgaatgtttgtatatggggttttgtgcgaacataagctctcattgctctgggataaatgcccaggagtgcatttgttgggttgtataccgttgcatgtttaggttttaagaagatacctgttttctgg

SEQ ID NO: 139350 - DNA, 601 bp, Human
taacaggggttttgttttgttttgttttgagatggaatctcactctgtcgcccaggctggagtgcagtggcgcgatctcggctcactgcaagctccgctttctgggttcacgccattctcctgcctcagcctcctgagtagctggaactacaggcgcccgccaccacgcccggctaattttttgtatctttagtagagacggggtttcaccgtgttagcctggatggtctcaatctcctgacctcatgatctgcccacctcagactcccaaagtgctgagattacaagcgtgagccaccgygcccggccttaacagggtctttcgctgagcaaatgtttttaactttgaggaagttcattttatatattttttctcctgtggattgtgattttgttgtcacatctaagaattctttgcctagcccaggatcccaaagattttctatttttttttcctaaaagttttagttttgtgttttacatttaagtcgctgatctttgagttaatttttatacaaggtgtgaggtttagatcaagattcattgttattattgtttcagcctatggatgtgtaattgctccagtaacatgttgaaaaga

SEQ ID NO: 139351 - DNA, 601 bp, Human
catcttccgttggctagaaaaaaagaaaaatcttgggagagatgagtaatttgaatgttgaatatatactcacctttaaattggttttgttttaaagggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagygcacctgagcccgtggtgggcacccctgacggtgggtctggcaggggcttcatcccgagagcaaggctagggaagtcggcgttgccgttttctctctgtttgctctgcctgttcccgcttccttggaacattagataactcagaaaggaaagacccgtctctcgtttctggcccttgtcctctcgcttatgtaatacattcattttaccttttattagattttttgttaataggaaggattatatcaagttatttttattcttttatggataccagaaggtgtttgtttgtttgtttaag

SEQ ID NO: 139352 - DNA, 601 bp, Human
taactcagaaaggaaagacccgtctctcgtttctggcccttgtcctctcgcttatgtaatacattcattttaccttttattagattttttgttaataggaaggattatatcaagttatttttattcttttatggataccagaaggtgtttgtttgtttgtttaagaaatggggtctcactgtgttgcccaggatggtcttgaactcctgggctcaagcaatccttctgcctcggcctcccaaagtgctgggattataggtgtgagccaccacacctggcctaaggaaggtgtttttttttktttgtttgtttgtttgttttgagatagagtattgctctgttgcccaggctggagtgcagtggtgccatcttggctcactgcaacctccgtctcccgggttcaagtgattttcctgcctcagcctcccgagtagctgggaccacaggcatgtgccaccacgcctgactaatttttttatttttttatttttgagataaaaaagtctctgtcgcccaggctgcagtgtagtggcacaatctcggctcagtgcagccttcgtctcctgggttcaagtgattctcctgcctaagcctcttgagt

SEQ ID NO: 139353 - DNA, 601 bp, Human
agccaccagatttcttacattctccaacacagtagctccattcaaaatagatttagatttgcttggcttttttttttccataaattttatatcttgcaagtcctttttgtgttatgttcctcttggaattaaaacagtcattaatatctattatagtcatgaatagtattgtgatttggcaatagaggtaactcagtggtaatcagggaaagataattgagtcagaaagtgtacctgtggtttagtcagtgatttgatctcagagcctatccctcaagtcctctaaggaatctggtttacrtctgccatctctgcggtttcatgtgcctctaggactctaggaccacacgttaactccactgagcacaaagactttgggagcctaaagctccagtgttctttgttgtaaataaatgtcacttacattccagacaaactagatgccgactacatcaagagatacctgggcgatttgactccgctgcaggagagctgcctcattagacttcgccagtggctccaggagacccacaagggcaaagtgagtgtcagcaccacacccagtgtgcagggccagagctacgtgaaatcatggaatctc

SEQ ID NO: 139354 - DNA, 601 bp, Human
ttcttacattctccaacacagtagctccattcaaaatagatttagatttgcttggcttttttttttccataaattttatatcttgcaagtcctttttgtgttatgttcctcttggaattaaaacagtcattaatatctattatagtcatgaatagtattgtgatttggcaatagaggtaactcagtggtaatcagggaaagataattgagtcagaaagtgtacctgtggtttagtcagtgatttgatctcagagcctatccctcaagtcctctaaggaatctggtttacatctgccatctytgcggtttcatgtgcctctaggactctaggaccacacgttaactccactgagcacaaagactttgggagcctaaagctccagtgttctttgttgtaaataaatgtcacttacattccagacaaactagatgccgactacatcaagagatacctgggcgatttgactccgctgcaggagagctgcctcattagacttcgccagtggctccaggagacccacaagggcaaagtgagtgtcagcaccacacccagtgtgcagggccagagctacgtgaaatcatggaatctctttctgtcata

SEQ ID NO: 139355 - DNA, 601 bp, Human
agagcaaggtctggctacaaacagtgtcacgtcacaaagcaacatgtgttccaagtattcacacattcaaattttcagaaggtgtaaaaagagttcagagatttatcagagattagaaatgtttgagctttaattttcaggtttttggtgaaattttagcctcataaaggtgtaaatttttatggtaagccttatgtagtgagcagagcctggtatgtgtctagcgagttattggcattatttagtaaagggaaactaggcattgcatgtatttggcctgatctctaattctgtcagcctrcttactagaaaccaaataactgagtgctgttgaataccagtcatcaagaaaaccactgcagtgatgatggccaccgtttgttgtcttcttaccatgtattagacactgttttcaggtctttattccatccttccggcagctctctctgctgctgtttttctcactggttttacacgtgaggaaactgaggcacagagcagtgaagtaacctgcctgaggtctcacagccagcgagtggtggggtcaggatttgaacccaggccattttgttccagaacctacattcttaaccacttccac

SEQ ID NO: 139356 - DNA, 601 bp, Human
catgtattagacactgttttcaggtctttattccatccttccggcagctctctctgctgctgtttttctcactggttttacacgtgaggaaactgaggcacagagcagtgaagtaacctgcctgaggtctcacagccagcgagtggtggggtcaggatttgaacccaggccattttgttccagaacctacattcttaaccacttccacgtaactgtggtcctttctgagtgaagatgatgccacgtcagtaggccacatgcttttgagttatttcgcaggagttggggtcatgaatagctsatgttcccacccccttcttgttctgacggaccagcctcttgagttggtaaacacatggccacggaggaagacacttggtccacgtgacactcggaacacggccttggccttgttctttattcagggaggccaacctgttgattgacagtaatggaacctggagaagattcctgcgtgttagtcagcaatactgccacatcatgaaaacccaacatgctttttttgtattctttttctttaatctgtagtttttgtttttaattatcttaagtcttatgatcactcataatttttaacttt

SEQ ID NO: 139357 - DNA, 601 bp, Human
tactgacttttaaaagcatctgaccttatagattgtctataaaatgtgagaagtgttaaatattccttatttgatattacacataaactacactaaaatgccttttaataaataaagggaaccattttagatacaggaaattctaattagattggcatagttaaggccaaaaatataaagtagatattgctgccttatcttcagcctttgcctttaagaggcaaataaatacaaaatacaggtgagtcttgcttggttctgagacagtgaagggatttcctcagtatttaaatagagtcayatggccagttatgtaaacccaaatataaaaccaatctccaataggctttaagatggcatttacgatctttgtgaaagttgaacattactagcgaagtccagtcacatctttagaaggggaaagcagtgtagcgttactgaatcagaattattaaaattcagaaaaccgaacatagtcctttaaccacaagccagccttagttaaatcaggattgcccaaccaaactattctgatgatggttcatgatctgaattctggtgtatgagatctcttttttttttttttttgagacggagtctc

SEQ ID NO: 139358 - DNA, 601 bp, Human
actacactaaaatgccttttaataaataaagggaaccattttagatacaggaaattctaattagattggcatagttaaggccaaaaatataaagtagatattgctgccttatcttcagcctttgcctttaagaggcaaataaatacaaaatacaggtgagtcttgcttggttctgagacagtgaagggatttcctcagtatttaaatagagtcatatggccagttatgtaaacccaaatataaaaccaatctccaataggctttaagatggcatttacgatctttgtgaaagttgaacattactagcgaagtccagtcacatctttagaaggggaaagcagtgtagcgttactgaatcagaattattaaaattcagaaaaccgaacatagtcctttaaccacaagccagccttagttaaatcaggattgcccaaccaaactattctgatgatggttcatgatctgaattctggtgtatgagatctcttttttttttttttttgagacggagtctcgccctgtcgcccaggctggagtgcagtggcgcgatctcggctcactgcaagatccgcctcctgggttcacgccattcttctgcttc

SEQ ID NO: 139359 - DNA, 601 bp, Human
gggaaccattttagatacaggaaattctaattagattggcatagttaaggccaaaaatataaagtagatattgctgccttatcttcagcctttgcctttaagaggcaaataaatacaaaatacaggtgagtcttgcttggttctgagacagtgaagggatttcctcagtatttaaatagagtcatatggccagttatgtaaacccaaatataaaaccaatctccaataggctttaagatggcatttacgatctttgtgaaagttgaacattactagcgaagtccagtcacatctttagaasgggaaagcagtgtagcgttactgaatcagaattattaaaattcagaaaaccgaacatagtcctttaaccacaagccagccttagttaaatcaggattgcccaaccaaactattctgatgatggttcatgatctgaattctggtgtatgagatctcttttttttttttttttgagacggagtctcgccctgtcgcccaggctggagtgcagtggcgcgatctcggctcactgcaagatccgcctcctgggttcacgccattcttctgcttcagcctccccagtagctgggactcaggcacc

SEQ ID NO: 139360 - DNA, 601 bp, Human
ttatgtaaacccaaatataaaaccaatctccaataggctttaagatggcatttacgatctttgtgaaagttgaacattactagcgaagtccagtcacatctttagaaggggaaagcagtgtagcgttactgaatcagaattattaaaattcagaaaaccgaacatagtcctttaaccacaagccagccttagttaaatcaggattgcccaaccaaactattctgatgatggttcatgatctgaattctggtgtatgagatctcttttttttttttttttgagacggagtctcgccctgtcrcccaggctggagtgcagtggcgcgatctcggctcactgcaagatccgcctcctgggttcacgccattcttctgcttcagcctccccagtagctgggactcaggcacccgccaccacgcccagataatttttgtatttttagtagagatggggtttcactgtgttagccaggatggtctcgatctcctgacctcatgatccacccgcctcggcctcccagagtgctgggattacaggcgtgagccaccgctcccggccatgagatctgttaaattatgatatgcattaaaaagtcatgaca

SEQ ID NO: 139361 - DNA, 601 bp, Human
tgtatgagatctcttttttttttttttttgagacggagtctcgccctgtcgcccaggctggagtgcagtggcgcgatctcggctcactgcaagatccgcctcctgggttcacgccattcttctgcttcagcctccccagtagctgggactcaggcacccgccaccacgcccagataatttttgtatttttagtagagatggggtttcactgtgttagccaggatggtctcgatctcctgacctcatgatccacccgcctcggcctcccagagtgctgggattacaggcgtgagccaccgckcccggccatgagatctgttaaattatgatatgcattaaaaagtcatgacatttctgttttgtaataagacagtgaccaattattactcattagaaggttttttgagataaactttcaagtctgcccttgccgtcttctttctttttttttttttttttgagatggagtttcgctcttgttgcccaggctgaagtgcagtggcgcgatcttggctcactgcaccctctgcctccaggttcaagtgattctcctgcatcagcctcccaagtagctgggactacaggcgtgcaccaccacgcc

SEQ ID NO: 139362 - DNA, 601 bp, Human
ccttggcctcccaaagtgctgggattacaggcctgagccaccacaccccgccagtgaagaccatttttgttccagggattctccaaataccccatcagtgtgtcctcactccaggtgatgcttttgttcttattggcatctgtgtataagagaatccagcagcctgacctgtcgtctgcccggagagacggtggagatgtggcccagtcttgtgcttgcttcccttttccatggtgtggcactgggcggcaccctttggaacaaaaatcttgcctttctcaacatcatccatgtttaattytcttttgtctctggcactacgaaggtttccattcagaagccaggtgtcctgctctctctttattctaactttttatttaaatgcagtatgtatacagaaaagtgcaaggatcatagtcattcatagatccgttcatagagttgaagcatttgatgtttagggaattatttatgcctttgctctactttgcggaaacgaaaatgaaatactataaagattattcaaactgataatgctgattttctctagagtagtaagggagatgtttctggtaccacctcatttttaatagtataatag

SEQ ID NO: 139363 - DNA, 601 bp, Human
ggctcacgcctataatcctagaagtttgggaggcggaggcaggcggattgcctgagctcaggattttgagaccagcctgggcaacacggtgaaaccctgtctctagtaaaatacaaaaaattagccgggcatggcagcgtgcgcctgtagttccagctacttgggaggctgaggcaggagaattgcttgaacctgcaggcagaggttgcagtgagctgagatcgtgccactgcactccagcttgggtgacagggagagactctctctctaaaaaaaataaaaaaataaaaaaaaaaaaaaacagagtagagccaacacaggctgcttggtggggttttaaggatttttagaatgttctcatttgtcttggtccttagagtgggaattgagggaagctggcttttaaaaagctttcattcagtttttagtaatctatgacatgaaaaaaaatgattttctaagaaagaaaattttaaaagtactctgtagtcatagaaaaagtgtctggatagtttgatgttcccttgccgttgaaaatcagagctcttgggcagccccagttgttcaaagtgagcccagcttatgggcagttgttcagact

SEQ ID NO: 139364 - DNA, 601 bp, Human
cacaggctgcttggtggggttttaaggatttttagaatgttctcatttgtcttggtccttagagtgggaattgagggaagctggcttttaaaaagctttcattcagtttttagtaatctatgacatgaaaaaaaatgattttctaagaaagaaaattttaaaagtactctgtagtcatagaaaaagtgtctggatagtttgatgttcccttgccgttgaaaatcagagctcttgggcagccccagttgttcaaagtgagcccagcttatgggcagttgttcagactgagcccagcacttaygcagctcgagctgagtgagtcccagccggattcccctcatcccggcacagccttctatttccaggaccctgcacagctaccctgtcagttggtttttatttttctcgcttacagctttttggggtaaatattggacacacaccccctatcacacaaatcagttgccacttctaagaatcagaaagacttttaagcgcccctagaacacaggcgaacacatattcctgttaagggtcttagagttgtatcctcagtttcaactgggatggtgctgacaactcattccttcccctcctctgc

SEQ ID NO: 139365 - DNA, 601 bp, Human
catttgtcttggtccttagagtgggaattgagggaagctggcttttaaaaagctttcattcagtttttagtaatctatgacatgaaaaaaaatgattttctaagaaagaaaattttaaaagtactctgtagtcatagaaaaagtgtctggatagtttgatgttcccttgccgttgaaaatcagagctcttgggcagccccagttgttcaaagtgagcccagcttatgggcagttgttcagactgagcccagcacttatgcagctcgagctgagtgagtcccagccggattcccctcatccyggcacagccttctatttccaggaccctgcacagctaccctgtcagttggtttttatttttctcgcttacagctttttggggtaaatattggacacacaccccctatcacacaaatcagttgccacttctaagaatcagaaagacttttaagcgcccctagaacacaggcgaacacatattcctgttaagggtcttagagttgtatcctcagtttcaactgggatggtgctgacaactcattccttcccctcctctgcagatgggcggcccctctacgtgctcaggctggggcagatggac

SEQ ID NO: 139366 - DNA, 601 bp, Human
ttgggcagccccagttgttcaaagtgagcccagcttatgggcagttgttcagactgagcccagcacttatgcagctcgagctgagtgagtcccagccggattcccctcatcccggcacagccttctatttccaggaccctgcacagctaccctgtcagttggtttttatttttctcgcttacagctttttggggtaaatattggacacacaccccctatcacacaaatcagttgccacttctaagaatcagaaagacttttaagcgcccctagaacacaggcgaacacatattcctgttargggtcttagagttgtatcctcagtttcaactgggatggtgctgacaactcattccttcccctcctctgcagatgggcggcccctctacgtgctcaggctggggcagatggacaccaaaggcttggtgagagcgctcggggaggaagccctgctgagatacgtaagtgcgcggctgcgagactccaggtgccactgtggcgtcactttttttctctgccagtaggattggggtgttaaccagcctgttagaacaaacatgaattgcttatgtagttaggactgaaaatatattaatatcgt

SEQ ID NO: 139367 - DNA, 601 bp, Human
atagccccattatcctgaaatacgcatttttggctttattttttattatgttttttgagacggagtttcactcttgttacccaggctggagtgcaatggtgtgatcttggctcactgcaacctccacctcccaggttcgagtgattctcctgcctcaacctcctgagtagctgggatttcaggcacccgccaccatgcccagctaattttttcatatttttactagagacggggtttcaccatgttggtcaggctggtctcgaactcctgatctcaggtgatcctcccgccttggcctccygaagtgctggaattacaggcttgagccaccctgcccagccagctttttttttttttttttttttttttttaaagagacatcgtcttactctgttgctgaggctggggtacagtgtacagtgtctattcgtgggtgtcatcacgactcactgcagcttcaaactgctgtcctcaagcagtcctcccacctcggcctcctgagtagctgggactacaagcaccaccactgagcctggctcactgttggcattcccttgtgtattgtgttagtctgcccccaccgctatgtgtgtttatatat

SEQ ID NO: 139368 - DNA, 601 bp, Human
attatgttttttgagacggagtttcactcttgttacccaggctggagtgcaatggtgtgatcttggctcactgcaacctccacctcccaggttcgagtgattctcctgcctcaacctcctgagtagctgggatttcaggcacccgccaccatgcccagctaattttttcatatttttactagagacggggtttcaccatgttggtcaggctggtctcgaactcctgatctcaggtgatcctcccgccttggcctcccgaagtgctggaattacaggcttgagccaccctgcccagccagcyttttttttttttttttttttttttttaaagagacatcgtcttactctgttgctgaggctggggtacagtgtacagtgtctattcgtgggtgtcatcacgactcactgcagcttcaaactgctgtcctcaagcagtcctcccacctcggcctcctgagtagctgggactacaagcaccaccactgagcctggctcactgttggcattcccttgtgtattgtgttagtctgcccccaccgctatgtgtgtttatatatccccacatgcacacgttcacacataaagatagggatggacttta

SEQ ID NO: 139369 - DNA, 601 bp, Human
cgccttggcctcccgaagtgctggaattacaggcttgagccaccctgcccagccagctttttttttttttttttttttttttttaaagagacatcgtcttactctgttgctgaggctggggtacagtgtacagtgtctattcgtgggtgtcatcacgactcactgcagcttcaaactgctgtcctcaagcagtcctcccacctcggcctcctgagtagctgggactacaagcaccaccactgagcctggctcactgttggcattcccttgtgtattgtgttagtctgcccccaccgctatrtgtgtttatatatccccacatgcacacgttcacacataaagatagggatggactttatctacaggggaggggtttattaacctaaagcaaaggatcgcttgagccatgccttacatctgttctcaggctgccttttctcttggcgggcacatgtggtatcagagtgttctcacactcacagacattcatctcctgttcccatgcacttgttctgaagacagagccccagagccaggcccctgctcatctggggatacctctgtgcttcactttggatagccgttacctttgccacacatg

SEQ ID NO: 139370 - DNA, 601 bp, Human
gctctaagttacagtaaagagttctgaaaatgtttagtgattcagaggttgacattgataagggtgtagatggttcactgggatgtaagttccatgagaacagggtttttgagggccttttgctgactgctgtattctcagctcctgggacagtgcttgcctctctctctgttgaagcatagcccactgcagttcagacgcaatatgtgttaaaataccagctgtgtgccctgttgatggcaggttggggggtggtttagcacgtcgaggacagcacactgtggctttgcttgccggctcrctgagcatatctgagagagcttttcgtgcattatcagtcagccttaattgcagtttcaggccttggtcctaccacactgatcctgtgtgttttgtacaagtagatataaacagggttcatagcactatacatagcactataatttaaaaaaattgattatgatgtatttggaaatagctataaatgaccaaaaaggaagaaaataagacacagtttgctaagtgtgctgtctgttgaatgaaacacatctctgcacaacctgcagctcatggacctgcctggtggacttggaagggctga

SEQ ID NO: 139371 - DNA, 601 bp, Human
taccagggtcctggaggcctgctggattacatcgacaaagagattattccagatttcctgagtggggagtgcatggtatgtcctgaggcgaggaactgcacatttggccccttatgcaggtgggagaggtcggtgtcgatttgcacaaatgattttcagaacttccagttgtttggatgttttgtttttgttttgtttcttttggccgccatttctctgatccagggttaagctaaagagaaccattgaagtaattgttgatactgtacatttcttcattgttaaatacgaatgagaattsgtagaatcaaatacgattgcagcttgctttgattcacacggctttgtgtgaatcagatctttaaacaattttagaggagctgtcatattttctaaaatactgttaaaaaattgaatcagttctcaaaatttcccacccgcccctccccgtccttttttttatggagacagggtccggctctgtcacccaggctggagtgcagtggtgcgatcacagctcagcagcctgacttggtgggctcaggtgatcctcccacctcagccacccaagtagctgggactgtaggcgtgcaccaccata

SEQ ID NO: 139372 - DNA, 601 bp, Human
gagaaccattgaagtaattgttgatactgtacatttcttcattgttaaatacgaatgagaattcgtagaatcaaatacgattgcagcttgctttgattcacacggctttgtgtgaatcagatctttaaacaattttagaggagctgtcatattttctaaaatactgttaaaaaattgaatcagttctcaaaatttcccacccgcccctccccgtccttttttttatggagacagggtccggctctgtcacccaggctggagtgcagtggtgcgatcacagctcagcagcctgacttggtgtgctcaggtgatcctcccacctcagccacccaagtagctgggactgtaggcgtgcaccaccatacccagcgaattttttgtagaggcagagtctcactattttgccccagactggatgacatttttggtttttttttttcttcttgagatggagtcttgctctgttgcacaggctggagtgcagtggtgcaatctcagctcactgcagcctccgcctcccagattcaagcgattcttcagtctcagcctctggagtaactgggattacaggcatgcgccactacccacagctaattgtttt

SEQ ID NO: 139373 - DNA, 601 bp, Human
agaaccattgaagtaattgttgatactgtacatttcttcattgttaaatacgaatgagaattcgtagaatcaaatacgattgcagcttgctttgattcacacggctttgtgtgaatcagatctttaaacaattttagaggagctgtcatattttctaaaatactgttaaaaaattgaatcagttctcaaaatttcccacccgcccctccccgtccttttttttatggagacagggtccggctctgtcacccaggctggagtgcagtggtgcgatcacagctcagcagcctgacttggtgggctcaggtgatcctcccacctcagccacccaagtagctgggactgtaggcgtgcaccaccatacccagcgaattttttgtagaggcagagtctcactattttgccccagactggatgacatttttggtttttttttttcttcttgagatggagtcttgctctgttgcacaggctggagtgcagtggtgcaatctcagctcactgcagcctccgcctcccagattcaagcgattcttcagtctcagcctctggagtaactgggattacaggcatgcgccactacccacagctaattgtttta

SEQ ID NO: 139374 - DNA, 601 bp, Human
aatttagtttatttcatggttatattgaacaagtttcatgtgctactttttctttttttttttctagacagagttttgctctgttgcccaggctggagtacactggcatgatctcaactcactgcaacctccgccttatgggttcaagcaattctcctgcctcagcctcccaagtagctgggattacaggcacccgccaccacgcctggctaatttttgtatttttagtaaaggtggggtttcaccatgttggccaggctggtctcgaacacctgacctcaggtgatccacctgccttggyctcccaaagtgctgggattacaggtgtgagccactgtacctggcccgtttgctactttttcttggctgggttttggttatttatagatatcttggggattttccgatttctgtaagtctaatggagcaaggagggtgttcctgtattccttttttgctgtcacttttggtagagaagcaagggcgttccgtgttcctgtgcatgccatatgtctgtcctgtagcatcacgagtgacctgaagcaggaggggcctgcagcggaatctcccttctcagctaggacaaggttcgtggcccaga

SEQ ID NO: 139375 - DNA, 601 bp, Human
acatggtaaaaacctccgttctgctttgggtattaaataaagcacagatccgagatggcaacaaactgaaaggaaggctgaagcggaggcccccactgtgaatgcaggaaagaggttccgtcagcacagggggccgaggcctcaggatggagctgcctggggagccactttgctgaagagggggccgtgccacgtggtgccgcctgctgttcttagacaggacccttgtacctcactgaatctgctgtggaaggacattctgaagtggcgtttcagtggtgaggtggcagtggtgggattraaggggcccggctcgtagagcagccacgcgctgaagggcacagcagacagcgtgcatgggctgagaggggccgtgggcctggctctgctgcttccttaggtggagttttcagtgactgcagaactctgcacagctgcttttcattctcacgtccgcccccgcccaatctttgaaactaactttgattattccctcctgggtagctctgtcggtgctgtgtaagtttggttttcaattggttctcagcacccagggggtgaccacctcaaccccatctctactatgccaggggctcatccc

SEQ ID NO: 139376 - DNA, 601 bp, Human
cagggccttctgttctgtccagcccagggcagtcctctgaaccactcatgtacgagctcacagtgtttggtgtttctaagacctggcctcttagagtgtgtgtgaagatggtgtatgggagatcttggacctctaggtgcaggtcacaaagaacacagagcttggtgcatgacatgtagcaggatccagcggttgaatggatggtggtgtgtgactctggggaaagagatccgtccatacgcattcagcgtttccctccccagcttcagcacctgcaccctggatcccctggagagcacgrtgcgctcgcagcatgccggcctggtgctcgtggatcgtggctgcctaacgctgcctctttttcagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaag

SEQ ID NO: 139377 - DNA, 601 bp, Human
gcaggtaaaatcacacacaggtcaaatcgcgcatccgtgactccacacggccaggtgattctgtcttgagtagactctttgcttcgctccttgagcagccctgtgtagcttttgaggccctgcttgtggaggagcagcttgcctggaggagcaggaagccaagtgggtctcgtaggaaggagttcaggcctcgcagtggttttggacagaatctgcgacttttcccaaaagcagcctgtgacaggaagggaaggcatcgcacgcacgggcccagctgggcttcataggatttttccccccygcctcatttcaccgggttgtgtttgtctttttcaaaggaaaatcaccctaaatagaagtaagagggacaagtacttagagaactattagctctcattaccaaaccttctaatttgtttcaaatgctttcagttcccttttcacattgtggctggttattttgggtgcctgtgctcacagtagcctcggggcgggggcattgcttctggccttcataatagatgcatcgttttgctgcctttacagttttcaggggtaaggcttgtcagtgtttcagtggtcttagaggcagagtaaaaga

SEQ ID NO: 139378 - DNA, 601 bp, Human
tcaaatcgcgcatccgtgactccacacggccaggtgattctgtcttgagtagactctttgcttcgctccttgagcagccctgtgtagcttttgaggccctgcttgtggaggagcagcttgcctggaggagcaggaagccaagtgggtctcgtaggaaggagttcaggcctcgcagtggttttggacagaatctgcgacttttcccaaaagcagcctgtgacaggaagggaaggcatcgcacgcacgggcccagctgggcttcataggatttttcccccccgcctcatttcaccgggttgtrtttgtctttttcaaaggaaaatcaccctaaatagaagtaagagggacaagtacttagagaactattagctctcattaccaaaccttctaatttgtttcaaatgctttcagttcccttttcacattgtggctggttattttgggtgcctgtgctcacagtagcctcggggcgggggcattgcttctggccttcataatagatgcatcgttttgctgcctttacagttttcaggggtaaggcttgtcagtgtttcagtggtcttagaggcagagtaaaagaatcctttgtccattttaaaaa

SEQ ID NO: 139379 - DNA, 601 bp, Human
ttctgtcttgagtagactctttgcttcgctccttgagcagccctgtgtagcttttgaggccctgcttgtggaggagcagcttgcctggaggagcaggaagccaagtgggtctcgtaggaaggagttcaggcctcgcagtggttttggacagaatctgcgacttttcccaaaagcagcctgtgacaggaagggaaggcatcgcacgcacgggcccagctgggcttcataggatttttcccccccgcctcatttcaccgggttgtgtttgtctttttcaaaggaaaatcaccctaaatagaartaagagggacaagtacttagagaactattagctctcattaccaaaccttctaatttgtttcaaatgctttcagttcccttttcacattgtggctggttattttgggtgcctgtgctcacagtagcctcggggcgggggcattgcttctggccttcataatagatgcatcgttttgctgcctttacagttttcaggggtaaggcttgtcagtgtttcagtggtcttagaggcagagtaaaagaatcctttgtccattttaaaaacaatgaacagctaagctgtgttaaccagtcatgaatt

SEQ ID NO: 139380 - DNA, 601 bp, Human; identical to SEQ ID NO: 40618

SEQ ID NO: 139381 - DNA, 601 bp, Human; identical to SEQ ID NO: 40619

SEQ ID NO: 139382 - DNA, 601 bp, Human; identical to SEQ ID NO: 40620

SEQ ID NO: 139383 - DNA, 601 bp, Human
gcaacaagagtgaaactccgtctcagaaaaaaaaaaaaaaagatttattattattattagtattattagttttaatacaaacaatcccacagcatttattgccatcttgtaaaaacataagtgtaatcaaaacaatatgaataaatgttcatattggacaaaggacgtctaaaaacaaactgtatccttctcaacaatttctcacttcattgatcatttctagttggagacactttgtagcagagtaatattatctccttttagcatgatccgacccagttgttttcttgactttgttttmgaatgaatctcttctgcatcatctaatacaaggttcatatactcatcaaaaccaatgatacagccttctatctgcatattcacttgctcatagagccacacctgaatctgcgatctattttgtaagtatctgaagatgaggttgatgggctgcaccataaccttctgcactttctggccctggccactgtatgccatggtggaatttcacaaagagcacacttgcaagcttattattattatttttatttttgaaatggagttttgctcttgttgcccaggctggagtgcaatggcgcga

SEQ ID NO: 139384 - DNA, 601 bp, Human
agaaaagaaaaaccattcggactcgaaaagtactgctgtctttcagttggtaaataataaaatttggacgtgaggtaagaaaacaattggaagatactgcgatctaaagaagcgtgggggagggaggcgagatgtctggtcacttccccagttgcacgaccttaggcaattcctagatcctttgagtctatccgggtctgcgcaggtaatgacacctctcaacccaaagtatgagagcaccctggccggtgagagggtgcctgggaagtggggaatctgctacaaaacgcaggggaagctsgcgggggccctaggataaagaccaagaaccgcacaacaccgactctctcctaacacaaaactgtctgctccgagaaccaaatatcccaccttcccgcggctccggaggtacccgccactgttttattttaatccacacattcccagtcctgagcaatccttaccccagagctcgattttcagggaaccacaaaagacaaataggccagaataatctaagtccaagggagccctcccggccacttacaaacagggtcttccattttcaagggtcttttcaaacggatgttggcagggaccg

SEQ ID NO: 139385 - DNA, 601 bp, Human
acatgcaggttttcaacgaccatcagatttgaaaccaacaaaggcagcagccctcagcatagcctgagcagccaacctgaagcagataggctccatacctcaaatgtccaccttcaaacaaaataaagcttgccatctgcacactagatcctttctatcatagcaacaaaataaaacagctgctctctcttcatttgactctagaagaaaaagagataagtatctccatgattgaaagtgagataaccagatgagatttttttttaagagctcagcctgtgcccttgacttatggattgtycccccaccccatggaagtcaaatacccacataaaaatacccctgaaaagcaatcttggaccattaaaaatattttaaacctaaaataaaattctaagaaagtctatgactaaactgacctttcttaaacaaatgtaaatcttatttgtgtgtttttctagaaaaaccattcggggtagggcacagtgactcgtgcctgtaatcccagcattttgggaggccgaggcagacggattgcctgaggtcaggagttcgacaccagcctggccaacatgaagaaaccctgtctctaataaaaata

SEQ ID NO: 139386 - DNA, 601 bp, Human
ttgtaatatacattaatacatgaaagcacgttaaagagtgtccagtacatggtaagcactacataaatgtctgagattactgagttatgtgtaataagtaacccaagtatttccaaactgatcacaatctttactctgcaatgaggacatttaacactcctataactagctctcactacagttttctctgtacatggcaaacaaatatttaatccagaattcctttctgactacactagaacacaggcattcacatgaaaccaagtttgagtaatggtgctccactattaaatggaaatgmtactaccagagcttacatgcaccaatttgctctccccacctggagaatattcattcaccatgacacgtgcacacctcagagtcaaaattcatcctttgcagatgcatcctcctccactctcccaacacccccagctcactattccaagaaacaagctttgttggagaactggtccatttcagggaatggggggacttctgattgtgcaatattttctgcgtgaatcatcccaaactagatggaacaagctcaaaatgtcacagaagctgctaggtttaaaatttatatggcatgggcatg

SEQ ID NO: 139387 - DNA, 601 bp, Human
atctgaatatcacggtttcttcatttttaaaacagaagtattaatggtattttcctcatagggttgtaatatacattaatacatgaaagcacgttaaagagtgtccagtacatggtaagcactacataaatgtctgagattactgagttatgtgtaataagtaacccaagtatttccaaactgatcacaatctttactctgcaatgaggacatttaacactcctataactagctctcactacagttttctctgtacatggcaaacaaatatttaatccagaattcctttctgactacactrgaacacaggcattcacatgaaaccaagtttgagtaatggtgctccactattaaatggaaatgctactaccagagcttacatgcaccaatttgctctccccacctggagaatattcattcaccatgacacgtgcacacctcagagtcaaaattcatcctttgcagatgcatcctcctccactctcccaacacccccagctcactattccaagaaacaagctttgttggagaactggtccatttcagggaatggggggacttctgattgtgcaatattttctgcgtgaatcatcccaaacta

SEQ ID NO: 139388 - DNA, 601 bp, Human
ggaaagctaaaaccactaataagggcaccattcagagaaatcagtgctgccagtgacacatatccttctagtccttttgttgttgttgagtgcatgtggatggggaatgcaggattcacttgagcaggacaggattttgaactgaatagctttgcttgtttctctgaataatgacttacttagcagccagttcatgatcaaagtattttgtcaaggcactttctgaattgtccaagaagagggggagcatccttagtgactgatgaaccacccgtcctcccctggttctgtccggccattstgtcctatacatgttaatcccactacctccagcagcctcccccagatttatctagcagagcatcactgctcattcttcagtattgcacttccgtgaccccttcccttgccctagcagcaggcttgagtgttcccacgtctgtgctgccaggaagctgctgcgtttccactggggcagttggcatatggcagggtgattctagtgcaactgggtttgtgcacatctgtaaactggatattccaggtgagtcaggacagaagttttccactttgtacacccacgaccttgcaaaggacaaaa

SEQ ID NO: 139389 - DNA, 601 bp, Human
aaactttaatccctgcagtttatctacgattagttcagtctagttcagtctagttgccttgagatgaattcactgaaaagactacacagcgaggcataccatagctaaaagtaactggctttggtcataaagtaatttttaactttgaattaattataaaatgaatacctacactgcagaaaattccaaaactgcaaagtaattaaaggaaagctaaaaccactaataagggcaccattcagagaaatcagtgctgccagtgacacatatccttctagtccttttgttgttgttgagtgcrtgtggatggggaatgcaggattcacttgagcaggacaggattttgaactgaatagctttgcttgtttctctgaataatgacttacttagcagccagttcatgatcaaagtattttgtcaaggcactttctgaattgtccaagaagagggggagcatccttagtgactgatgaaccacccgtcctcccctggttctgtccggccattctgtcctatacatgttaatcccactacctccagcagcctcccccagatttatctagcagagcatcactgctcattcttcagtattgcacttccg

SEQ ID NO: 139390 - DNA, 601 bp, Human
ggtttagtttctcctctctcttccacaagcaatgtgcaattttgtgtaaactttaatccctgcagtttatctacgattagttcagtctagttcagtctagttgccttgagatgaattcactgaaaagactacacagcgaggcataccatagctaaaagtaactggctttggtcataaagtaatttttaactttgaattaattataaaatgaatacctacactgcagaaaattccaaaactgcaaagtaattaaaggaaagctaaaaccactaataagggcaccattcagagaaatcagtgytgccagtgacacatatccttctagtccttttgttgttgttgagtgcatgtggatggggaatgcaggattcacttgagcaggacaggattttgaactgaatagctttgcttgtttctctgaataatgacttacttagcagccagttcatgatcaaagtattttgtcaaggcactttctgaattgtccaagaagagggggagcatccttagtgactgatgaaccacccgtcctcccctggttctgtccggccattctgtcctatacatgttaatcccactacctccagcagcctcccccaga

SEQ ID NO: 139391 - DNA, 601 bp, Human
cagctgccacggcctagttgcccctggggtcagttcaggagagtgcgcaacccaactagggtgacaaagccaacacctgcagctgcattacacaatgctccctccctccactcactgccctccattaaccatttagtagaaatcactctggaacattcagctggcacaagtccatcattctgacaactcatctcctcagttctagttgaataatgtgaacattggagggtttagtttctcctctctcttccacaagcaatgtgcaattttgtgtaaactttaatccctgcagtttatctaygattagttcagtctagttcagtctagttgccttgagatgaattcactgaaaagactacacagcgaggcataccatagctaaaagtaactggctttggtcataaagtaatttttaactttgaattaattataaaatgaatacctacactgcagaaaattccaaaactgcaaagtaattaaaggaaagctaaaaccactaataagggcaccattcagagaaatcagtgctgccagtgacacatatccttctagtccttttgttgttgttgagtgcatgtggatggggaatgcaggattcact

SEQ ID NO: 139392 - DNA, 601 bp, Human
actgttacagtcatttaatggaaatttattggaatcatcctaaagaagaaataataattcctataagctgggaattgaatgagtcgggaatggccaaaggaaagccttgtcacagactgcggggcctacaggcaggacctggcaatgggcatcatctggctaaagacaagtcgtggcctcggcctggggaacagctgccacggcctagttgcccctggggtcagttcaggagagtgcgcaacccaactagggtgacaaagccaacacctgcagctgcattacacaatgctccctccctccrctcactgccctccattaaccatttagtagaaatcactctggaacattcagctggcacaagtccatcattctgacaactcatctcctcagttctagttgaataatgtgaacattggagggtttagtttctcctctctcttccacaagcaatgtgcaattttgtgtaaactttaatccctgcagtttatctacgattagttcagtctagttcagtctagttgccttgagatgaattcactgaaaagactacacagcgaggcataccatagctaaaagtaactggctttggtcataaagtaat

SEQ ID NO: 139393 - DNA, 601 bp, Human
gtctgactcccttgctacagcaagctcattacagcctttgtttctctcatttagctaatctttactgttacagtcatttaatggaaatttattggaatcatcctaaagaagaaataataattcctataagctgggaattgaatgagtcgggaatggccaaaggaaagccttgtcacagactgcggggcctacaggcaggacctggcaatgggcatcatctggctaaagacaagtcgtggcctcggcctggggaacagctgccacggcctagttgcccctggggtcagttcaggagagtgcscaacccaactagggtgacaaagccaacacctgcagctgcattacacaatgctccctccctccactcactgccctccattaaccatttagtagaaatcactctggaacattcagctggcacaagtccatcattctgacaactcatctcctcagttctagttgaataatgtgaacattggagggtttagtttctcctctctcttccacaagcaatgtgcaattttgtgtaaactttaatccctgcagtttatctacgattagttcagtctagttcagtctagttgccttgagatgaattcac

SEQ ID NO: 139394 - DNA, 601 bp, Human
ctctgtctttccatcccatttcacatcatttctgaacgctcatgacattttacccacagctttcatggcacctagaactttttaactgtctgtctgatctatttatattaagaaggtaagatgtaagccccttggagatagtgactatgtttattcaaatgtatatcctcactgggcacggtggctcccgcctataatcccagcactttgggaggccaaggcaggcagatcacgaggtcaggagtttgagaccagcctgaccaacatagtgaaaccccgtctctactaaaaatataaaaaytagctgggcatggtggtgcgtgcctgtagtctcagctactcgggaggctcaggcaggagaatcgcttgaacccaggaggcagaggttgtggtgagccaagaccgtgccactgcactctagcctgggcaacagagcgagactctgtctcagaaaaaaaaaaaaaagtatatcctcagagtgtctttcaatagtagtcagtaaacatttaacaattaggcaacaaggtgacagtccaatctgcctattgagaattaatgacaaaaacagagctttttcacaagatggcgccgaaagcgaaga

SEQ ID NO: 139395 - DNA, 601 bp, Human
attttaggactcaacacattaaaaatttttttttactttttttttttcaaagagacaggatgttgcccaggctggtcttgaactactcggctcaagcaatccacccaccttaacctcccaaagtgctgagattacaggtgtcagcctgtaatctcatcacttttaaaacaaatattttcacccctccacttttaccatgatatacttcgacatttatctgaatatcccccaaataattgatagcataattatttaagattccatcagggatgatcccgcaacaacattcaagtgcttgccraattatgtcttgcacattgcatttctccatttcctttttctcagtgaaggtactgcctttgcttgagtttttgtttgtttgtttgttgtttttttttttgagacagagtctcactgtcgcccaggctggagtgcaatggcgcggcttagctcactgcaacctccaccttccgggttcaagcgattcttctgcctcggcctcagcgtcccaagtagctgggattacaggcatgcgccaccacgcccaggtaatttctgtatttttagtagagacggggattcaccatgttggtcaggctgg

SEQ ID NO: 139396 - DNA, 601 bp, Human
ttttgtatttttagtagagacagggttttgccacgttgcccaggctgatgctgaactcctggcctcaagtgatccatccgcctcagcctcccaaagtgctaggattacaggcatgagccactgtgcccagccaagactgagatttctagtttgggattctaattttaataagaaaggaaaaactgatcataatttattttaggactcaacacattaaaaatttttttttactttttttttttcaaagagacaggatgttgcccaggctggtcttgaactactcggctcaagcaatccaccyaccttaacctcccaaagtgctgagattacaggtgtcagcctgtaatctcatcacttttaaaacaaatattttcacccctccacttttaccatgatatacttcgacatttatctgaatatcccccaaataattgatagcataattatttaagattccatcagggatgatcccgcaacaacattcaagtgcttgccgaattatgtcttgcacattgcatttctccatttcctttttctcagtgaaggtactgcctttgcttgagtttttgtttgtttgtttgttgtttttttttttgagaca

SEQ ID NO: 139397 - DNA, 601 bp, Human
atagtccaggcacagtggctcacgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcagaagaattgcttgaacccaggaggcggaggttgcagtgagccgagatcgtgccattgctctccagcctgggtgacagagcagaactggttttgtttgtttttttttttwaaaaagtccgggcacaatggctcacgcctgtaatgccagcactttggaaaatcccagcactttggaaggccgaggcaggcggatcacttgaggtcaggagttcgaaaccagcctggccaacatggtgaaaccccgtctctactaaaatatacaaaaattagacaggcgtggtggcaggtgacttaataccagctacctgggaggcagaggcaggagaatcatttgaaccccggaggcagaggttgcagtgagctgagatcgagccattgcactcaaacctgggggataagagcgagactt

SEQ ID NO: 139398 - DNA, 601 bp, Human
cagtgagctgtaatcacaccactgcactccagcctgggcaacagagtgagaccccacctcaaaaataaaattaaaaaacccaaaatagtccaggcacagtggctcacgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcagaagaattgcttgaacccaggaggyggaggttgcagtgagccgagatcgtgccattgctctccagcctgggtgacagagcagaactggttttgtttgtttttttttttaaaaaagtccgggcacaatggctcacgcctgtaatgccagcactttggaaaatcccagcactttggaaggccgaggcaggcggatcacttgaggtcaggagttcgaaaccagcctggccaacatggtgaaaccccgtctctactaaaatatacaaaaattagacaggcgtggtggcaggtgacttaataccagctacctgggaggcagaggcaggag

SEQ ID NO: 139399 - DNA, 601 bp, Human
cttgaacccaggaggtcgaggctgcagtgagctgtaatcacaccactgcactccagcctgggcaacagagtgagaccccacctcaaaaataaaattaaaaaacccaaaatagtccaggcacagtggctcacgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcasaagaattgcttgaacccaggaggcggaggttgcagtgagccgagatcgtgccattgctctccagcctgggtgacagagcagaactggttttgtttgtttttttttttaaaaaagtccgggcacaatggctcacgcctgtaatgccagcactttggaaaatcccagcactttggaaggccgaggcaggcggatcacttgaggtcaggagttcgaaaccagcctggccaacatggtgaaaccccgtctctactaaaatatacaaaaattagacaggcgtggtggcaggtgacttaataccag

SEQ ID NO: 139400 - DNA, 601 bp, Human
ctctaaaaaataaagttggtcgggcaaggtggctcacgcctatgatcctagtattttgggaggcagagtcggaaggatttcttcctgagcccaggaattcgagaccagcatgggcaacacagtaagattgtctctagaaaaaatacaaaaattagccgggcatggtggcatgcgcctgtagtcccagctgctcaggaggctgaagtgcgagatcacttgaacccaggaggtcgaggctgcagtgagctgtaatcacaccactgcactccagcctgggcaacagagtgagaccccacctcamaaataaaattaaaaaacccaaaatagtccaggcacagtggctcacgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcagaagaattgcttgaacccaggaggcggaggttgcagtgagccgagatcgtgccattgctctccagcctgggtgacagagcagaact

SEQ ID NO: 139401 - DNA, 601 bp, Human
aactgctctaaaaaataaagttggtcgggcaaggtggctcacgcctatgatcctagtattttgggaggcagagtcggaaggatttcttcctgagcccaggaattcgagaccagcatgggcaacacagtaagattgtctctagaaaaaatacaaaaattagccgggcatggtggcatgcgcctgtagtcccagctgctcaggaggctgaagtgcgagatcacttgaacccaggaggtcgaggctgcagtgagctgtaatcacaccactgcactccagcctgggcaacagagtgagaccccayctcaaaaataaaattaaaaaacccaaaatagtccaggcacagtggctcacgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcagaagaattgcttgaacccaggaggcggaggttgcagtgagccgagatcgtgccattgctctccagcctgggtgacagagca

SEQ ID NO: 139402 - DNA, 601 bp, Human
gggtttaatgggaaatctttgtagctttcactcagttttgccatgaacctaaaactgctctaaaaaataaagttggtcgggcaaggtggctcacgcctatgatcctagtattttgggaggcagagtcggaaggatttcttcctgagcccaggaattcgagaccagcatgggcaacacagtaagattgtctctagaaaaaatacaaaaattagccgggcatggtggcatgcgcctgtagtcccagctgctcaggaggctgaagtgcgagatcacttgaacccaggaggtcgaggctgcagtragctgtaatcacaccactgcactccagcctgggcaacagagtgagaccccacctcaaaaataaaattaaaaaacccaaaatagtccaggcacagtggctcacgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcagaagaattgcttgaacccaggaggcggag

SEQ ID NO: 139403 - DNA, 601 bp, Human
gactgaatcctaacgtaaacaatcttcactttgggtgaggccaggcgcagtggctcacctataatcccagcattatgggaggccaaggtgggtagatcatctgaggtcaggagttcaagaccagcctggctaacatggtgaaacccccgtctctactaaagatacaaaaattagccaggcgtggtagttcatgcctgtagtctcgcctactcaggaagctgaggcaggagaatcgcttgaacccaggaggcggaggttgcagtgatctgagatcgtgccactgtactccagcctgggtgasatagtgagactccgtctcaaaaaaaaaaaaaacactttgggtgataatgatgcattaatgtaggttcaattgtagcaaatgctctggtaggcaatgctgataatgggagactctacgcttgtgtggaggcagtgggtttaatgggaaatctttgtagctttcactcagttttgccatgaacctaaaactgctctaaaaaataaagttggtcgggcaaggtggctcacgcctatgatcctagtattttgggaggcagagtcggaaggatttcttcctgagcccaggaattcgagaccagca

SEQ ID NO: 139404 - DNA, 601 bp, Human
agttagtatgttgatgatacaggcattgagaattcttactaaaattctcagtttgcatttttgtatgaatactctggacttacaaaaagtaaagcaaacttgagtcaaaatgagatcaaagttatccgtacatcgtataactgagacttgtttaagcaaggcacagtgctatttgatggagtggggaagaggacatgaagaatagaagtcacaacacagattcgcccacagcgactcacgtccctattctctagcacgcgccccggttcagcccgggccctcactcccagcctcctgaggygggtcactgagcttgcaggcagaatgtgggtggggctgccccacctctctctcaacctcactgagctgactagtggaccttgaagtcctcccctcggctgaactcagtcaccacatttctctgttcctgcttccaagtcactgactgatggtggggtggaggacactcaaacaggccttacaaattcccgctattcaatctcagcagaccctccctgcaggccgatcgagggtcctcgccacccagatgctctcagcagaccctccctgcagaccgatcaagggtcctcgccacccagat

SEQ ID NO: 139405 - DNA, 601 bp, Human
gaatcaatgcataaattgttctcacatttggttcaactacatcccaaaatgtgtgagcctcagagaaacatttatcagtggaaacctgcagctattaagaaagttgtataaaataatgcagtgtctacaataatttcagacttcccaaaattttatttcttcattgttcagtcagttagtatgttgatgatacaggcattgagaattcttactaaaattctcagtttgcatttttgtatgaatactctggacttacaaaaagtaaagcaaacttgagtcaaaatgagatcaaagttatccrtacatcgtataactgagacttgtttaagcaaggcacagtgctatttgatggagtggggaagaggacatgaagaatagaagtcacaacacagattcgcccacagcgactcacgtccctattctctagcacgcgccccggttcagcccgggccctcactcccagcctcctgaggcgggtcactgagcttgcaggcagaatgtgggtggggctgccccacctctctctcaacctcactgagctgactagtggaccttgaagtcctcccctcggctgaactcagtcaccacatttctctgttcc

SEQ ID NO: 139406 - DNA, 601 bp, Human
ccaaaacaacattcactgtggggagtgggacaagggatgatatgtcttgttattttactccttgaacttggatcatactccttcctgtgggaggccccttttcatttaatctacaaatgttaagaaatgtacagagaaacattgcaattcatagtatttatctggaataccagctgacctatgtattcaggccaaatgctgagtttgaaatgagaatcagtgcaggtcccagaggatttgttttccctctttgctgccccaaaggtacattgtcatggcctacagagcaagaacaagaagkgaagactgtgtcctaagagtccaactcaaacagtgtatcatgcttgagaaaaagataattttttatagatcaaaggcatatgggctgggcacagtggctcatgcctgtaatcccagcaatttgggaggctaagggaggaggatgttttgaacccaggagtttgagaccagcctaggcaacacagcaagacccccgtctctacaaaatgaaataaattagtccatgtggtagcacatgcctgtagtccaggtactcaggaagctgcagtagtgggaggatctgtttggcccaggaggttga

SEQ ID NO: 139407 - DNA, 601 bp, Human
cccttgtctccgtatgagtgagcagtctctgcagctcttcctgatcacccgagagatgcatagcttcaagaccctaccagctgtagcaaaaccaaaacaacattcactgtggggagtgggacaagggatgatatgtcttgttattttactccttgaacttggatcatactccttcctgtgggaggccccttttcatttaatctacaaatgttaagaaatgtacagagaaacattgcaattcatagtatttatctggaataccagctgacctatgtattcaggccaaatgctgagtttgaartgagaatcagtgcaggtcccagaggatttgttttccctctttgctgccccaaaggtacattgtcatggcctacagagcaagaacaagaagtgaagactgtgtcctaagagtccaactcaaacagtgtatcatgcttgagaaaaagataattttttatagatcaaaggcatatgggctgggcacagtggctcatgcctgtaatcccagcaatttgggaggctaagggaggaggatgttttgaacccaggagtttgagaccagcctaggcaacacagcaagacccccgtctctacaaaatga

SEQ ID NO: 139408 - DNA, 601 bp, Human
agagggtaaggggaaagctggggccagaatgtgaggacagagactgcctgggcagattgttcttgccaacatcctaatcctcagctgtgaagctgagagggaaccatggggtggggctggggtgtcaatcaagataaacagaccatgaatgacagcatggcaggactttctcatctttctgaagggaagtcagaatttggaagcagattccatctgcatgctgatcctttccccaacatcacccagtcatttatagcactcctttctctcccccatagccacctggatcaagcccacttaygcagtccatagagccaactccctgttacttgtcaagtttcctccctgggcagaggagggtttcactagccaagtcagctgaatcacggaatgtgttgaatcgttcgagaaagccaagccaatccatacgctacgctctgcacagcgtacagaggaaactgaacctaaaacccttgcagaccagcagagctgtgccacgtgtaaggatgtggtcagggcagcggcacgcaggcccaacctggggctctgagtctccttgctctaagcctgccaggctcttccctgtcttcttgctcagcca

SEQ ID NO: 139409 - DNA, 601 bp, Human
ttggtggagacagggtttcaccatattggacaggctggtcttgaactcctgacctcaggtgatctgcctgcctcggcccccaagtagctgttaaattttcaatacattactaggactaggttttaatatcctgtttatgtgaatttccacaagaactggaaaaatgtcattaaaatggacaggcaatctgtatgagtcaagatacctgctacaactaaacacacacacacacatgcacacattgtttcccatccttaacccattaccccaaacataaccctacaatttcttttggcctcarttataagggaaaatgtattcaggttttgctttttgcttctttgacaatctaaaaatgctatacctaaagttttacaccatatatatatatacccacaatattgttatcatttatattttaaaaataattatatgtgcatctgtttatatattagcagaacatctttgtgatgattcacaagaaattgataataaatacaagataatagatgtgggagggaggcttgcttttcactatatatatatatatatatatatttttttttttttttttttaagagagacaaggtctcactatgtt

SEQ ID NO: 139410 - DNA, 601 bp, Human
tctctacaaaaaaaaagtcaaagaatgagacaggaggattgcttgagcccgggaggtggaggctgcagtgagcagtgattgcaccaatgcactcccacctgggtgacagagtgagaccctgcctaaagaaaaagaaacacttggagacaagatggcatcttccggatccttgcctacagctatgcagggcagccagcagctgtgcattattttgcactctcagccatgaaggaattcaggcaatccttcaggaacctacacagtaaattcttttcttgcagaataaatgcctgcttctgaycttgtttattctgcctcagagcattgcataatctcctggtcctaatgtaccaagaacagagttcagtggcctctaggcatcacttcctaagaatctgcaggtaagaacttgcgctgcttctgcttgctaaattctgcttctcagaatttagaatgaatgcttcctctttacatcattccacataagagcccttctatagcaactcctttgccactgcgcctaaaatagcaacagttttgcactaaccactgcatcaaataaatactttccaatagcaataagatgattttgctgttaaat

SEQ ID NO: 139411 - DNA, 601 bp, Human
cctcacccttttcctttcaactggacaaaaccagcttgctcctgtgcacaagcctaattcctgaacatgaactacaatgaaactaaccaggggggaaagagaccaaatgagaaaagggggaatccattaagaaacgcttgaaggctgggggcagtggctcacgcctgttaatcccagcactttgggaggccgaggcagaaggattgtttgagcccaggagttcgagcctgaccaacatagtgagacctcgtctctacaaaaaaaaagtcaaagaatgagacaggaggattgcttgagcccrggaggtggaggctgcagtgagcagtgattgcaccaatgcactcccacctgggtgacagagtgagaccctgcctaaagaaaaagaaacacttggagacaagatggcatcttccggatccttgcctacagctatgcagggcagccagcagctgtgcattattttgcactctcagccatgaaggaattcaggcaatccttcaggaacctacacagtaaattcttttcttgcagaataaatgcctgcttctgatcttgtttattctgcctcagagcattgcataatctcctggtcctaatgtac

SEQ ID NO: 139412 - DNA, 601 bp, Human
gccatccaaaccttggaaagcaaatgggaaaagggaaaaagaaaactagattttccccccagagcaaagctcacagcagagcacattcctcacccttttcctttcaactggacaaaaccagcttgctcctgtgcacaagcctaattcctgaacatgaactacaatgaaactaaccaggggggaaagagaccaaatgagaaaagggggaatccattaagaaacgcttgaaggctgggggcagtggctcacgcctgttaatcccagcactttgggaggccgaggcagaaggattgtttgagcycaggagttcgagcctgaccaacatagtgagacctcgtctctacaaaaaaaaagtcaaagaatgagacaggaggattgcttgagcccgggaggtggaggctgcagtgagcagtgattgcaccaatgcactcccacctgggtgacagagtgagaccctgcctaaagaaaaagaaacacttggagacaagatggcatcttccggatccttgcctacagctatgcagggcagccagcagctgtgcattattttgcactctcagccatgaaggaattcaggcaatccttcaggaacctacacagt

SEQ ID NO: 139413 - DNA, 601 bp, Human
ctatccagcttgggactaatgagttttcctggattggttctcatgatagcttggtagttatgcccaattttaccttctgttgagaacaaagtgagttaatagaatgagctgtcccctatacaacaagttaatggacattttcgagccattaagagtaggtccctagtcacgcttctttccattcactcatccattgcccaacactacaaaacttcccaacaaaaacttcccagctagaagccaagacagtctgtgacttgatgaacagaggggtaagctgcttcttactgtgataaaatcwaagacctcaggcttccacacccacatataataaaaagaattccccaaacatacagcctagtgagtgtctgaattgtttcaaatgtttgttcactggttgccatttctcagacccactcatgaaatatcactttggccagatctgcaggagaacaaacccagtgtacctagaagcccagagtttgagtaactttggtgtcaagatagcaatagatgcagagaaaaggagagaagacagaaaagtccatgatcagagatctacctgctgaaccaacctgaaactgaacttcacagaatccag

SEQ ID NO: 139414 - DNA, 601 bp, Human
tagagaggtgctcaaatgtgtttagattttgcttgcagacttttggaaggtctctttactatggtttattttccactcctgtgatagtagccctagctgttatgttaattctcactgataggaaaggtggggttaaagttttatgggtctgcagcagaggccacctcctgagaaggagtagataggatctcacccaaaggaaggagaaggctaggatcccaggaagggggtggggcaccaccccagtcctgacaattagctccaggagaccagtcaagaagcgcaattgactacagaaggrgcaggattgaaataaaaagataaaaaataaaaagaagcagctcaattgaatgggagtattgcggaagataaaaatggtagtttattttttcacttgacagaagaagaaacacaagaactaagatggtgcctgccactgtgtttcaagactgtgggtctttataattaattattttgttcttcatttatactaattggccttttaaaaatttcaagtgtttcattcaaatgtgaaaatcatcagagctgctatgggggatggtgatgtctgaagtccctagactctcaagtaaagagagat

SEQ ID NO: 139415 - DNA, 601 bp, Human
atctatgctctcgccccatagagaggtgctcaaatgtgtttagattttgcttgcagacttttggaaggtctctttactatggtttattttccactcctgtgatagtagccctagctgttatgttaattctcactgataggaaaggtggggttaaagttttatgggtctgcagcagaggccacctcctgagaaggagtagataggatctcacccaaaggaaggagaaggctaggatcccaggaagggggtggggcaccaccccagtcctgacaattagctccaggagaccagtcaagaagckcaattgactacagaaggagcaggattgaaataaaaagataaaaaataaaaagaagcagctcaattgaatgggagtattgcggaagataaaaatggtagtttattttttcacttgacagaagaagaaacacaagaactaagatggtgcctgccactgtgtttcaagactgtgggtctttataattaattattttgttcttcatttatactaattggccttttaaaaatttcaagtgtttcattcaaatgtgaaaatcatcagagctgctatgggggatggtgatgtctgaagtccctagac

SEQ ID NO: 139416 - DNA, 601 bp, Human
cacttcaaggactcagattcaggaaagtcatggaggtgatagaagccctggagctcggggctagaagctgagaagaatcctgaactaaatcaaactccagatcgcttccctctgagaacacaaaatgccacccctctgcctgccttcagcaaaaatctatgctctcgccccatagagaggtgctcaaatgtgtttagattttgcttgcagacttttggaaggtctctttactatggtttattttccactcctgtgatagtagccctagctgttatgttaattctcactgataggaaaggtrgggttaaagttttatgggtctgcagcagaggccacctcctgagaaggagtagataggatctcacccaaaggaaggagaaggctaggatcccaggaagggggtggggcaccaccccagtcctgacaattagctccaggagaccagtcaagaagcgcaattgactacagaaggagcaggattgaaataaaaagataaaaaataaaaagaagcagctcaattgaatgggagtattgcggaagataaaaatggtagtttattttttcacttgacagaagaagaaacacaagaactaagatggtg

SEQ ID NO: 139417 - DNA, 601 bp, Human
aggattagagggataggaatttggctattgtgccaagagccacaattacagtccctcactaggtactgtagcaaaaatctagctcccgctgcatatagaggtgctcaaatgtgttgttttgattttgcttgtagacttttggaaggtctctttactatggttttattttccactcctatgatagtagccctagctgttatgttcattcccactgataggaaaggtggggttaacgttttatgggtctgcagcagaggccacctcctgagaaggagtagataggatctcacccaaaggaagrggaagagtaggacccaagttttctgaaaaatgcacttcaaggactcagattcaggaaagtcatggaggtgatagaagccctggagctcggggctagaagctgagaagaatcctgaactaaatcaaactccagatcgcttccctctgagaacacaaaatgccacccctctgcctgccttcagcaaaaatctatgctctcgccccatagagaggtgctcaaatgtgtttagattttgcttgcagacttttggaaggtctctttactatggtttattttccactcctgtgatagtagccctag

SEQ ID NO: 139418 - DNA, 601 bp, Human
tccctcagtgacccggccggaggtcaaaccagcaccgccagttatccagcccaaagatttgcactgattgctctctcactcacacggcctggcatgggaaagggaagcaatatggccttgcagtcacgttgttccacaagcagcacggctgagagaaccaactcaatggctgactttatttggctgcatgcctggagaaaaataatattatagtagttgaaataattagaaatagctaaatggacattgatgggagccaaaagggttactgaaaccaacagtcctcatagtaagtgaaacygctaaggtaattcttccagtgcaggactctccttcctcatacccagccccaggagacacagtaggattagagggataggaatttggctattgtgccaagagccacaattacagtccctcactaggtactgtagcaaaaatctagctcccgctgcatatagaggtgctcaaatgtgttgttttgattttgcttgtagacttttggaaggtctctttactatggttttattttccactcctatgatagtagccctagctgttatgttcattcccactgataggaaaggtggggttaacgttt

SEQ ID NO: 139419 - DNA, 601 bp, Human
agccttcatcaatgcaaacgcattcacagacgctacagagaaactagttctttgattttcctgtccccttattaataaagtggagcatattgaaactaagagttatgtacagggacagcaatactggaatgattgtgctgagagatctggctcctataatgatatgataaaaataattgcatctacgacaaagcacatgcacccaccaggattacatttgcaatgatggaaaagcagacaaagatgcaaagtgtttatcaaattgttaacactcattgattgggagcatgtacttgggtayttcaaaagctcctgttggtacaacttatgatttcccacttagtgaagcctgcattcccttaagtaaagttggtttttacatatgttaatctaaaagccaatctgtgccccttgctaggaatactttgaattgcagaggcaaccacttactctgtcctcatgtcatgatgatcctgctagaaattaaagttacctcttccacaaactaacttttaaaaaatcacctaggaattatcaccatactccatctatgtctgatttgtttccatgctggaaatgaaaagtggacacctatattttc

SEQ ID NO: 139420 - DNA, 601 bp, Human
cccacctactcaggaggctgaggcaggaggattacgtgagccaaggagttccagtttacagtgagctattagagcaccactgtacgctagtccaggtgacagacggagaccttgtcttaaaaaaaaaaaaaaagacctagtatataaccagtattttcttttttattgaaacggagtctaactgtcacccaggctggagtgcagtggtgcaatctccactcactgcagtctcctcttcctgggttcaagtgattctcctgcttcagcctcccaaatatctgagattacaggtgcctatcastaggcctggctaattttttttgtattttttgtagagatagggttttgccatgttggccaggctggtcttgaacacctgacctcaagtgatctgcccacctcggcctcccaaagtgctgggatacaggcgtgagccaccgcacctggcctaatcaggattttcttttctgttgtttgtatacaggcttgtgctatgctacccaggctggagtgcagtggctgttcacctgtgcgatgattgggcactacagcctcaaacttctggactcacatgatcttcctgcctcagcctcccaaggag

SEQ ID NO: 139421 - DNA, 601 bp, Human
tagccaatatctcttgcctctcaatggaaataacatcacctatatgagagatttttcttaatgctcaaatcagactaatgtactgtccaaaggttattcaagtgaataatagcaactgtaaattagcatctgtaagttattttgaattcataagacattcaaaaacttttaaaatccctagctttctgtctatatgtgtctgtgtatgttttaagactcagtatacaggccaggtgtggtggctcacacctgtcagcactttgggaggaaaatctcttggggcaagtagttcaagatcagmctgggcaacacagagaaaccttgtctctactaaaaatttaaaaaaaaaaaaaaaattagcctggcgaggggcctgtaagtcccacctactcaggaggctgaggcaggaggattacgtgagccaaggagttccagtttacagtgagctattagagcaccactgtacgctagtccaggtgacagacggagaccttgtcttaaaaaaaaaaaaaaagacctagtatataaccagtattttcttttttattgaaacggagtctaactgtcacccaggctggagtgcagtggtgcaatctccact

SEQ ID NO: 139422 - DNA, 601 bp, Human
agacagagtcttgctctgtcacacagactggagtgcagtggcctgatcttggctcgctgcaacctccacctcctgggctcaagcaatcctcccacctcaacctcccgagtggctgggactacaggcatgcaccaccacgcccagctaatttttatatttttttgtagggatggagtttcaccatgttggccaggctggtctcaaactcctgggctcaaagacccacccacctcagcctcccaaaatgttgggaatacaggcgtgagccaccacgcccagctgaagccctgggtttcaatcttttttttttttttttgtagggacagggtttcactatgttgtccaggctggtctcaaattcctgggctcaagtgatccttccacctcagcttcacaaattgctgggataacaggagtgagccactgtgccaagccttaatcttattaattttctacagtcatgcatggcttaacagaaatatgctctgagaaatacatcgttaggtgatttagtcattgttgtgtgaacctcatagagtgtacttacgtgtacttagaaggtatagcctactacacacctaggctacgtgatatagcctat

SEQ ID NO: 139423 - DNA, 601 bp, Human
accacacccagctaaattttgtatttttagttgagatagggtttcaccatgttggccaggctggtctcgaactcctgacctcaggtgatctgcccaccctggcctcccaaagtgctgggattacaggcgtgagtcatgtgtaattatcacgcccaccctgataattagttctaaggctcccagagcatagtaccatgttcctctccagaaagagcatatctgtctgcattctcttaaacactacagtgattcacagatatccttgcatcttcaaaactactaagtattaagaagcactggsttttggtttttgttttgttttttgagacagagtcttgctctgtcacacagactggagtgcagtggcctgatcttggctcgctgcaacctccacctcctgggctcaagcaatcctcccacctcaacctcccgagtggctgggactacaggcatgcaccaccacgcccagctaatttttatatttttttgtagggatggagtttcaccatgttggccaggctggtctcaaactcctgggctcaaagacccacccacctcagcctcccaaaatgttgggaatacaggcgtgagccaccacgcc

SEQ ID NO: 139424 - DNA, 601 bp, Human
cattattccatgaacaatgtctaacataacatctttaaatactattcaaaaaacatgattttaactgctctatggtattaaataacttatgaaataaattatttaagttataatttcttcatgtaaatcttgatttatttaacgagttccttccagttgaatacttttgatttcaaatattagaaatagcataatagttaagatctttatctttgtctaaggatacattcttagaagtagaattccaaattatatatgataactagttttttggggtttttatttttttttagatagagtyttgctctgtcacccaggctggagtgcagtggcacgatctcggcccagtgcaacctccacctcttgggttcaagccattctcctgcctcagcctcctgagtagctgggattacaggtgcgtgacaccacacccagctaaattttgtatttttagttgagatagggtttcaccatgttggccaggctggtctcgaactcctgacctcaggtgatctgcccaccctggcctcccaaagtgctgggattacaggcgtgagtcatgtgtaattatcacgcccaccctgataattagttctaaggc

SEQ ID NO: 139425 - DNA, 601 bp, Human
agtagatggaggctgggcatggtggctcacacctgtaacccttgcactctgggaggctgaggtgggcaatcactcgagccctggaattcgagactagcctgggcaacatatgagacctcacctctacaaaaaaatcaggccaggcgcagtggctcatgcctgtaagtaatcccagcacgttgggaggctgaggaggcggatcacgaggtcaggagttcgagacgagcctggccaatatggtgaaaccccgtctctactaagaatacaaaaattagctgggtgtggtggcacgtgcttgtartcccagctacttgggaggctgaggcagaagaatcgcttgaaaccagaaggcggaggttgcagtgagccaagatcatgccactgcactccagcctgggtgacagagcgagactccatctcaaaaaacaaaaaataaccatgaggctggaggatagtttgaggctgcaatgagccatgatcacgcctctgcactcccgcctgggtgacgggagtgagactctgtctcaaaaaataaatacataaaatacaaaacgttctcgtttttataagtttgtaaaaacaagtagatgaaccaaaatgt

SEQ ID NO: 139426 - DNA, 601 bp, Human
caccaacaccccaatacaagtctcaggaaattatttcaaagtctcgatattgtactgcttggaaaggcaacctccccaccacactccctgtcaaagataagaagatgttggtttcaaagctttcaaaaaagaaagaaagaaaagtaatgaaagaaaagtagatggaggctgggcatggtggctcacacctgtaacccttgcactctgggaggctgaggtgggcaatcactcgagccctggaattcgagactagcctgggcaacatatgagacctcacctctacaaaaaaatcaggccaggygcagtggctcatgcctgtaagtaatcccagcacgttgggaggctgaggaggcggatcacgaggtcaggagttcgagacgagcctggccaatatggtgaaaccccgtctctactaagaatacaaaaattagctgggtgtggtggcacgtgcttgtagtcccagctacttgggaggctgaggcagaagaatcgcttgaaaccagaaggcggaggttgcagtgagccaagatcatgccactgcactccagcctgggtgacagagcgagactccatctcaaaaaacaaaaaataaccatgaggc

SEQ ID NO: 139427 - DNA, 601 bp, Human
acacacacactctttctctctctctctctctcacacacacacacacacatacacatagccgcacaccaacaccccaatacaagtctcaggaaattatttcaaagtctcgatattgtactgcttggaaaggcaacctccccaccacactccctgtcaaagataagaagatgttggtttcaaagctttcaaaaaagaaagaaagaaaagtaatgaaagaaaagtagatggaggctgggcatggtggctcacacctgtaacccttgcactctgggaggctgaggtgggcaatcactcgagcccwggaattcgagactagcctgggcaacatatgagacctcacctctacaaaaaaatcaggccaggcgcagtggctcatgcctgtaagtaatcccagcacgttgggaggctgaggaggcggatcacgaggtcaggagttcgagacgagcctggccaatatggtgaaaccccgtctctactaagaatacaaaaattagctgggtgtggtggcacgtgcttgtagtcccagctacttgggaggctgaggcagaagaatcgcttgaaaccagaaggcggaggttgcagtgagccaagatcatgccac

SEQ ID NO: 139428 - DNA, 601 bp, Human
tttacttgggaggtcaaggcgggcggatcacgaggtcaggagatcgagaccatcctggctaacatggtgaaacccgtctctactaaaaatacaaacaattagccaggcgtggtggcacgtgcctgtagtcccagctactcaggaggctgaggcaggagaatcgcttgaacccgcggggcggaggttgcagtgagctgagatcacgccactgtactccagcctgggcaacagagcaagactccgtctcaaaaaaaaaaaaaaaattagtacatcatgaacatctcccacatcagcaaatatkttttacagcatcattttcaatgaatgcatagtattatattcacactgtctaattatcatttcctttttagcagacactgcttgttttttctgttgttttctgtgctgtgatgaattctttggaacattattctctgtcttcctgtcgtatatcttgtgcctgtctttatggatatactaagtctttcctatttatcagatggactagattgtatgtgtgtattcctgcatgtgtatgtgtttctacatgacaaataatgattccaagtaaaatgaaagttttttattacccaagcaatct

SEQ ID NO: 139429 - DNA, 601 bp, Human
gagtccatggcagttaactctatggctattgaaattccaggatggaaatgtttagaaggcaacgtaaacatggattctaactttatctccttcaattattagccaagaatgtggctttggatatgtcagttagccaatttagttccttcatccttacaggcgagagctaccacacctcacctattttacttgggaggtcaaggcgggcggatcacgaggtcaggagatcgagaccatcctggctaacatggtgaaacccgtctctactaaaaatacaaacaattagccaggcgtggtggcrcgtgcctgtagtcccagctactcaggaggctgaggcaggagaatcgcttgaacccgcggggcggaggttgcagtgagctgagatcacgccactgtactccagcctgggcaacagagcaagactccgtctcaaaaaaaaaaaaaaaattagtacatcatgaacatctcccacatcagcaaatatgttttacagcatcattttcaatgaatgcatagtattatattcacactgtctaattatcatttcctttttagcagacactgcttgttttttctgttgttttctgtgctgtgatgaatt

SEQ ID NO: 139430 - DNA, 601 bp, Human
tttgttttatgttaaccaggagaagttctacatgctaagaaattaatagaggtctacttaagaattctcattatccagttactaagagtccatggcagttaactctatggctattgaaattccaggatggaaatgtttagaaggcaacgtaaacatggattctaactttatctccttcaattattagccaagaatgtggctttggatatgtcagttagccaatttagttccttcatccttacaggcgagagctaccacacctcacctattttacttgggaggtcaaggcgggcggatcacraggtcaggagatcgagaccatcctggctaacatggtgaaacccgtctctactaaaaatacaaacaattagccaggcgtggtggcacgtgcctgtagtcccagctactcaggaggctgaggcaggagaatcgcttgaacccgcggggcggaggttgcagtgagctgagatcacgccactgtactccagcctgggcaacagagcaagactccgtctcaaaaaaaaaaaaaaaattagtacatcatgaacatctcccacatcagcaaatatgttttacagcatcattttcaatgaatgcatag

SEQ ID NO: 139431 - DNA, 601 bp, Human
ttatttggatatttgttttatgttaaccaggagaagttctacatgctaagaaattaatagaggtctacttaagaattctcattatccagttactaagagtccatggcagttaactctatggctattgaaattccaggatggaaatgtttagaaggcaacgtaaacatggattctaactttatctccttcaattattagccaagaatgtggctttggatatgtcagttagccaatttagttccttcatccttacaggcgagagctaccacacctcacctattttacttgggaggtcaaggcrggcggatcacgaggtcaggagatcgagaccatcctggctaacatggtgaaacccgtctctactaaaaatacaaacaattagccaggcgtggtggcacgtgcctgtagtcccagctactcaggaggctgaggcaggagaatcgcttgaacccgcggggcggaggttgcagtgagctgagatcacgccactgtactccagcctgggcaacagagcaagactccgtctcaaaaaaaaaaaaaaaattagtacatcatgaacatctcccacatcagcaaatatgttttacagcatcattttcaa

SEQ ID NO: 139432 - DNA, 601 bp, Human
caagagatcctctggcctaagtctccaaagtggctgggacaacaagcacatgccatcacgctcagctaatttttgtattctttgtacagccagggttttgtcatgttacccaagctggtcttgaactcctgagctcaagcaatccacctgcctcggcctgccaacatgctggcattataggcatgagccactgcacttgaggctacctataatatcataaacagaaatttcatttgctattatctttcccctagataaaagacctcattcacattttacaataggaaagcatccaagaatstaacatgtaatactcaaacattttatttatttatttggatatttgttttatgttaaccaggagaagttctacatgctaagaaattaatagaggtctacttaagaattctcattatccagttactaagagtccatggcagttaactctatggctattgaaattccaggatggaaatgtttagaaggcaacgtaaacatggattctaactttatctccttcaattattagccaagaatgtggctttggatatgtcagttagccaatttagttccttcatccttacaggcgagagctaccaca

SEQ ID NO: 139433 - DNA, 601 bp, Human
atatccaacctctaggtttttgaacctgttgagtttttcagtttctctgaaaagtcatactctagaaagctgactaaagtaatattcacaatatactatagaaagaaaacaaggccaggcgaggtggcccacaactggaattccagcactttgagaggcctctcacctgtagcacagctgcagtgcctctgcggctgcagtcccctcatccagcagggatgcattggccatgtccaggcctgtgatgtcacacaccatggtctggtagttgagtaaactctccagcctcccctgagacacytcaggctggtatggagtatactgggtgatcctgcaagggaaacaaaaggtcttgtccaaactgactgctgtttagagaagcacacaaaatgctatcatttcagaattcagtacctgaaaataatttgcctatcttgaggagaattacataacacaccagtaagcttctttttggcctttgtaaagcttagaattaaatcatagtaacaatattaccctttgtttggggataagcagtacttatttttctatctctctggtgttgtttttttgttttttgtttgttggtttttgagacagg

SEQ ID NO: 139434 - DNA, 601 bp, Human
aactatatgtgtaatagacgagagattaaataaattatggcacttccatgtaagtgccatggagataatagaagtcctactctatgggcctgagaatccacccttgaccatagtgccaggacctttgtcactaccctcttacaaccccaccaaacagagaccctcatgcctttacactcagctatgctgccaaggtttggaacaacggagaggctcccgggcactcagtcatgtgtgtgtgttatgggggagatcctcacgtctgacccacacctgcccttgaaacaccctcacccccacycccagccacatctatccaaagtccactcctaattgagcttccccctcccctgctcccgccctctgccctcccaaagctaggtgccgagtcagctgtttaaggtcacatttccaccctagcctcactgccctgccttgagagacctcaccctgtcccctgaacaaccctgctggcccaccctcgcagcccccaggcctgcgcttggctgcttccccaagccagcacttcccagtgggggacctggcaccggctccctgtccttcctcccaaaaatagtcccctcaccaaatatgcagatgt

SEQ ID NO: 139435 - DNA, 601 bp, Human
ttataaggatgcacatgaagtactattaataacagtaagagacggaaataaactatatgtgtaatagacgagagattaaataaattatggcacttccatgtaagtgccatggagataatagaagtcctactctatgggcctgagaatccacccttgaccatagtgccaggacctttgtcactaccctcttacaaccccaccaaacagagaccctcatgcctttacactcagctatgctgccaaggtttggaacaacggagaggctcccgggcactcagtcatgtgtgtgtgttatgggggrgatcctcacgtctgacccacacctgcccttgaaacaccctcacccccacccccagccacatctatccaaagtccactcctaattgagcttccccctcccctgctcccgccctctgccctcccaaagctaggtgccgagtcagctgtttaaggtcacatttccaccctagcctcactgccctgccttgagagacctcaccctgtcccctgaacaaccctgctggcccaccctcgcagcccccaggcctgcgcttggctgcttccccaagccagcacttcccagtgggggacctggcaccgg

SEQ ID NO: 139436 - DNA, 601 bp, Human
attccaccaggaaggtacactcctaagtactggcaaggcaaataagggaagcagaagaaatggagaaccatcctgattcagtaagtccacttccagaaatggctcttcaggaaataatcagaagttttgacaaagatttattataaggatgcacatgaagtactattaataacagtaagagacggaaataaactatatgtgtaatagacgagagattaaataaattatggcacttccatgtaagtgccatggagataatagaagtcctactctatgggcctgagaatccacccttgaccayagtgccaggacctttgtcactaccctcttacaaccccaccaaacagagaccctcatgcctttacactcagctatgctgccaaggtttggaacaacggagaggctcccgggcactcagtcatgtgtgtgtgttatgggggagatcctcacgtctgacccacacctgcccttgaaacaccctcacccccacccccagccacatctatccaaagtccactcctaattgagcttccccctcccctgctcccgccctctgccctcccaaagctaggtgccgagtcagctgtttaaggtcacattt

SEQ ID NO: 139437 - DNA, 601 bp, Human
ggtggcgggcacctgtagtcccagctacgtgggaggctgaggcaggagaatgacgtgaacccaggaggcggagcttgcagtgagccgagatagcgccagtgcactccagcctgagtgacagagtgagactctgtctcaaaaaaaacaaaataattaaaacaaataaattaactcggccgggctcagtggctcacgcctataatcccagcaatttgggaggccgaggcgggcggatcatgaggtcaggagatcgagaccctcctggctaacagggtgaaaccccatctctactaaaaatacaaaaaaaaaaaattagccgggcgtggtggcaggcacctgtagtcccagctacttggaaggctgaggcaggagaatggcgtgaacccgggaggcggagcttgcagtgagcagagatcacgccactgtactccagcccgggcgaaagagcgagactccgtctcaaataaataaataaattaataaataataaataaataaatgaaataagataaaaagcaattttttaaaaaaagagggaagatgaaaattagcaaaaagctgagaataataaccagagaggtgggtggatggcactcttttg

SEQ ID NO: 139438 - DNA, 601 bp, Human
accatgaggaaaaagaaaataaagcaaaggacagtgattagatacaagtgtaaactggacaggtgcggtggctcacacctgtaatcccagcactacgggaggccgaggtgcgtggatcacctgaggtcaggagttcaagaccagcctgaccaacttagcaaaaccccagctctactaaaactacaaaacgtagccaggcatggtggtgcacacctgtaatcccactactcgggaggatgaggcaggagaattgcttgaacccgggaggcagaggttgcagtgagccaagatcgcctcactkcactccagcctaggccacagagcgagactctgtcttaaataaataaatacatacatacataaattaataaataaaatagtttatttatttatttttattttatttttggtggggggagaacagggtctcggtctatcgctcaggctggagtgcagtagcgccatcacagctcactgcaacctcgacctccaaggttcaagtgctccttccacctcagcaccccgcccctacatagttgggactacgggcatgtgccaccatgcccagccaatttttgtattaaaaaaataaaattggccg

SEQ ID NO: 139439 - DNA, 601 bp, Human
cccatttagaaagtcagtcttaagatggttcaatttctatgtttactcaataacaatttttaaaaaatggttcaaaatgtttcaaatataccatgaggaaaaagaaaataaagcaaaggacagtgattagatacaagtgtaaactggacaggtgcggtggctcacacctgtaatcccagcactacgggaggccgaggtgcgtggatcacctgaggtcaggagttcaagaccagcctgaccaacttagcaaaaccccagctctactaaaactacaaaacgtagccaggcatggtggtgcacrcctgtaatcccactactcgggaggatgaggcaggagaattgcttgaacccgggaggcagaggttgcagtgagccaagatcgcctcactgcactccagcctaggccacagagcgagactctgtcttaaataaataaatacatacatacataaattaataaataaaatagtttatttatttatttttattttatttttggtggggggagaacagggtctcggtctatcgctcaggctggagtgcagtagcgccatcacagctcactgcaacctcgacctccaaggttcaagtgctccttcca

SEQ ID NO: 139440 - DNA, 601 bp, Human
agtaactaatggcatttactgattagcattcctcatagatccaattcccattctaaccccatttagaaagtcagtcttaagatggttcaatttctatgtttactcaataacaatttttaaaaaatggttcaaaatgtttcaaatataccatgaggaaaaagaaaataaagcaaaggacagtgattagatacaagtgtaaactggacaggtgcggtggctcacacctgtaatcccagcactacgggaggccgaggtgcgtggatcacctgaggtcaggagttcaagaccagcctgaccaacwtagcaaaaccccagctctactaaaactacaaaacgtagccaggcatggtggtgcacacctgtaatcccactactcgggaggatgaggcaggagaattgcttgaacccgggaggcagaggttgcagtgagccaagatcgcctcactgcactccagcctaggccacagagcgagactctgtcttaaataaataaatacatacatacataaattaataaataaaatagtttatttatttatttttattttatttttggtggggggagaacagggtctcggtctatcgctcaggctggagtgca

SEQ ID NO: 139441 - DNA, 601 bp, Human
aggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtggcaacggggatcaacgagaaatttcctcctcttgttgtgtctgttgaaaagaaaaagcacattccaacgtgaacattaaataaataggactatcttctaagaacgcaaagcaaacayagtaccgagggtaagtctaagcacagtataaaaaatactgagtaggccgggtgcggtggctcacgcctgtaatcccagcactttgggaggccgaggcgggcagattacctgaggtcaggagttcgagaccagcctggccaacgtgataaaacctcgtctctactaaaaatacaaaattagccggtgcatgcctgtaatcccggctacttgggaggctgaggccagagaatcacttgaaccagggaggccgaggttgcagtgagccaagattgcaccgctgctgcactccatcctgcgtaa

SEQ ID NO: 139442 - DNA, 601 bp, Human
aaaacacaacttactataaagcaatggcaattgtgtatttcccaactcaattctgacacagtttacttaccagagagatgcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtggcaacggggatcaacragaaatttcctcctcttgttgtgtctgttgaaaagaaaaagcacattccaacgtgaacattaaataaataggactatcttctaagaacgcaaagcaaacatagtaccgagggtaagtctaagcacagtataaaaaatactgagtaggccgggtgcggtggctcacgcctgtaatcccagcactttgggaggccgaggcgggcagattacctgaggtcaggagttcgagaccagcctggccaacgtgataaaacctcgtctctactaaaaatacaaaattagccggtgcatgcctgtaatc

SEQ ID NO: 139443 - DNA, 601 bp, Human
gaaaacaaaacacaacttactataaagcaatggcaattgtgtatttcccaactcaattctgacacagtttacttaccagagagatgcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtggcaacggggrtcaacgagaaatttcctcctcttgttgtgtctgttgaaaagaaaaagcacattccaacgtgaacattaaataaataggactatcttctaagaacgcaaagcaaacatagtaccgagggtaagtctaagcacagtataaaaaatactgagtaggccgggtgcggtggctcacgcctgtaatcccagcactttgggaggccgaggcgggcagattacctgaggtcaggagttcgagaccagcctggccaacgtgataaaacctcgtctctactaaaaatacaaaattagccggtgcatgcct

SEQ ID NO: 139444 - DNA, 601 bp, Human
aaagaagaagaagaaaacaaaacacaacttactataaagcaatggcaattgtgtatttcccaactcaattctgacacagtttacttaccagagagatgcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtggrtggcaacggggatcaacgagaaatttcctcctcttgttgtgtctgttgaaaagaaaaagcacattccaacgtgaacattaaataaataggactatcttctaagaacgcaaagcaaacatagtaccgagggtaagtctaagcacagtataaaaaatactgagtaggccgggtgcggtggctcacgcctgtaatcccagcactttgggaggccgaggcgggcagattacctgaggtcaggagttcgagaccagcctggccaacgtgataaaacctcgtctctactaaaaatacaaaattagc

SEQ ID NO: 139445 - DNA, 601 bp, Human
tcacgaggtcaggagatcaagaccatcctggctaacacggtgaaactccgtctctactaaaaatagaaaaaaaattagccaggcgtggtggcgggcacctgtagtcccagcaactcgggaggctgaggcaagacaatggcgtgaacttgggaggcggagcttgcagtgagcctaggttccctcaactgcactccagcctggacgacagagcgagactccgtctcaaaaaaaaaaaaaaaaaagaagaagaagaaaacaaaacacaacttactataaagcaatggcaattgtgtatttcccmactcaattctgacacagtttacttaccagagagatgcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtggcaacggggatcaacgagaaatttcctcctcttgttgtgtctgttgaaaagaaaaagca

SEQ ID NO: 139446 - DNA, 601 bp, Human
ccgggcgcagtggctcaagcctgtaatcccaggactttgggaggcggaggtgggcgggtcacgaggtcaggagatcaagaccatcctggctaacacggtgaaactccgtctctactaaaaatagaaaaaaaattagccaggcgtggtggcgggcacctgtagtcccagcaactcgggaggctgaggcaagacaatggcgtgaacttgggaggcggagcttgcagtgagcctaggttccctcaactgcactccagcctggacgacagagcgagactccgtctcaaaaaaaaaaaaaaaaaagaagaagaagaaaacaaaacacaacttactataaagcaatggcaattgtgtatttcccaactcaattctgacacagtttacttaccagagagatgcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtgg

SEQ ID NO: 139447 - DNA, 601 bp, Human
aggcattcagtagtcaggtcagacgtgtgatttacctgagctgtacagatgttgctggtagccttgtctctccgaatgtgttgctccctggtttgaagagcaagacgatacacttctttcccagtggcatctctacaccaagaataaggcatccagttagcacagataatcacagcactgggagatgctataaatagaattacttctttccttcccagcttgaagtgaattcagcaaatgcacttgggtgcaaatttataaagaaacaatttctaaacgttcctcatctaaacatgattaytgatttttttttttttttttgagacggagtttcgctctttcgcccaggctggagtgcaatggcgtgatctcggctcactgcaacctctgccttctggtttcaaacgattctactgcatcagcctcctgacaccacgcccagctaatttttgtatttttagtagagatggggtttcaccatgttggccaggctggtcttgaactcctggcctcaggtgatccgcctgccttggcctcccaaagtgctgggattacaggcatgagccactgtgcccagcaggattactgatttttagactgt

SEQ ID NO: 139448 - DNA, 601 bp, Human
ccctggtcagaacccaggaagctcttcctgttttatcccatccttttaaagaatgccagacatggccaggtgcagtggctcatgcttgtaatcccaacactttgggaggccgaggtgggtggatcatgaggtcaggagttcaagaccaacctggccaagatggtgaaaccccgtctctactaaaaatgcaaaaactagcctggcgctgtggcaggcgcctgtaatcccagttactcaggaggctgaggcaggagaattgcttgaaaccgggcagcagaggttgcagtgagctgagattgcrccactgcactccagcctgggcgacagagtaaaactctgtctcgaaaaaacaaaaaaaagaatgccagtcataatctcccagtaagagtgcctcatgactaccaccatcccctcaagcacagtcatcacaaatgcccttgctttgccttcctcaacccattcctggagaggctccttctcagtcctaagagagggtgtctcaactgccacccataacaaacctggcccaacgccaagaatactagagaccctgatatccatctttctatttacatatattttaagtctgtatataaaagtg

SEQ ID NO: 139449 - DNA, 601 bp, Human
gctctttaggaggctgaggcacaagaatcacttgaacccaggaggcagaggttgcagtgagccaagattgcgccaccccattccaacctgggtgacgcaggaacaggactctatctcaaagaagaaaaaaaaagaagaagaaaaaaaaaaagagatgcacttagaatggatcctgtgctcaggagtgggcctccaactgatcctagggtttggctgggtttcacaaacacttcgacctaagccctggagcaacttcaaggagcagaacccagaaccctggtcagaacccaggaagctcttsctgttttatcccatccttttaaagaatgccagacatggccaggtgcagtggctcatgcttgtaatcccaacactttgggaggccgaggtgggtggatcatgaggtcaggagttcaagaccaacctggccaagatggtgaaaccccgtctctactaaaaatgcaaaaactagcctggcgctgtggcaggcgcctgtaatcccagttactcaggaggctgaggcaggagaattgcttgaaaccgggcagcagaggttgcagtgagctgagattgcgccactgcactccagcctgggcgacag

SEQ ID NO: 139450 - DNA, 403 bp, Human
ccatataaagatcaccatgtggccaggcatggcggcttatgcctgtaatcccagcactttgggaggccgaggtgggcagatcatgagatcaggagttcgagaccagcctgaccaacatggtgaaaccctgtctctactaaaaatagaaaaattagttgggcatggtggcaggcgcctgtaatcccagctactcaggaggctgaggcaagagaatcgctggaaactggaaggcagaggttgcagtgagctgagattgggccgctgcacgccagcctgggtgacagagcaagactccatctcaaaaaaaaaaaaaaacaaccaaaaaaacaaataaataaataaagatcagcttgctgttcaacagaggaaaagcctgtgccaaccacctttccttcctatcata

SEQ ID NO: 139451 - DNA, 437 bp, Human
acaaatggagggtaagctacagaaagtgaggccaccatataaagatcaccatgtggccaggcatggcggcttatgcctgtaatcccagcactttgggaggccgaggtgggcagatcatgagatcaggagttcgagaccagcctgaccaacatggtgaaaccctgtctctactaaaaatagaaaaattagttgggcatggtggcaggcgcctgtaatcccagctactcaggaggctgaggcaagagaatcgctggaaactggaaggcagaggttgcagtgagctgagattgggccgctgcaygccagcctgggtgacagagcaagactccatctcaaaaaaaaaaaaaaacaaccaaaaaaacaaataaataaataaagatcagcttgctgttcaacagaggaaaagcctgtgccaaccacctttccttcctatcata

SEQ ID NO: 139452 - DNA, 601 bp, Human
tcctaaagtgttgagattacaggtgtgagccaccgcaccctgttttttcagttttgttttagaatggggcctgctgagccagaataggctcagagagactccctatagaaaaatttatttaaaaaagaatcattaacacactttcagagattaaaaaagagtcatgccccatccacgatgcgaaactaagagtggactcccccacccaccccagtgacaagagagaagagcaagagtgagaagaatgtggaacagctgctacaacagaaggcgggggtcaaagacctacagcacaaaaggracaactcaaaagacaccagtcatctcctaacaaaacagggagacttgcatgctcacaaagagtgaaactggagttatgagtaattcttgtatgcaatcaactatgaaaaggcacatatgcagtgaaatagacagtgaagagttagaagatcatcagaataagaggatgaaaatcagacaagctggagtatggccatctccagggcaaacattttaacaattgctggaaaagatacagacctttcaacccaagttaaataataaattatcagctatacatgaactggaagaaattaagcaa

SEQ ID NO: 139453 - DNA, 601 bp, Human
caactgtagtcccagtgactccagaagccgagatggatcacttgaacccaggatttcgaggttacagtgacctatgattgcgccactggactccagcccggttgacaatacaaaaccctgtctctgcaaaatacagttgatgttcaatactgggtccattttgttaggtacatctttttttctgctagactactagaggaagtctctatggagccaatgcaaaataagaaacagtttccaaaggtgaagtcagcaaacaaggaagtaaatgaggagaaagagacatcagaaaacatggaartaggcattcttgtactaaaagtcctagacaaagtgtaaacactcttatggactccttacaacaatcagaaataaacacagaaactccacagcactttacagctgtggaaaaggcgaggctgaggtaaagaatctgtgacacactgtgcccaaatgctcatggctgtgttgctggaaacagaaacccaggcctgacattcacagaatgccctggcagcctccaccacaatattgtagaggttggttcatgtccctttttaatctacagatgattccttccataatcaggaggctatatcac

SEQ ID NO: 139454 - DNA, 601 bp, Human
gagcaagactccattaagcaaggaagcaagcaagcaagcaagcaagcaaacaagaaagcaagaaagcaagcaagcaagaaagcaagcaagcaagaaaaaaagaaagaaagcaagaaaaaggaaataaaagaaagaaagaaagaaagaaagaaagaaaaagaaagagaaagaaagaaagcaaaacaacaaaataatcatggatgttgaaagtatttttcctcgtttctcacttgacttttaattttgcatatagtattggacatgcaatattttcaattttactcaaatttatcaattttaytatgcccaaatgttttagacagattaccaactcaccttctgacaaaatcaaagtggcattatgtaccctcctagcaatatgctccagcccatgggaaccatggtagattgcaaacatggcagccatattcgccaagagggcctaaaagataagaacatttaaagaatcacgtgatggaggacaattagtgggagggtgtaattacttgacttgggatgtcaaaactgaagacagcgacaaaacaaaatgatcagatttcctacattctttgatagttggggacaattaatatataacctg

SEQ ID NO: 139455 - DNA, 601 bp, Human
atggaagaaaatatatgtaagtcatatatctgataaggatttaatatccagaatatataatcaatacatggcttgatcctcattccttgccaggctaataatatgactaatacagatttaatacttgtcccctccagatctcagggtgaaatgtgatccccagtgttgaagatgggcttggcgctgtcttcacagtaatgagtgagttctcactctactagttcccatgagaactgatgagaagtgattgttaaaaagagcctggcacctccctcctctctctctcttcctttttcttttrccatgtgatgcctgctcctcttccccttccttcatgagaggaagtttcctgaaaccctcaccagaagcaaacgcttcttgcacagcacagcctgcagaaacatgagccaaataaagctattttatttataaattatttagcctcaggtactccaatgcaaatgaactaaaataatggccctcttgaccccttagtgatgctccagaaacatttctcaaatgcatgaaccaaatatctgtgattaaatttagtgcagagttctacagagaaggagctaactcagtcctgtttaattgaggt

SEQ ID NO: 139456 - DNA, 601 bp, Human
tgaggtgggaggactgcttgaggccaggagtctgagatcagactggcaaacacagcaagaccttgactctattttttaaaaaaatagagagggaaatattcttatcatgatataaaatgatttctttcgtctgatatgatatgtcacttcagaataaacgtaagaaatgaaagaaagaaaaaaaaagcttcgctaaaatggatcctggcctagtagagatacttgccaaccacaacagcgagttgcacaaatcttctgttgacttgaatccctatctttctgatacaggaatgatttctaraaagacggcttaaggttcgtaattctacctgagatttagaactataaacaattttttttaaaaaagcttttaatatgacaggtttaaaagggggtgggggtgggggagggataggatagaaaggcataaataccatatacatttaattaattttattaaaaaataataagtttacccatacatttaaatgatgaagtcgtgagaaatacagggttactcccaagattggtgaatagcaaggtaaagaattattaaaatagttcttcaatcacagaatcacagtcccagtagatttcacta

SEQ ID NO: 139457 - DNA, 601 bp, Human
gcaatagattgttctctttcttcactaagtggaacaagaaacaaacacaaaagtaaatgggaaggccaggtacagtggttcacacctataattccagaactctgggaggctgaggtgggaggactgcttgaggccaggagtctgagatcagactggcaaacacagcaagaccttgactctattttttaaaaaaatagagagggaaatattcttatcatgatataaaatgatttctttcgtctgatatgatatgtcacttcagaataaacgtaagaaatgaaagaaagaaaaaaaaagcttygctaaaatggatcctggcctagtagagatacttgccaaccacaacagcgagttgcacaaatcttctgttgacttgaatccctatctttctgatacaggaatgatttctagaaagacggcttaaggttcgtaattctacctgagatttagaactataaacaattttttttaaaaaagcttttaatatgacaggtttaaaagggggtgggggtgggggagggataggatagaaaggcataaataccatatacatttaattaattttattaaaaaataataagtttacccatacatttaaatg

SEQ ID NO: 139458 - DNA, 601 bp, Human
acaatgagttgcttcaggtatggttggcataaactcttatatagcaatagattgttctctttcttcactaagtggaacaagaaacaaacacaaaagtaaatgggaaggccaggtacagtggttcacacctataattccagaactctgggaggctgaggtgggaggactgcttgaggccaggagtctgagatcagactggcaaacacagcaagaccttgactctattttttaaaaaaatagagagggaaatattcttatcatgatataaaatgatttctttcgtctgatatgatatgtcacktcagaataaacgtaagaaatgaaagaaagaaaaaaaaagcttcgctaaaatggatcctggcctagtagagatacttgccaaccacaacagcgagttgcacaaatcttctgttgacttgaatccctatctttctgatacaggaatgatttctagaaagacggcttaaggttcgtaattctacctgagatttagaactataaacaattttttttaaaaaagcttttaatatgacaggtttaaaagggggtgggggtgggggagggataggatagaaaggcataaataccatatacatttaat

SEQ ID NO: 139459 - DNA, 601 bp, Human
cagatttctttccatgaaacacaatgagttgcttcaggtatggttggcataaactcttatatagcaatagattgttctctttcttcactaagtggaacaagaaacaaacacaaaagtaaatgggaaggccaggtacagtggttcacacctataattccagaactctgggaggctgaggtgggaggactgcttgaggccaggagtctgagatcagactggcaaacacagcaagaccttgactctattttttaaaaaaatagagagggaaatattcttatcatgatataaaatgatttctttygtctgatatgatatgtcacttcagaataaacgtaagaaatgaaagaaagaaaaaaaaagcttcgctaaaatggatcctggcctagtagagatacttgccaaccacaacagcgagttgcacaaatcttctgttgacttgaatccctatctttctgatacaggaatgatttctagaaagacggcttaaggttcgtaattctacctgagatttagaactataaacaattttttttaaaaaagcttttaatatgacaggtttaaaagggggtgggggtgggggagggataggatagaaaggcat

SEQ ID NO: 139460 - DNA, 601 bp, Human
gggacatagttgtccaaaaagggaacttacacaaaaatacaatgttttgctaacttttcagggaagaaaagcccccaaaacagatttctttccatgaaacacaatgagttgcttcaggtatggttggcataaactcttatatagcaatagattgttctctttcttcactaagtggaacaagaaacaaacacaaaagtaaatgggaaggccaggtacagtggttcacacctataattccagaactctgggaggctgaggtgggaggactgcttgaggccaggagtctgagatcagactggcraacacagcaagaccttgactctattttttaaaaaaatagagagggaaatattcttatcatgatataaaatgatttctttcgtctgatatgatatgtcacttcagaataaacgtaagaaatgaaagaaagaaaaaaaaagcttcgctaaaatggatcctggcctagtagagatacttgccaaccacaacagcgagttgcacaaatcttctgttgacttgaatccctatctttctgatacaggaatgatttctagaaagacggcttaaggttcgtaattctacctgagatttagaactataa

SEQ ID NO: 139461 - DNA, 601 bp, Human
aatctggaagggatgcagtgtaacttaggaggttcggccattagagatttgcagcttctccatgcttcatctgggaacacgcattctgaaccccgacattgtgctgtaaggaacaaggaagctcaaggaactacaaggaaagccccatatggagaaaaactatggccctagtgaacatcctcaaatgcactcccagcccacagctcctcaccagctatgtgagggagaacacgatgcaccttctagccatgctctccccagtggagtggaactgtctagcaagtcacagaataacacaaawaagttgttgttctaagcctttaagttttgtggtgtatgctatacaagaatagattgctgaaacaataagaaaagaaatgcccttacctgtttggctggaaacagacctggtcataacctgtgagttcacacaaatccttctcaagctctcggaaaagctgctgatatccttgagcttgatccagaggcacaaaggggtggatgtttgcaaattctttccatgtgataggctgaaaagaaagaaaacaaaaatgcatatatacatattataatagcaatagcaataataactttaataata

SEQ ID NO: 139462 - DNA, 601 bp, Human
ctggaagaggagaagggacctttcaaagttagtgacattaccaaagcaggatccaggttctcctggccctgctaaactgagacacttgttggaattcagcatgtgtgcttgatccttcttcttatgctgtgtcactgacaggtgtagtaagctagcttccaaagacagtccgcaatgaacgacatctaccaaaattcacacccaggtgttgtcccctccccgattcaatctgggctcgcctcgtgacttgctttaatagatagactaatctggaagggatgcagtgtaacttaggaggttsggccattagagatttgcagcttctccatgcttcatctgggaacacgcattctgaaccccgacattgtgctgtaaggaacaaggaagctcaaggaactacaaggaaagccccatatggagaaaaactatggccctagtgaacatcctcaaatgcactcccagcccacagctcctcaccagctatgtgagggagaacacgatgcaccttctagccatgctctccccagtggagtggaactgtctagcaagtcacagaataacacaaataagttgttgttctaagcctttaagttttgtggtg

SEQ ID NO: 139463 - DNA, 601 bp, Human
tatttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgctaaactgagacacttgttggaattcagcatgtgtgcttgatccttcttcttatgctgtgtcactgacaggtgtagtaagctagcttccaaagacagtccgcaatgaacgacatctaccaaaattcacacccargtgttgtcccctccccgattcaatctgggctcgcctcgtgacttgctttaatagatagactaatctggaagggatgcagtgtaacttaggaggttcggccattagagatttgcagcttctccatgcttcatctgggaacacgcattctgaaccccgacattgtgctgtaaggaacaaggaagctcaaggaactacaaggaaagccccatatggagaaaaactatggccctagtgaacatcctcaaatgcactcccagcccacagctcctcaccagctatgtgagggagaacacgatgcac

SEQ ID NO: 139464 - DNA, 601 bp, Human
gagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgcggtgagccgagatcacgccattgcactccagcctgggcaacaagagcaaaactccatctaaaaaaacaaataaataaataaaaataaaaataaagagtcttagtctcaccccctggaggttatgatcagtgcgtctggagcggggcccggagtttgtayttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgctaaactgagacacttgttggaattcagcatgtgtgcttgatccttcttcttatgctgtgtcactgacaggtgtagtaagctagcttccaaagacagtccgcaatgaacgacatctaccaaaattcacacccaggt

SEQ ID NO: 139465 - DNA, 601 bp, Human
ccaacactttgggaggccgagccaggcggatcacctgaggtcaggagttagagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgcggtgagccgagatcacgccattgcactccagcctgggcaacaagagcaaaactccatctaaaaaaacaaataaataaataaaaataaaaataaagagtcttagtctcamcccctggaggttatgatcagtgcgtctggagcggggcccggagtttgtatttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgctaaactgagacacttgttggaattcagcatgtgtgcttgatccttcttcttatgctgtgtcactgacaggtgtagtaagctagct

SEQ ID NO: 139466 - DNA, 601 bp, Human
ataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgcggtgagccgagatcacgccattgcactccagcctgggcaacaagagcaaaactccatctaaaaaaayaaataaataaataaaaataaaaataaagagtcttagtctcaccccctggaggttatgatcagtgcgtctggagcggggcccggagtttgtatttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgctaaactgagacacttgttggaattcagcatgtgtgcttgatcc

SEQ ID NO: 139467 - DNA, 601 bp, Human
aaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgcggtgagccgagatcacgccattgcaytccagcctgggcaacaagagcaaaactccatctaaaaaaacaaataaataaataaaaataaaaataaagagtcttagtctcaccccctggaggttatgatcagtgcgtctggagcggggcccggagtttgtatttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgcta

SEQ ID NO: 139468 - DNA, 601 bp, Human
gagagaccacaaatccaggggattccaaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgyggtgagccgagatcacgccattgcactccagcctgggcaacaagagcaaaactccatctaaaaaaacaaataaataaataaaaataaaaataaagagtcttagtctcaccccctggaggttatgatcagtgcgtctggagcggggcccggagtttgtatttttaacaagtgctcaggagattttgctggaggctgttgcttttgaaaatcactgttcttcttcaaagtctttcctttacaaagaaattgaggctggaagaggagaagggacctttcaaagttagtgacattaccaaagca

SEQ ID NO: 139469 - DNA, 601 bp, Human
atagggtgtattgtttttacaaagtaaatggctttgctgtgtagtctatgttacaaaacagaaggtagggcatcttgaaacagaaattttgcattactaaccagctcccagaggggtcaactctgaggctgctggtagagaactatactttgagcagcaggaggtgaagaacctaggggcagataccataactcattttctaaagatattctaaaatgtaaactcacataccgataacatgattcctgcccatctatcattcatctatgtatgtatgtatgtatgtatgtatctatctatstatctatctatctatctatctatcatctgtccatcggtccatctgtcatctatcatcatgaaggcagagagaccacaaatccaggggattccaaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagcacatg

SEQ ID NO: 139470 - DNA, 601 bp, Human
ttttatagggtgtattgtttttacaaagtaaatggctttgctgtgtagtctatgttacaaaacagaaggtagggcatcttgaaacagaaattttgcattactaaccagctcccagaggggtcaactctgaggctgctggtagagaactatactttgagcagcaggaggtgaagaacctaggggcagataccataactcattttctaaagatattctaaaatgtaaactcacataccgataacatgattcctgcccatctatcattcatctatgtatgtatgtatgtatgtatgtatctatstatctatctatctatctatctatctatcatctgtccatcggtccatctgtcatctatcatcatgaaggcagagagaccacaaatccaggggattccaaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagca

SEQ ID NO: 139471 - DNA, 601 bp, Human
tgtattttatagggtgtattgtttttacaaagtaaatggctttgctgtgtagtctatgttacaaaacagaaggtagggcatcttgaaacagaaattttgcattactaaccagctcccagaggggtcaactctgaggctgctggtagagaactatactttgagcagcaggaggtgaagaacctaggggcagataccataactcattttctaaagatattctaaaatgtaaactcacataccgataacatgattcctgcccatctatcattcatctatgtatgtatgtatgtatgtatgtatstatctatctatctatctatctatctatctatcatctgtccatcggtccatctgtcatctatcatcatgaaggcagagagaccacaaatccaggggattccaaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggt

SEQ ID NO: 139472 - DNA, 601 bp, Human
tgggatcacaatttactgcaagagctaataaccagaattaaaatagtcttgaaaaatcactctccaatatgacagtgaaaatgtgattatattccgtcactagagggcgaaatttcttaattttcaacatttaataactatcatagactcaaggttcagaattcactgaggtttgtctcttaaaacaaaacaaaaataagtaatgaagttctaaagaaggtatactaaagcttgactttcatgctatcagctcctacctatttatgaagtgagactttaagacgcaattgagagcactgtrtcctttcattgccacataccctcttcccaaagggtttgtattttatagggtgtattgtttttacaaagtaaatggctttgctgtgtagtctatgttacaaaacagaaggtagggcatcttgaaacagaaattttgcattactaaccagctcccagaggggtcaactctgaggctgctggtagagaactatactttgagcagcaggaggtgaagaacctaggggcagataccataactcattttctaaagatattctaaaatgtaaactcacataccgataacatgattcctgcccatcta

SEQ ID NO: 139473 - DNA, 601 bp, Human
aagacatcattgccaggaacgacatcatgatgaagatctcttaccctctgcaagattgggatagggtgtggagtctcactgtccatcatatgaatgagaaaaattaggacaaagaaagaacaccaggtatgtagggaaaaacagcggagaaatgtctaagacactggttctcaaccttggctgcagttggaatcatgtagggaactttaaagaaatactcacgcctgggtcccttccctcaccccagtcattctccattgagattatgattcaatctgggattgtgatgtgggcatcaggratgttataaagtcaccatgggatctaattcctagccaaggctgtaaaccactgctttaagaagacaaatttcctgattcttaggtcagtcttctgggatcctggctgggatcacaatttactgcaagagctaataaccagaattaaaatagtcttgaaaaatcactctccaatatgacagtgaaaatgtgattatattccgtcactagagggcgaaatttcttaattttcaacatttaataactatcatagactcaaggttcagaattcactgaggtttgtctcttaaaacaaaacaaaa

SEQ ID NO: 139474 - DNA, 601 bp, Human
ggttaaaaaaatcacttatatatggaatatgtggtgtatcccttccttttttctgcgaattaagacatcaaattgctttactcaccagaagcatggcccttgtactttctcaacaaagaataaggcattttctcatctgtcacagcagcttctgctcatgaccagaaacatccttcattcctttatctaagcctaaacattgtgcaaagcccctgccatgctcaaatcagctcttggaaatggatggtatagctgggaatctcaggaactggagaagacatcattgccaggaacgacatcrtgatgaagatctcttaccctctgcaagattgggatagggtgtggagtctcactgtccatcatatgaatgagaaaaattaggacaaagaaagaacaccaggtatgtagggaaaaacagcggagaaatgtctaagacactggttctcaaccttggctgcagttggaatcatgtagggaactttaaagaaatactcacgcctgggtcccttccctcaccccagtcattctccattgagattatgattcaatctgggattgtgatgtgggcatcagggatgttataaagtcaccatgggatcta

SEQ ID NO: 139475 - DNA, 601 bp, Human
tagccagcagtaaatcatgacaaattagccaatatgtaagccctgttgtagacacagaataattataagacaagaaatgtgtcacccacttgtgcagagattagcacaaataagccaaaataggattgaaacaaggttaaaaaaatcacttatatatggaatatgtggtgtatcccttccttttttctgcgaattaagacatcaaattgctttactcaccagaagcatggcccttgtactttctcaacaaagaataaggcattttctcatctgtcacagcagcttctgctcatgaccagamacatccttcattcctttatctaagcctaaacattgtgcaaagcccctgccatgctcaaatcagctcttggaaatggatggtatagctgggaatctcaggaactggagaagacatcattgccaggaacgacatcatgatgaagatctcttaccctctgcaagattgggatagggtgtggagtctcactgtccatcatatgaatgagaaaaattaggacaaagaaagaacaccaggtatgtagggaaaaacagcggagaaatgtctaagacactggttctcaaccttggctgcagttggaat

SEQ ID NO: 139476 - DNA, 601 bp, Human
tctagccagcagtaaatcatgacaaattagccaatatgtaagccctgttgtagacacagaataattataagacaagaaatgtgtcacccacttgtgcagagattagcacaaataagccaaaataggattgaaacaaggttaaaaaaatcacttatatatggaatatgtggtgtatcccttccttttttctgcgaattaagacatcaaattgctttactcaccagaagcatggcccttgtactttctcaacaaagaataaggcattttctcatctgtcacagcagcttctgctcatgaccasaaacatccttcattcctttatctaagcctaaacattgtgcaaagcccctgccatgctcaaatcagctcttggaaatggatggtatagctgggaatctcaggaactggagaagacatcattgccaggaacgacatcatgatgaagatctcttaccctctgcaagattgggatagggtgtggagtctcactgtccatcatatgaatgagaaaaattaggacaaagaaagaacaccaggtatgtagggaaaaacagcggagaaatgtctaagacactggttctcaaccttggctgcagttgga

SEQ ID NO: 139477 - DNA, 601 bp, Human
cgtgcatataggtcccctagatttcactggactctagccagcagtaaatcatgacaaattagccaatatgtaagccctgttgtagacacagaataattataagacaagaaatgtgtcacccacttgtgcagagattagcacaaataagccaaaataggattgaaacaaggttaaaaaaatcacttatatatggaatatgtggtgtatcccttccttttttctgcgaattaagacatcaaattgctttactcaccagaagcatggcccttgtactttctcaacaaagaataaggcattttcycatctgtcacagcagcttctgctcatgaccagaaacatccttcattcctttatctaagcctaaacattgtgcaaagcccctgccatgctcaaatcagctcttggaaatggatggtatagctgggaatctcaggaactggagaagacatcattgccaggaacgacatcatgatgaagatctcttaccctctgcaagattgggatagggtgtggagtctcactgtccatcatatgaatgagaaaaattaggacaaagaaagaacaccaggtatgtagggaaaaacagcggagaaatgtctaa

SEQ ID NO: 139478 - DNA, 601 bp, Human
gtgccagtagtcccagctaagcgggaggctgaagcaggaagatcacttgagcctgggaggccaaggttgcagtgagccaagatcctgctactgcactccagcctgagcaaaagaatgagaccctgtctgaaaaaaagaaaaaaggaagtaaattctgacacatgccacaacattgatgaaccttgaagacattatgctaagtgaaataagccagacacaaaaggacaaatattgtatgatccacttatacgaggttcctaaagtagtcaaattcatggagccagaaagtagaatggaggcygccaggggccagggaaaaagggaaagaggaaccgaagagttactgtttaacaggtcctgagcttgaatttgagaaaatcaaaaagctctcagacggataatggtgatggctgtacaacagtgtgaatatacttaatgcctctgaactgtacacttaaaaatacgtaaagcagtaaattttgtgttatgtatattttaccacaataaaaaatactttagagttgtgaaatactactaaggctacttcctaaaaattatgctatggttatatctgaaatatcatacaataatgaaagggaaa

SEQ ID NO: 139479 - DNA, 601 bp, Human
agtgagccgagatggcgccactgcgctccaggctggacaacagagcagggctccatctcaaaaaaaaaagatataaagaactgctgggccgggcgcggtggctcacgcctgtaatcccagcactttgagaggccgaggcgggtggatcacgaggtcaggagatcgagaccatcctggctaacacggtgaaaccctgtctctactaaaaatacaaaaaattagccgggtgtggtggcatgcgcctgtagtcccagctactcgggagggtgaggcaggagaatggcgtgaacccgggaggcgrtcgttgcagtgagccgatatcgcgccactgcactccagtctgggcgacagagcgagacctcgtctcaaaaaaaaaaaaaaagaactgctataactcaacaacaaatctcccaagaaacccaattaaaaaatgggcaaaggacttgaatacacgtttctccaaagaagatgtacaaatgcatggtaagcatatgaaaagatgctcaacattgctaatcattggggaaatgtccatcaaaaccacagtgagataccacttcacacctaccagaattgctattacttgaggaaacagaaaata

SEQ ID NO: 139480 - DNA, 601 bp, Human
cttccctgtctcacctctgtacttctccactgtgctttccgggatcagcaaccacataaacttcttgtactgaagttcctgtttcagggtctgattttgggaaaccccaaataagacacaagcataccagaggcatagtggcgtctctgacagacagttaccagcattcagggccaactggtatctgggtcaataacatagcatttccagtgcaaaggcctcctctccagtcagggtctatgtcgctctcatgggtcaggtcaaggcagataatacagaatataaatctaaattgcaccayggtagatcatgaatagtaggaatgaaaaagttaatgtaaataaaaatggactaagagtggataaaggttagactatccaggttgaccaaaagctaatatttaccagagaaggccacagacattatgctagataaggtgcaaatcctttatatttattgtatatttagagttgcctttgtgcatcaaaaaacactgtaaacagtgaaaaggaaattcatggaatgataggtaatgtttgcaaatcatatatctgataaggaattagaacatataggctgggcgtggtgttcccgcctgtaa

SEQ ID NO: 139481 - DNA, 601 bp, Human
aactccagcttctcagtccttcccgggcaacgaaggagcagttggtaaatactctggcttcctcagctcttcactgggacaaatcggaggcatgttccatccagtctccctcagtgcccccaatgggactgatctctaggatcccatacagtgatggtgataacctggtcactaatacaaccttttccagctttcctcacttccctgtctcacctctgtacttctccactgtgctttccgggatcagcaaccacataaacttcttgtactgaagttcctgtttcagggtctgattttgggraaccccaaataagacacaagcataccagaggcatagtggcgtctctgacagacagttaccagcattcagggccaactggtatctgggtcaataacatagcatttccagtgcaaaggcctcctctccagtcagggtctatgtcgctctcatgggtcaggtcaaggcagataatacagaatataaatctaaattgcaccatggtagatcatgaatagtaggaatgaaaaagttaatgtaaataaaaatggactaagagtggataaaggttagactatccaggttgaccaaaagctaatattt

SEQ ID NO: 139482 - DNA, 601 bp, Human
aacttcctcaattttttaagccaagtgagctaataataattccaacttgtctttcactttacatatccatgggaggtgttaattactctttctgtctgccttaaacatcacatcataattctaaactagcaattcctagaatgtacttatgagctgctgaatgatttgaagagtggcaaagtgttatggagaaaaagctgaagcaagccccgctgggctcagtgggaaatgaaaaggtaattaaatattatttggctgttttctacaccaagctggaaaccctccccggggtttatgggtwgaacaaataaataggagaaaatagggataagcttcttgacattttttctttcaggcccttcaaacacccttgggatcaaaatgtcctaaggaactaggcagaccagtgaaggcttggctacatcaagcaaagttatcttgacaaaatttatggttattgtcttaatccatccaggtgctataacaaaatgccaaaaactgggtggcttataaacaacagaaagctatttcccattgttctagaggctgagatgtccaagatcctagaagccagcagacttagtgtctagtgagggcgcac

SEQ ID NO: 139483 - DNA, 601 bp, Human
gatgtaactggtttgtgcagtaggtagggcatctgtgttcttcaaaagtctccccaggtaattctaacatgcagccaggtccaagaacctctggtaaacctagtggttttcacaggctggtggccaaacgagctgcctcagcatcacctggggatttgttaaaaatgcaaattctggggccctactccagacttactgaatcagaaactctgtagggtgaggctcagtaattgcacaagccctccaggtgattctcatgcacaattaattctgacagccattgagagccctgttcacaccwcaatttaagaatcttcccatgaaggagattctgggaaaagcaatggccacctccgtctacattaacaatcacagtttgcagtttttaaggacaaaaacaacttcctcaattttttaagccaagtgagctaataataattccaacttgtctttcactttacatatccatgggaggtgttaattactctttctgtctgccttaaacatcacatcataattctaaactagcaattcctagaatgtacttatgagctgctgaatgatttgaagagtggcaaagtgttatggagaaaaagctgaa

SEQ ID NO: 139484 - DNA, 601 bp, Human
gacagagtgagactccatctcaaaagaagcaaaaaaaaaaaaaacaaaccccaaaactctcccatatgggctccatccccagcgaagattctgatgtaactggtttgtgcagtaggtagggcatctgtgttcttcaaaagtctccccaggtaattctaacatgcagccaggtccaagaacctctggtaaacctagtggttttcacaggctggtggccaaacgagctgcctcagcatcacctggggatttgttaaaaatgcaaattctggggccctactccagacttactgaatcagaaacyctgtagggtgaggctcagtaattgcacaagccctccaggtgattctcatgcacaattaattctgacagccattgagagccctgttcacaccacaatttaagaatcttcccatgaaggagattctgggaaaagcaatggccacctccgtctacattaacaatcacagtttgcagtttttaaggacaaaaacaacttcctcaattttttaagccaagtgagctaataataattccaacttgtctttcactttacatatccatgggaggtgttaattactctttctgtctgccttaaacatca

SEQ ID NO: 139485 - DNA, 601 bp, Human
gcactttgggaggctgaggcaggtggaggcaggtggatcacctgaggtcaggagttcaagatcagcctggccaacatggagaaaccctgtctctaataaaaatacaaaaattagccaggtgtggtggcacacacctgtaatcccagctacttgggaagctgagacacaagaatcgcttgagcccggcaggcagacgttgcagtgagctgagatcgtgccactgtactccagcctgggcaacagagcaagactctatcttaaaaaataaataaataaaagaatacatttatgtgattttttwaaaaaaaatccatcatcagtgcagaagggttataaagcaaaagaagaagaaaaaagcgacccccatccatcctacccagtgtcaccccccagaaggaaatacttcacagttgcttgtgatacgtaagggtttggtgttggacatctttgatgtcagactcccctcatccaaactctcctttacgttgagaaacaaaaacgatgcaagtgaaacatcagctaagaaaccgatacggtaaaaatgatggcagtaaagtgatcctaacaaccactgtcgaaatgacccacttcagttcatggc

SEQ ID NO: 139486 - DNA, 601 bp, Human
acttagacatccataggcacaatctaagtctcacagcttatataaaaatcacctgtaaatggatcatggacttaaatgtaaaacataaaactatgaaatttctgggaaaaacaaaaaacagaataaaaattgttgggatctagggtagatttgaaacccaaagcacaattcataaaagaaaaaaattgataaattgaactccatcataattaaaaactttttgctcccattagggttacaaggacaagctacagaacgggagaaagtatctgcaaactaccatagccaacgagcagtaagkacaaatgcaattcagaaaatgatgctgggaaaatgacatgtggacatgctgtcaatgtgcttaaaagtacgaaggagggttacattaggatgttgaaaatcaactgggttttcattggtgctgagtttagaggtgtgtgtgggaatgcagagcctttcagtggctttattatctgggggaattccctcttttgtgtgagtctatgggagagacacggtcctacactcccctatgaaagcaaaaaggattagacattcccagtcactaaacactaataagacatggaggtgtgaaacatcc

SEQ ID NO: 139487 - DNA, 601 bp, Human
actaagaataaatagaacaattacaccaccataccagtatcactactcttgtgctttgggtacactactaaataaaataagggttccttgcaatgagacattgcagtgagatcgtgccactgtacgatttcactgttccttgaaagcgctgtgataacatagcagttgatctgataaccaaggcagctactaagtgactgatgggtgggtagcatatacacagtggatatgctggacaaagggctgatttacatcccaggtgggatggaacaagatgctgcagggtttcatcacactattyagaatggtgtacaatttaaaacttaggatgaattgcttatttctcaaattttccatttaatatttttgagccagttgaccatgggtaactgaaactgcaaataagtggggactatcatatatagctacaataatcaagcctatgtacacagagatcacacatagatcaatggaatagaatatagaatccagaaatagatccaaacaaatatacccaactatttttgacaaagttgcaaaagtaattcaatggaggaaagatcgccttttcaataaatggaactgaaacacttagacatcc

SEQ ID NO: 139488 - DNA, 601 bp, Human
ctcccccaaaataatgattttcttatagacacaagcaagattattctaaaatgcatatgtaaaggcaaagtaactggaatagctactttttttaaaaaaaaaagaaagaaactggcacaaatcagttcatctgatggcaaggcttattaacagtagccccctcttatctgcaggaaatatcttccgggacacccagtgggtgcctgaaaccatggatggcacccaaacccaggtgtactacgatttttcctatacatacatacctatgataaaatctaacttataaattaggcacagttasagattaacaacaataactaagaataaatagaacaattacaccaccataccagtatcactactcttgtgctttgggtacactactaaataaaataagggttccttgcaatgagacattgcagtgagatcgtgccactgtacgatttcactgttccttgaaagcgctgtgataacatagcagttgatctgataaccaaggcagctactaagtgactgatgggtgggtagcatatacacagtggatatgctggacaaagggctgatttacatcccaggtgggatggaacaagatgctgcaggg

SEQ ID NO: 139489 - DNA, 601 bp, Human
catggcgaaacttcgtctctactaaaaatacaaaaattagctgggcgttgtggcaggtgcctgtaatcctagctactcaggagggtgagacaagagaatcacttgaacccagcaggtggaggttccagtgagctgagatcgcaccactgcactccagcctgcgcaacaagagcaaaactctgtctcaaaaaaaaaaaaaaaaaaagtttctcggggtatgtttttaaaaaaaatattttattacatttaaaatgataccttttcatgaaaaatatttattttatgagtgataaattataartttaaatatgaggtgaatttgttcccttcaactacctataatatctatagcatccagcatacagccctttgtacaaaatgtaacatttagaagctaaaatatacatcatcctcccccaaaataatgattttcttatagacacaagcaagattattctaaaatgcatatgtaaaggcaaagtaactggaatagctactttttttaaaaaaaaaagaaagaaactggcacaaatcagttcatctgatggcaaggcttattaacagtagccccctcttatctgcaggaaatatcttccgggac

SEQ ID NO: 139490 - DNA, 601 bp, Human
accaggcatggtggctcatgcctgtaatcccagcactttgggaggctgaggcgggcagatcacctgaggtcaggagttcgagaccaacctggccaacatggcgaaacttcgtctctactaaaaatacaaaaattagctgggcgttgtggcaggtgcctgtaatcctagctactcaggagggtgagacaagagaatcacttgaacccagcaggtggaggttccagtgagctgagatcgcaccactgcactccagcctgcgcaacaagagcaaaactctgtctcaaaaaaaaaaaaaaaaaaagtttctcggggtatgtttttaaaaaaaatattttattacatttaaaatgataccttttcatgaaaaatatttattttatgagtgataaattataagtttaaatatgaggtgaatttgttcccttcaactacctataatatctatagcatccagcatacagccctttgtacaaaatgtaacatttagaagctaaaatatacatcatcctcccccaaaataatgattttcttatagacacaagcaagattattctaaaatgcatatgtaaaggcaaagtaactggaatagctacttttttta

SEQ ID NO: 139491 - DNA, 601 bp, Human
aattatagtaccaagaaattaagatttatatatttttgaattactaaatatctagattgaccatatctatttttgttttaattttccctaaatattctgaaaatcattttatagtttttaacacaccatcatagtttgtgcacggatggccacctttagtgtgtgatttcagtgaagttcccattgaagttatttataagcagtggacctattttacttcttatatttgaacttcttaagaagtttcttgaccaggcatggtggctcatgcctgtaatcccagcactttgggaggctgagrcgggcagatcacctgaggtcaggagttcgagaccaacctggccaacatggcgaaacttcgtctctactaaaaatacaaaaattagctgggcgttgtggcaggtgcctgtaatcctagctactcaggagggtgagacaagagaatcacttgaacccagcaggtggaggttccagtgagctgagatcgcaccactgcactccagcctgcgcaacaagagcaaaactctgtctcaaaaaaaaaaaaaaaaaaagtttctcggggtatgtttttaaaaaaaatattttattacatttaaaatga

SEQ ID NO: 139492 - DNA, 601 bp, Human
gcctgggcaacagagtgagactccatcacaaaaacaaacaaacaaaaagaaatggatgttgcagaccaggcacagtgcctcatgcctgcatgcctgtaatcacagcacgttgggaggccgaggcgagcggattacctgcagttagaagatcgagaccagcctggcgaacatggcaaaaccctgtctctactaaaaatacaaaaattagccaggtgtggtggtgtgcatctgtaatcccagctacttgggaggctgaggcaggagaatcgcttaaagcaaggaggtggaggctgcagtgatstaagatcgcgccactgcactccagcctgggccacagagtgagactcagtctcatggccggggggattaaaaaacatcgtggctaactttatagacaccataagcaatttctcagatggtgactgctttggaatatttggacatgggtcactgtagctgcatgctttttatatatgcaaaaagtaacatgaaacccattttgcaagactgcagaatgcactaaagtaataatttatggtgaacaccagcagtcaccaaaactcccactgaatcacattgtaattatatggagaaaacagta

SEQ ID NO: 139493 - DNA, 601 bp, Human
gccttccctaaagccaccaatccagctctgtcacttcctcagagaggccttccctgaaggcaagaattttgtcaaccttgttcacaattgtattctctattccaagaacactgacataaaaaatatttgatagattgattaaagaaataatcctctacctcctccaaattatcatagcattttactctacaatcttatctgacattaatatcctatacatgtactggacatagaaaattattaccgatttcacatttactttgtatgcctgtcttatctcaattagagcataagctctgamagtagggtctaattctcagagttctgtatattcttcaacagggaatatatagaacagtactctgcatgtagtagttctgcaataagtatttagtaaatattttaaaaattgaattcctccagcacaggcaatcaatatgaatgtcatcctttcccctacagtaaggaacctcaagaaaaacattttatatttacccctatgtttttctcatgaattctattcatctgactttcttgaaaggccaatcaaggtgtagactaggaatgaaggaagaggcagattactggctatgagccagta

SEQ ID NO: 139494 - DNA, 601 bp, Human
catctccctgtgcctatgtgcctgagagatgtgtaaaatggggatagtaacagtacccatcacacagggcagatgtgatgtgtagtgagatcatcaaggtcaaatgcttctcagccaaatcctgcccattcttcaactggctacaactctctgcaaagccttccctaaagccaccaatccagctctgtcacttcctcagagaggccttccctgaaggcaagaattttgtcaaccttgttcacaattgtattctctattccaagaacactgacataaaaaatatttgatagattgattaaakaaataatcctctacctcctccaaattatcatagcattttactctacaatcttatctgacattaatatcctatacatgtactggacatagaaaattattaccgatttcacatttactttgtatgcctgtcttatctcaattagagcataagctctgacagtagggtctaattctcagagttctgtatattcttcaacagggaatatatagaacagtactctgcatgtagtagttctgcaataagtatttagtaaatattttaaaaattgaattcctccagcacaggcaatcaatatgaatg

SEQ ID NO: 139495 - DNA, 601 bp, Human
aaagcctgtcttacaagacctgagtcaccccgttcctcgtcacccgcactgagtcagctgcagctatctccgctctcttccaagaagaaaggcaaagactgctcttctgttttcctggcttctgaaaaacaagtcctagcctatttgaggttttttcattttgaggacaagaaaatgaatatgccgtgcttcaggaaaccactcacatcacaagtaacttcatctccctgtgcctatgtgcctgagagatgtgtaaaatggggatagtaacagtacccatcacacagggcagatgtgatgwgtagtgagatcatcaaggtcaaatgcttctcagccaaatcctgcccattcttcaactggctacaactctctgcaaagccttccctaaagccaccaatccagctctgtcacttcctcagagaggccttccctgaaggcaagaattttgtcaaccttgttcacaattgtattctctattccaagaacactgacataaaaaatatttgatagattgattaaagaaataatcctctacctcctccaaattatcatagcattttactctacaatcttatctgacattaatatcctatacatgtac

SEQ ID NO: 139496 - DNA, 601 bp, Human
taaggaagacacacctatgaggtgaaaacaaatcatcactctataatttcttagtattaccaaatatcgagtcaagggcctgatcagccccaaaagaatgaggcacttttaatgtgacaccattcctggcagtctcaggttcggctctcccaggccccggatgcagatggctgttaggggctggccatcctcatctcaacggtcctggaaggcaccactttcagggcatatgcaatgactaacattccggtgagcaatgctgactcaatcgtagactgttatttcatgttcccagtacccygtgcaggaagggaagggaaatgagtaatagatgtatcagtcccattcaaaatgtgtatgtctgcgaagctgaaggcaaaaattaaatactaaaaaaagatacaaaaatttaaactttaaacaaatgaaaatttaaaaataaaataactttttttaatgttacccacagaaaatcggtaagaattttaaaaaatgtgtatgttctccatgccatcacccccattttgcacacaaagaaactgaggtctgagtgctacatgccaaatggccaacagtgacagatgaagacttgggtgtggag

SEQ ID NO: 139497 - DNA, 601 bp, Human
ttttcctttttttttcccttttctttccccctttaaatgggtaatgtgtcaacatcttaacaaggtttaaggaagacacacctatgaggtgaaaacaaatcatcactctataatttcttagtattaccaaatatcgagtcaagggcctgatcagccccaaaagaatgaggcacttttaatgtgacaccattcctggcagtctcaggttcggctctcccaggccccggatgcagatggctgttaggggctggccatcctcatctcaacggtcctggaaggcaccactttcagggcatatgcmatgactaacattccggtgagcaatgctgactcaatcgtagactgttatttcatgttcccagtaccccgtgcaggaagggaagggaaatgagtaatagatgtatcagtcccattcaaaatgtgtatgtctgcgaagctgaaggcaaaaattaaatactaaaaaaagatacaaaaatttaaactttaaacaaatgaaaatttaaaaataaaataactttttttaatgttacccacagaaaatcggtaagaattttaaaaaatgtgtatgttctccatgccatcacccccattttgcacacaa

SEQ ID NO: 139498 - DNA, 601 bp, Human
ctatatttaacaatatataattttgaatagttagaaggaggatattgaacgttccctcaacacaaagaaatgatacatgcttgagatgatggatatgctgattaccctgatctgatctctatacatttgatgtatagaaacatcactatataccccatgactatgtacaactattgtcatttaaaaagataaagaacagaggccaggcgtggtagctcacgcctgtaatctcagcactttgggaggctgaggcgggcggatcatgaggtcaggagatcgagactatcctggccaacacggkgaaaccctgtctctactaaaaatacaaaaagtagctgggcatggtggcacacgcctgtagtcccagctaatcaggaggctgaggcaggagaattgcttgaacccgggaggcggaggttgcagtgagccgagatcgtgccactgcactccagcctgggcgacagggtgagactccgtctcaaaacaaacaaacaaaaagataaagaacaggaattggaaaaaaaaaaaaaaaaagaattcccacaagaagtgtttctgtaaataaaagtcttctttattctttccttttacagaaggcaag

SEQ ID NO: 139499 - DNA, 601 bp, Human
ccgagcatggtggcaggtgcctgtaatcccagctacttaggaggctgaggcagggacaattgcttgaaccggtgaggtggaggttgtagtgagccaagatcacaccactgcactccagcttggacaacagagagagactccacgtcaaaaaaaaaaaagaaaaaagaaaaaaagaaataataagatcctttcaggctaggtctctatggtccagaccaaaaggactattcacaagatttttggatattttgggcccaactctctaaggtggttttcccttggttcaagtcatctcaataaygatttcagacgtttgtggttctaggtgcgtccattctcatagttaatctctctgctcatcttctcatatccattcctttcccttgccttctgttgaagttaaaattcccaaattacagctagataggaggagtaagttgtagagttctataccactgcaggatgactatatttaacaatatataattttgaatagttagaaggaggatattgaacgttccctcaacacaaagaaatgatacatgcttgagatgatggatatgctgattaccctgatctgatctctatacatttgatgtat

SEQ ID NO: 139500 - DNA, 601 bp, Human
tcccggcactctgggaggccgaggcgggcagatcacctaaggtcaagaattcgagaccagcctggccaacatggtgaaaccccgtctctactaaaaatacaaagattagccgagcatggtggcaggtgcctgtaatcccagctacttaggaggctgaggcagggacaattgcttgaaccggtgaggtggaggttgtagtgagccaagatcacaccactgcactccagcttggacaacagagagagactccacgtcaaaaaaaaaaaagaaaaaagaaaaaaagaaataataagatcctttsaggctaggtctctatggtccagaccaaaaggactattcacaagatttttggatattttgggcccaactctctaaggtggttttcccttggttcaagtcatctcaataacgatttcagacgtttgtggttctaggtgcgtccattctcatagttaatctctctgctcatcttctcatatccattcctttcccttgccttctgttgaagttaaaattcccaaattacagctagataggaggagtaagttgtagagttctataccactgcaggatgactatatttaacaatatataattttga

SEQ ID NO: 139501 - DNA, 601 bp, Human
cctccatgttgttgaaataggcaactcttccctgagcagcgctaccttcccctgcgtggtcggctttagtatgatgcacgttaccgaacggccccgttgggcacagtgatggaaggggctgcgggggcaccagggaggaggctgaactgagagagggaaggcaaggctcgcagtcttcccgagatgacccagatgccaggcatgccatcccactagccttcccaccacttgggtgttaggactaattttgatggtgaccaaaggtacagaattcatttatgctacagaaccaatagacaakctctggattacacttgtgaaatgaatgagaaccaaagaaaggctctaaaatggtaggaaaaaaaaaagaggtcgggcgtggtggatcacacctgtaatcctagcactttgggaagctgaggcaggtggattgcctgagctcaggagttcaagaccagcctgggcaacacagtgaaaccccatctctactaaaatacaaaaataaaaataaaaaaatttaaaaaaattagctgggtgtggcagcatgcacctgtagtcccagctactcgggaggctgaggcagcagaactgcttgaaccca

SEQ ID NO: 139502 - DNA, 601 bp, Human
tggaaatagcaactgaccatttagtccaatttagatttaaaaatatggatttgaatacacagtctcttcctaattatccacacaccacaaagggagagaagtgtctctaacacaagaaagggcagaacctccatgttgttgaaataggcaactcttccctgagcagcgctaccttcccctgcgtggtcggctttagtatgatgcacgttaccgaacggccccgttgggcacagtgatggaaggggctgcgggggcaccagggaggaggctgaactgagagagggaaggcaaggctcgcagycttcccgagatgacccagatgccaggcatgccatcccactagccttcccaccacttgggtgttaggactaattttgatggtgaccaaaggtacagaattcatttatgctacagaaccaatagacaatctctggattacacttgtgaaatgaatgagaaccaaagaaaggctctaaaatggtaggaaaaaaaaaagaggtcgggcgtggtggatcacacctgtaatcctagcactttgggaagctgaggcaggtggattgcctgagctcaggagttcaagaccagcctgggcaacacagtg

SEQ ID NO: 139503 - DNA, 601 bp, Human
cacctaccacaaaggcaagggccaaaagcaaaagtcaagagcttggaagcaccctccagtgtgaaggccatggctggccggtgctgccttctcccctcagaggaaaagcaggcagagccacatccatggtgttcacagaaatgtcctctatactggcccagttccgtagtcacaaactggcatccgataggcagagtgcttgtggttgctatggaaatagcaactgaccatttagtccaatttagatttaaaaatatggatttgaatacacagtctcttcctaattatccacacaccacaragggagagaagtgtctctaacacaagaaagggcagaacctccatgttgttgaaataggcaactcttccctgagcagcgctaccttcccctgcgtggtcggctttagtatgatgcacgttaccgaacggccccgttgggcacagtgatggaaggggctgcgggggcaccagggaggaggctgaactgagagagggaaggcaaggctcgcagtcttcccgagatgacccagatgccaggcatgccatcccactagccttcccaccacttgggtgttaggactaattttgatggtgaccaaag

SEQ ID NO: 139504 - DNA, 601 bp, Human
agctgattttaaaaaagaaaaaaaaaatgctaggaaatccaaaagtccgaaaggcactttctagtgccaatattccagttacaatacgtatgctcaggtgaagttccctattcattattctgttaataaacctgctgtctatgtgcaactggaagctcagtgaggccagatgctatggttagtaaaatctaattacgcttttctttggaaatcccctaaaagcacccattttgctgctcctcccccagcccctacaagtgcactacaccgatgagggtatcctcaacacatgaagactttsatgggatgagtagtctatttagggccactccttcattctgtctccaaagccatcctgaaaccagcagcccagaacttacactccgatgggccccatgccaggaccacctcctccgtggggaatgcagaaggtcttgtgaagatttaggtgcgagacatcagacccgaagtctccagggcgacagattcccacctaccacaaaggcaagggccaaaagcaaaagtcaagagcttggaagcaccctccagtgtgaaggccatggctggccggtgctgccttctcccctcagaggaaaagcag

SEQ ID NO: 139505 - DNA, 601 bp, Human
ttacatctaattcactttcaatggaaccattagctgattttaaaaaagaaaaaaaaaatgctaggaaatccaaaagtccgaaaggcactttctagtgccaatattccagttacaatacgtatgctcaggtgaagttccctattcattattctgttaataaacctgctgtctatgtgcaactggaagctcagtgaggccagatgctatggttagtaaaatctaattacgcttttctttggaaatcccctaaaagcacccattttgctgctcctcccccagcccctacaagtgcactacaccratgagggtatcctcaacacatgaagactttgatgggatgagtagtctatttagggccactccttcattctgtctccaaagccatcctgaaaccagcagcccagaacttacactccgatgggccccatgccaggaccacctcctccgtggggaatgcagaaggtcttgtgaagatttaggtgcgagacatcagacccgaagtctccagggcgacagattcccacctaccacaaaggcaagggccaaaagcaaaagtcaagagcttggaagcaccctccagtgtgaaggccatggctggccg

SEQ ID NO: 139506 - DNA, 601 bp, Human
acccaggccatcagcaatattctttgaaccacatctcagatcatgaatttatttgtttttaagccaagaagtctgcagtatccggtccccatgcatgcctgacgcccccacccacctgcacacctgcacatactcccaggcctcaccttgatataagcccaggaaatgggcaagatggaactggagccccatggggccgcactgacggttcccacaggacaggcatcctcattccgctttagtgaaatgacgggatgattgggcaaaaacggggcgagatgtttcttcctgtattttttttaagtgcaaattcagaaaatgtaaacgattcagtttaatctaatgggaaggttctgggccctcccagaaagccttgttcttagcagaggagctctgacagtggaagggactctccacctgctgggaggcagatgttcaggaagcgatccttccttccttcctcctctggtggaggtccaccagccatcagtgtcccagggctcacccaagaaatgtggtggagggcttgatagaggcaggcagccataaaacagtggagttccatgtccctccctcccactcccagccccattccctcacc

SEQ ID NO: 139507 - DNA, 601 bp, Human
caagaactgtagaaaatcaactctggccctggtgttatttggaataagacaaaggaaggaagcctgtactctgactaattacgcagagagcacagcaccacaaaccctaaaggccaaagagctctggggaaaaaccagagaagcaaatttctgctatttttcatcttctcctctggccccccccaagaaatatatagcaaagtgagatatatagcaggatctcagcaaagtggaataattagtacatgcactgcttttcactcggaaggggctatataaatcctgcaggaaaccaaaggaygcggccagaacatccatatgactcatggaacttagctgtgtctggaaaaatatatctgatgtttcagtttctctgatgttaaacccactctgagaacccaaaagaagtagtgtaatgaaggagagatgaaatgatttttagctcatctcttcaggaaggtttcttccacccaggccatcagcaatattctttgaaccacatctcagatcatgaatttatttgtttttaagccaagaagtctgcagtatccggtccccatgcatgcctgacgcccccacccacctgcacacctgcacatac

SEQ ID NO: 139508 - DNA, 601 bp, Human
acatttcagtgttgtggaatctttattgacctgggctgctgtgtagactaggagcctaggagaaacctgcatatagtaatgcccctaaacagttaactaaagtggtgttatggctgggcgtggtggctcatgcctgtaatcccagcactttgggaggctgagacaggtggatcacctgaggtcaggagttcgagaccagcctggccaatatggtgaaaccctgtctctactaaaaatataaaaattagccgggcatggtggtgcacacgtgtagtcccagctactcgggaggctgaggcaraagaatcgcttgaacccgggaggcagaaattgcagtgagacaagatcctgccactggactccagcctgggtgacagagcaagactctatctcaaaaataacaagataaaataaaataaacccgagttatttccaagaactctacactattttctgatatgtgctaagaaatagaagtctcttgcccatgtcagaaaagcgcatctaggtcaaacttagtttggccaagaaaaaaaccaaagtaatgatagattaaagttgatacttgcctcttgcacccctgaaaagaattctgtagtgt

SEQ ID NO: 139509 - DNA, 601 bp, Human
atatcatagcactttgtaaataattagcttatggtatttatgtacacatttcagtgttgtggaatctttattgacctgggctgctgtgtagactaggagcctaggagaaacctgcatatagtaatgcccctaaacagttaactaaagtggtgttatggctgggcgtggtggctcatgcctgtaatcccagcactttgggaggctgagacaggtggatcacctgaggtcaggagttcgagaccagcctggccaatatggtgaaaccctgtctctactaaaaatataaaaattagccgggcayggtggtgcacacgtgtagtcccagctactcgggaggctgaggcaaaagaatcgcttgaacccgggaggcagaaattgcagtgagacaagatcctgccactggactccagcctgggtgacagagcaagactctatctcaaaaataacaagataaaataaaataaacccgagttatttccaagaactctacactattttctgatatgtgctaagaaatagaagtctcttgcccatgtcagaaaagcgcatctaggtcaaacttagtttggccaagaaaaaaaccaaagtaatgatagattaa

SEQ ID NO: 139510 - DNA, 601 bp, Human
gccatctacttgaggcgttttgttctggcttctcaccttcaatattctttcctggggcctcaccacttccaagactcagctattaggtcctgagcccacagcccaatgtgtaaaaggatgcctggtttttagttccctcccatcacttccagggtgactttgttcccctgcctattattccctctactgtaagccctagaggctagctaaccttcaatcacaggtgtgattacaggattgcaggtgtgagccaccaccccagccccttgctacctctaaggcatgtttcccccttgccgcygtcttaatgattgtaacggtctcttcatgaatccctaccctcccctgctcaaaaacctttaatggctattgtccagctcaagggtgaagtccagagccttccaaggccttcaaggccccacgctacatttccagcctcattgtcatttgctccctctcccctatcccatccttcactccagaccagagagctttcttttctctggtttgctcctgtgtctctgcttactcaggctctcatcggctacgctggcttccaggcccatctcaaatggctccagcaagaaggcgctgtcaacca

SEQ ID NO: 139511 - DNA, 601 bp, Human
aggcaggggtgttgagggagaggcactgtgccaagcactgccagggttctaaagctgcctcaggtgtggagtgcccctcaccaggcacccaacttctccctccctcttaatgtagccatctacttgaggcgttttgttctggcttctcaccttcaatattctttcctggggcctcaccacttccaagactcagctattaggtcctgagcccacagcccaatgtgtaaaaggatgcctggtttttagttccctcccatcacttccagggtgactttgttcccctgcctattattccctctaytgtaagccctagaggctagctaaccttcaatcacaggtgtgattacaggattgcaggtgtgagccaccaccccagccccttgctacctctaaggcatgtttcccccttgccgccgtcttaatgattgtaacggtctcttcatgaatccctaccctcccctgctcaaaaacctttaatggctattgtccagctcaagggtgaagtccagagccttccaaggccttcaaggccccacgctacatttccagcctcattgtcatttgctccctctcccctatcccatccttcactccagaccag

SEQ ID NO: 139512 - DNA, 601 bp, Human
ttgaattaattagaagctcttgtcacttctttagtacccacttcacagaagcattttattgtgctgcttagagacatgttgcccacaactgtgttttctgctctctggggagcattttaaccagcacttctggttatttggtcctattctttttcaaactgtggaaccacccctttggatactgatttataaggtaagaccagccattaaattaaagatcacagctatagaggtacattccacctggaccagagaaaccaagatcccataagcgctttgttgctgttgcccaggtgcaggmgggtgggctggttcctgacgtctgtctctctgatctaagctccaggtcctggtctctgtcctgctcttactctgggcccatagcaaggacttgtacctggttctcagttccagcctttcccttccagggtgactttgttcccccatctgtttttctctcaaaggtatctttgctctcccttctcacagcttaaaatcatgttgttttcatagttaaaaagaaaatataactacatcctactgaagcagccccctcctccttcactacctgcaaacatggaatccttttcccctctccttc

SEQ ID NO: 139513 - DNA, 601 bp, Human
atacatttcacagagcaggagctaagctagatttgaattaattagaagctcttgtcacttctttagtacccacttcacagaagcattttattgtgctgcttagagacatgttgcccacaactgtgttttctgctctctggggagcattttaaccagcacttctggttatttggtcctattctttttcaaactgtggaaccacccctttggatactgatttataaggtaagaccagccattaaattaaagatcacagctatagaggtacattccacctggaccagagaaaccaagatcccayaagcgctttgttgctgttgcccaggtgcaggagggtgggctggttcctgacgtctgtctctctgatctaagctccaggtcctggtctctgtcctgctcttactctgggcccatagcaaggacttgtacctggttctcagttccagcctttcccttccagggtgactttgttcccccatctgtttttctctcaaaggtatctttgctctcccttctcacagcttaaaatcatgttgttttcatagttaaaaagaaaatataactacatcctactgaagcagccccctcctccttcactacc

SEQ ID NO: 139514 - DNA, 601 bp, Human
ggcaccactgcacttcagcctggacaacaaactaataaaactatctgtagtatgatcaattgtacaaacaaagaggagaagaaatacagaaaatattagtaatggctataactgattgatggaaccatggaccatttacattttctttgtcatgctttattattttccaaaatgtccgtgttgagcatatatacattatttatgtaatctgatgaaataaatattgaagctattccttaaagccaatacacaagcaggatacatttcacagagcaggagctaagctagatttgaattaatyagaagctcttgtcacttctttagtacccacttcacagaagcattttattgtgctgcttagagacatgttgcccacaactgtgttttctgctctctggggagcattttaaccagcacttctggttatttggtcctattctttttcaaactgtggaaccacccctttggatactgatttataaggtaagaccagccattaaattaaagatcacagctatagaggtacattccacctggaccagagaaaccaagatcccataagcgctttgttgctgttgcccaggtgcaggagggtgggctg

SEQ ID NO: 139515 - DNA, 601 bp, Human
atataaataaattagccaggtgtggcgggtgtatgcctgtgttcccagctacttgggaggatgagttaggaggatgacttgagcccaggagctgaagattgcaatgagctgccatggcaccactgcacttcagcctggacaacaaactaataaaactatctgtagtatgatcaattgtacaaacaaagaggagaagaaatacagaaaatattagtaatggctataactgattgatggaaccatggaccatttacattttctttgtcatgctttattattttccaaaatgtccgtgttgagyatatatacattatttatgtaatctgatgaaataaatattgaagctattccttaaagccaatacacaagcaggatacatttcacagagcaggagctaagctagatttgaattaattagaagctcttgtcacttctttagtacccacttcacagaagcattttattgtgctgcttagagacatgttgcccacaactgtgttttctgctctctggggagcattttaaccagcacttctggttatttggtcctattctttttcaaactgtggaaccacccctttggatactgatttataaggta

SEQ ID NO: 139516 - DNA, 601 bp, Human
aaatatatatataaataaattagccaggtgtggcgggtgtatgcctgtgttcccagctacttgggaggatgagttaggaggatgacttgagcccaggagctgaagattgcaatgagctgccatggcaccactgcacttcagcctggacaacaaactaataaaactatctgtagtatgatcaattgtacaaacaaagaggagaagaaatacagaaaatattagtaatggctataactgattgatggaaccatggaccatttacattttctttgtcatgctttattattttccaaaatgtccrtgttgagcatatatacattatttatgtaatctgatgaaataaatattgaagctattccttaaagccaatacacaagcaggatacatttcacagagcaggagctaagctagatttgaattaattagaagctcttgtcacttctttagtacccacttcacagaagcattttattgtgctgcttagagacatgttgcccacaactgtgttttctgctctctggggagcattttaaccagcacttctggttatttggtcctattctttttcaaactgtggaaccacccctttggatactgattt

SEQ ID NO: 139517 - DNA, 601 bp, Human
atggaattgacagtgccactttcaaagaatatttagtgacaggggaaaatgctcataatatacatttaaaaaataggctaaaaactgtatttgtaggccaggtgcagtggctcacacccataaccccagcattttgggaggccgaggtgggaggatcactagagcagaggagttcaagaccaacctgggcaacagagcaagaccccgtctctacaaaaaatatatatataaataaattagccaggtgtggcgggtgtatgcctgtgttcccagctacttgggaggatgagttaggaggatsacttgagcccaggagctgaagattgcaatgagctgccatggcaccactgcacttcagcctggacaacaaactaataaaactatctgtagtatgatcaattgtacaaacaaagaggagaagaaatacagaaaatattagtaatggctataactgattgatggaaccatggaccatttacattttctttgtcatgctttattattttccaaaatgtccgtgttgagcatatatacattatttatgtaatctgatgaaataaatattgaagctattccttaaagccaatacacaagcaggata

SEQ ID NO: 139518 - DNA, 601 bp, Human
gcagtggctcacgcctgtaatcccagcatttggggaggccaaggtgggaggatcacctgaggtcaggagtttgagaccagcccgggcaacaggatgaaaccctgtctctactaaaaatacaaaaatcagccaagcgtggtgatgaacacctgtagtcccagctactggggaagctgaggcaggagaatcgcttgaacctgggaggcggaggttgcagtgagccaacatcacaccactgcactcccacctgggtgaccaagcgagactctgtctcaaaaataataataataataataataaagataagaagcattatgtagtgaatacataaaccagcagcatagtctttatcattattattaggtactatatattaaatgtaagtgtcatacttttagacaacccgcctcagccttccaaagtgcttggattacaggtgtgaaccaacacacccggctgctactaaataaaattaaacgtgaggaagtttaaaatatgaacaaataagcaattagggaaaaaaccaataggatgcagttatatgtctttttaagatatggaaacaacatgattttaagctgtgaaatcagagagtcagctg

SEQ ID NO: 139519 - DNA, 601 bp, Human
gtctaggcctacagattcaggatgctcaatatcattgtcttccacctcctcatcttttttttttgagacagtgtctcactctgtcacccaggctggagtgcagtggcaccattacaactcactgcagcctcaacttcccaggctcaagcaatcctcctgcctcaaccttccaagtagctgggactacaggtgtgcaccaccatggtggttaattttttctttttttttttttttggaagagacaggtctcatgatatttcccaggctggtctcagactcctgggctcaagcaaccctcccrgcttggcctcccaaactgctgggattgcaggcatgagccacagcacctagccccacctccgacatcttgtcctctggaaggtgttcagggacagtaacacacacggagctgctatctcctgtgatgacaatgccttcttctggaatacctcctgaaggaccgccctgaagctgttttacagttaacattttttttttacagtagaaggaatacactctaaaataatgatgggggccagacgcagtggctcacgcctgtaatcccagcatttggggaggccaaggtgggaggatcacctga

SEQ ID NO: 139520 - DNA, 601 bp, Human
tctgcccgcctcagccttccaaagtgctgggattataggcgtgagccaccatgcccagcgtactgtaacttttttactttataaactaaattttttaaacctttctgactcttttgtaataacactttaaacacaaatacattgtacagctgtacaaaaatattttctttttcaatgtccttattctatatgctttcttctatatttaatttctttttactttttaaacttttttgttaaaaactaagacacaaacacacacctttgtctaggcctacagattcaggatgctcaatatcaytgtcttccacctcctcatcttttttttttgagacagtgtctcactctgtcacccaggctggagtgcagtggcaccattacaactcactgcagcctcaacttcccaggctcaagcaatcctcctgcctcaaccttccaagtagctgggactacaggtgtgcaccaccatggtggttaattttttctttttttttttttttggaagagacaggtctcatgatatttcccaggctggtctcagactcctgggctcaagcaaccctcccggcttggcctcccaaactgctgggattgcaggcat

SEQ ID NO: 139521 - DNA, 601 bp, Human
aaaccactcagcaccaacttttcgtgttaacagagtaggtgtttctgctggacctaacagtgactacagctgagaaggtaccacgtgaaaggggcaaggaggacaggagggggggggatgaaggaaaagcaaggtaaacgttgggtggctatctaagtgggaaccaccgcccccatatgttgattgtcttctgagggtaagaacaatatgggagtgtgctgtgaaaaaatagggctgctcaaaaccctccttgagagaagggaccagaccttacttatcccccatcctcaaggcggctgcygaggaataaatgaactcactgggtaactactctggaaagctctgctgggcaatcaatgcttggtcaagccttttagctgaaatccacagaacatgactaacagaatcaaacctcccggctgtttccctgtagttcaagcgagaatgaggtttccccgagaatgaggtcaggtaagcgggactgagcagggtcacttgtgagccaaggatgtgagggcccagcccctgaggcccctgcccacccatacagcaagggccacctggaaacctccgcagggacaggtatttgcaggcaaagtcg

SEQ ID NO: 139522 - DNA, 601 bp, Human
gtttgagaccagcctgggcagcatagtgagagcttgtttctacaaaaaaacaaaaaattagctaggtgcagttgtgcctgcctgtagtaccagctacgtgtaaggctgaggtgggagaatcatttgagcccaggaggtcaaggctgcagtgagccgagatcacatcactgcattccagcctgggtgacggagtgagaccttttctcaaaaaaaaaaaaaaaaaaaaaaaagaggtagaaaatcctattcatgggtaggtaaacatagggaaaaaatgctgaaacagaatagtaagtggaaygttcaaggggaaaatcattagactaagtttttatcaactattaataccaggactcttaaatgctcagctgaggattgcttgagcttgggagttggagaccagcctgggcaacaaagcaagaccctatcctacaaaatatttaaaaattagccaggtgtgtggcagacatctgtagttccagctacttgggaggctgaggtgggagaatcgcttgatcccaggaggttgaggctgcaatgagctatgataatgtgactgtactccagcctgggtaataaagcaagaccgtctcttaaacaa

SEQ ID NO: 139523 - DNA, 601 bp, Human
agccacttaccataatcctggagtctcttggccacatccacagcctcaatatttgcagactttttgaagggtctcgtgtccaaaataaattcatgacccacataacctgttcaggaaagttgtttcagcccaagattagcatcagcttattgttttacccaaacaaatgaataagtaatttaataaataagtgcatcagctttttatgtgtatcagcgaggaccaagaagccatgggcaccgggtaagtttattattggcaataaaggtttcatttagtcttattacaaataaaaatgttyagcacactgtgccgatgtgtcttatcttcagctcactacacacctgtgaacctgattatggctaatggcaggtggggggcattactgaacatatgaccggaggtgtctggggatgagattatttctattctgcggacataaaatctacttgcaacagttaaatgtgttgtatagtcctgatccttttatacaaaatatttctagagccattgacacttttcagcaactttaccctcaacatcaaataattacttttgcgtatatataggtatggatatattaaacatatatccataagac

SEQ ID NO: 139524 - DNA, 601 bp, Human
ccttgatattattatcattttcatattattataatagtaatattggctgggcgtgctggctcacacctgtaatcccagcactttcggaggccgaggtgggtggattgcctgagctcaggagactgagaccagcctggccaacatggtgaaaccccatctctactaaaaatataaaaaaatagctgggtatggtggtgtgcacctgtagtcccagctacgtgggaggctgaggcatgagaatcacttgaacccaggaggtggaggttgcagtgagctgagatcacatcactgcactccagcstgggcgacaaagtgagactctgtctccccaacccccaaaaaagtaatatggtcttaatattttaatattaataacattgttcactaggaaaatgtagtgagctgagctgaatgaacacccactaatgcacaggtaaagtgtccgtgtctttcaaaatgcttcaaagaaagttgcattttctttgtgaaaactactacacttatttcttcatctctagaagcagctgaaacagctacgccatgacagaggtggctataaaactccaatgccatttgtctctaccacttcgatgggttactt

SEQ ID NO: 139525 - DNA, 601 bp, Human
aaggcatccacaaagtgagtgtgttttcctgagtcggccattacccaatcgctagccgggaggctgtcaggggaaaggagttctactgtcaggttacaagagttgccaagcagagatcttgaggatgggattggtaatttcattaatgaagcctttctctggctttcccatctattatcagtgtaactgcataataagatcattcattcaagagaggagtgagtcacacacatgggattcccattatgatgcagtagtgaaactattaaatttaaaagatttttttctttttttccaaaarcaagtcattaaaactcagagaggactccatatccattgaatggcaatgttctccccaacttagcctttctgagaattgaaagatccttgatattattatcattttcatattattataatagtaatattggctgggcgtgctggctcacacctgtaatcccagcactttcggaggccgaggtgggtggattgcctgagctcaggagactgagaccagcctggccaacatggtgaaaccccatctctactaaaaatataaaaaaatagctgggtatggtggtgtgcacctgtagtcccagct

SEQ ID NO: 139526 - DNA, 601 bp, Human
acctgagaagttcttgcaaaagaaattcctgcatctggaccctgattcaggaagtccaaggtagggtccaaaaatctatgagtcataaaacatgccaggtgattctgataattggtctgataattagcctggaactgctgggtaaggcagtatgccccaaaattgcctgaaaagactcacacagaagctgcgtgttaaatatacagattatcagctctcttccttaaaaattcacattcagcggttatgctttaagacctggaaactgtgttgtcatgttcattgtttttcgacttagctrttcatttggtctctcatttattaacactatgtgttgagtgcctactatgtgccaggcacctggacaattctgggcttttggacaagtgtggaaacggttctatcaatcttcaaaacaacattgaggtcaggagacaacatgattcagaaacactgggtggtgacttcagttaccacctccctgtgagcccctcctctctctccttgcaaatgctgttgcagttagatgtgtgaagtaggcaaggcatccacaaagtgagtgtgttttcctgagtcggccattacccaatcgctagccggg

SEQ ID NO: 139527 - DNA, 601 bp, Human
cccttcagcatatatatcatgactagaattcagtatctgttcacatatttttgtgataaaacttacagtgaaatgcacaaatcctaactgtaccatttaatgagttttggtaaatgcatacacctttgtcactcaaaccagacagggattttttttttttttaagagaacaagctgattacctatcacgtctgcccttaattccatgtgtgagcaaattcagtccaacatatcctgctgtagtggtccccatattttgaaccacctgagaagttcttgcaaaagaaattcctgcatctggrccctgattcaggaagtccaaggtagggtccaaaaatctatgagtcataaaacatgccaggtgattctgataattggtctgataattagcctggaactgctgggtaaggcagtatgccccaaaattgcctgaaaagactcacacagaagctgcgtgttaaatatacagattatcagctctcttccttaaaaattcacattcagcggttatgctttaagacctggaaactgtgttgtcatgttcattgtttttcgacttagctattcatttggtctctcatttattaacactatgtgttgag

SEQ ID NO: 139528 - DNA, 601 bp, Human
atatcatcatatgagtggtattatccacttgtattataactcactattatgctctttgaaatgtttattgccatttaaaaaaatagcctaaatcctgaaagaagcaggtgtcttcagagagaaaagagtaataaacggtggtaagcataatcatcttgtatgcctccatgactctgtgaactcacctctagagaggtgcctgccttctgcaagtcactggtccctgccctctcctacaggtaggcagtttggaaacctgccccagctgctgcagtcatatcagacttgttctctggcttayagccatgaagacacaaccacagccttcatggtattctccactcctgatcttccagcttaatatctggactaacaagaaacttaggactctgaccagatgtaaaattaacatgttttggaagcggcagagtaatgcccaaccaacttttccccaacatggggcataaacattgtaacatccagtccaaatgtcaatccagttttctcagagataactgctctaatataagaatgtgtgcttgtacagagtttgtgatgtgaatatgtaaattttatttatgccataatctcactacagtac

SEQ ID NO: 139529 - DNA, 601 bp, Human
gcaatacactctcttctcctcctaccctgcacctcaaccgtcaatcttctgacaggagcccaggcagagaaagctgttgttttctttcaatttaggggggtacaatgtgatttataattgtgaaatattttaaatatcagaacgttatggtaataatcatcacatccaccacccagtaaagtctaatgagcattctgtcatatttgcttcatcttttagaaaaaattacctacacgtttggtgctgcctgtatatccccatcccagtgctaaccactcttctgaattcggtgtttaccatyctcatcatgcttttatactattactgcatatgttaataaactgcatatagcataatttggctcattttaaaatctgatatcatcatatgagtggtattatccacttgtattataactcactattatgctctttgaaatgtttattgccatttaaaaaaatagcctaaatcctgaaagaagcaggtgtcttcagagagaaaagagtaataaacggtggtaagcataatcatcttgtatgcctccatgactctgtgaactcacctctagagaggtgcctgccttctgcaagtcactggtccc

SEQ ID NO: 139530 - DNA, 601 bp, Human
aggaggggtcagagcaatacactctcttctcctcctaccctgcacctcaaccgtcaatcttctgacaggagcccaggcagagaaagctgttgttttctttcaatttaggggggtacaatgtgatttataattgtgaaatattttaaatatcagaacgttatggtaataatcatcacatccaccacccagtaaagtctaatgagcattctgtcatatttgcttcatcttttagaaaaaattacctacacgtttggtgctgcctgtatatccccatcccagtgctaaccactcttctgaattyggtgtttaccattctcatcatgcttttatactattactgcatatgttaataaactgcatatagcataatttggctcattttaaaatctgatatcatcatatgagtggtattatccacttgtattataactcactattatgctctttgaaatgtttattgccatttaaaaaaatagcctaaatcctgaaagaagcaggtgtcttcagagagaaaagagtaataaacggtggtaagcataatcatcttgtatgcctccatgactctgtgaactcacctctagagaggtgcctgccttctgca

SEQ ID NO: 139531 - DNA, 601 bp, Human
gatgtaacgcaggtcagggagtgtggagacatctgagacagagacacggacagaggaggggtcagagcaatacactctcttctcctcctaccctgcacctcaaccgtcaatcttctgacaggagcccaggcagagaaagctgttgttttctttcaatttaggggggtacaatgtgatttataattgtgaaatattttaaatatcagaacgttatggtaataatcatcacatccaccacccagtaaagtctaatgagcattctgtcatatttgcttcatcttttagaaaaaattacctacaygtttggtgctgcctgtatatccccatcccagtgctaaccactcttctgaattcggtgtttaccattctcatcatgcttttatactattactgcatatgttaataaactgcatatagcataatttggctcattttaaaatctgatatcatcatatgagtggtattatccacttgtattataactcactattatgctctttgaaatgtttattgccatttaaaaaaatagcctaaatcctgaaagaagcaggtgtcttcagagagaaaagagtaataaacggtggtaagcataatcatcttg

SEQ ID NO: 139532 - DNA, 601 bp, Human
tcagattcagagaacttacgagtgggaatgctgccacctctctggaataaggccggtcccagtgggaagatgtaacgcaggtcagggagtgtggagacatctgagacagagacacggacagaggaggggtcagagcaatacactctcttctcctcctaccctgcacctcaaccgtcaatcttctgacaggagcccaggcagagaaagctgttgttttctttcaatttaggggggtacaatgtgatttataattgtgaaatattttaaatatcagaacgttatggtaataatcatcacatcyaccacccagtaaagtctaatgagcattctgtcatatttgcttcatcttttagaaaaaattacctacacgtttggtgctgcctgtatatccccatcccagtgctaaccactcttctgaattcggtgtttaccattctcatcatgcttttatactattactgcatatgttaataaactgcatatagcataatttggctcattttaaaatctgatatcatcatatgagtggtattatccacttgtattataactcactattatgctctttgaaatgtttattgccatttaaaaaaatagccta

SEQ ID NO: 139533 - DNA, 601 bp, Human
tctgaaagccaatttctttgctcctcattcctcttcaagacccttatttcacaaggtgccccacatatggtttctgtaatcatgaggctaagagcgtacacccgtcaggataggagctggcccatgccttcccagctggcacattcagattcagagaacttacgagtgggaatgctgccacctctctggaataaggccggtcccagtgggaagatgtaacgcaggtcagggagtgtggagacatctgagacagagacacggacagaggaggggtcagagcaatacactctcttctcctccyaccctgcacctcaaccgtcaatcttctgacaggagcccaggcagagaaagctgttgttttctttcaatttaggggggtacaatgtgatttataattgtgaaatattttaaatatcagaacgttatggtaataatcatcacatccaccacccagtaaagtctaatgagcattctgtcatatttgcttcatcttttagaaaaaattacctacacgtttggtgctgcctgtatatccccatcccagtgctaaccactcttctgaattcggtgtttaccattctcatcatgcttttatactatt

SEQ ID NO: 139534 - DNA, 601 bp, Human
gagcgagactccgtctcaaaaaaaaaaaaaaaaaaagaaagaaaaaaaaagcatcattttgtttcctctcctctccaatgaatacaggatttaccattctcattatgtttttatactattactgcatagatccataaacagcacatagcataatttggcacatttttagccttctccctacctcactcaaacagactacacagaaccttctcctccatataagaatcagaaaggaaaggaaggttgcactgggcgccatctccctgtcccacagtggagggaaacacattggtccactggrcaggactcgtattcagttttcccccactctgttccctatgggttcccagatctgtggttgatactgtgtgacctcgcctctgaaagccaatttctttgctcctcattcctcttcaagacccttatttcacaaggtgccccacatatggtttctgtaatcatgaggctaagagcgtacacccgtcaggataggagctggcccatgccttcccagctggcacattcagattcagagaacttacgagtgggaatgctgccacctctctggaataaggccggtcccagtgggaagatgtaacgc

SEQ ID NO: 139535 - DNA, 601 bp, Human
tcatgccactgcactccagcctgggcaacagagcgagactccgtctcaaaaaaaaaaaaaaaaaaagaaagaaaaaaaaagcatcattttgtttcctctcctctccaatgaatacaggatttaccattctcattatgtttttatactattactgcatagatccataaacagcacatagcataatttggcacatttttagccttctccctacctcactcaaacagactacacagaaccttctcctccatataagaatcagaaaggaaaggaaggttgcactgggcgccatctccctgtcccwcagtggagggaaacacattggtccactgggcaggactcgtattcagttttcccccactctgttccctatgggttcccagatctgtggttgatactgtgtgacctcgcctctgaaagccaatttctttgctcctcattcctcttcaagacccttatttcacaaggtgccccacatatggtttctgtaatcatgaggctaagagcgtacacccgtcaggataggagctggcccatgccttcccagctggcacattcagattcagagaacttacgagtgggaatgctgccacctctctggaat

SEQ ID NO: 139536 - DNA, 601 bp, Human
tgaggtcagaggttcgagaccagcctgatcgacatggagaaaccccatctctactaaaaatgcaaaattagccaggcatggtggcacatgcctgtaatcccagttacttgggaggctaaggtaggagaatcgctttaacctgggaggcagaggttgtggtgagccgagatggtgccattgcactccagcctggacaacaagagtaaaactctatctcaaaaaaaaaaaaaagttaatttctcatactgtgtattaaaataaaaatttgaacgattaaaaaaaaagcatcagctgggcgtgrtggctcacgcctgtaatcccagcactttgggaggccggggtgggcggatcacgagttcaggagatcaagaccttcctggctaacacagtgaaaccccgtctctactaaaaatacaaaaaattacccgggcatggtggcaggcgcctgtagtcccagcgggaggctgaggtaggagaatggcgtgaacccaggatcatgccactgcactccagcctgggcaacagagcgagactccgtctcaaaaaaaaaaaaaaaaaaagaaagaaaaaaaaagcatcattttgtttcctctcctctcca

SEQ ID NO: 139537 - DNA, 601 bp, Human
gctgaggtcagaggttcgagaccagcctgatcgacatggagaaaccccatctctactaaaaatgcaaaattagccaggcatggtggcacatgcctgtaatcccagttacttgggaggctaaggtaggagaatcgctttaacctgggaggcagaggttgtggtgagccgagatggtgccattgcactccagcctggacaacaagagtaaaactctatctcaaaaaaaaaaaaaagttaatttctcatactgtgtattaaaataaaaatttgaacgattaaaaaaaaagcatcagctgggcgygatggctcacgcctgtaatcccagcactttgggaggccggggtgggcggatcacgagttcaggagatcaagaccttcctggctaacacagtgaaaccccgtctctactaaaaatacaaaaaattacccgggcatggtggcaggcgcctgtagtcccagcgggaggctgaggtaggagaatggcgtgaacccaggatcatgccactgcactccagcctgggcaacagagcgagactccgtctcaaaaaaaaaaaaaaaaaaagaaagaaaaaaaaagcatcattttgtttcctctcctctc

SEQ ID NO: 139538 - DNA, 601 bp, Human; identical to SEQ ID NO: 20538

SEQ ID NO: 139539 - DNA, 601 bp, Human; identical to SEQ ID NO: 20539

SEQ ID NO: 139540 - DNA, 601 bp, Human; identical to SEQ ID NO: 20540

SEQ ID NO: 139541 - DNA, 601 bp, Human; identical to SEQ ID NO: 20541

SEQ ID NO: 139542 - DNA, 601 bp, Human; identical to SEQ ID NO: 20542

SEQ ID NO: 139543 - DNA, 601 bp, Human; identical to SEQ ID NO: 20543

SEQ ID NO: 139544 - DNA, 601 bp, Human; identical to SEQ ID NO: 20544

SEQ ID NO: 139545 - DNA, 601 bp, Human; identical to SEQ ID NO: 20545

SEQ ID NO: 139546 - DNA, 601 bp, Human; identical to SEQ ID NO: 20546

SEQ ID NO: 139547 - DNA, 601 bp, Human; identical to SEQ ID NO: 20547

SEQ ID NO: 139548 - DNA, 601 bp, Human; identical to SEQ ID NO: 20548

SEQ ID NO: 139549 - DNA, 601 bp, Human; identical to SEQ ID NO: 20549

SEQ ID NO: 139550 - DNA, 601 bp, Human; identical to SEQ ID NO: 20550

SEQ ID NO: 139551 - DNA, 601 bp, Human; identical to SEQ ID NO: 20551

SEQ ID NO: 139552 - DNA, 601 bp, Human; identical to SEQ ID NO: 20552

SEQ ID NO: 139553 - DNA, 601 bp, Human; identical to SEQ ID NO: 20553

SEQ ID NO: 139554 - DNA, 601 bp, Human; identical to SEQ ID NO: 20554

SEQ ID NO: 139555 - DNA, 601 bp, Human; identical to SEQ ID NO: 20555

SEQ ID NO: 139556 - DNA, 601 bp, Human; identical to SEQ ID NO: 20556

SEQ ID NO: 139557 - DNA, 601 bp, Human; identical to SEQ ID NO: 20557

SEQ ID NO: 139558 - DNA, 601 bp, Human; identical to SEQ ID NO: 23906

SEQ ID NO: 139559 - DNA, 601 bp, Human; identical to SEQ ID NO: 23907

SEQ ID NO: 139560 - DNA, 601 bp, Human; identical to SEQ ID NO: 23908

SEQ ID NO: 139561 - DNA, 601 bp, Human
agctgggactatgggtgtgcatcaccacacgtagttaacgaaaattttttttttttgtagagacaaggtcacgctatgttgctcaggctggtcttgaactcctggcctcaagtgatcctcttgccttggtctcccaaagtaacttatcgttgcaattactggtggtcaaatgagaatttaatccatgttttctgaaatatgagaactttagtttacaaaaagttgaaaatgaaaagaagcttagaatgaggaaagatttggagttctcaatacacagaaatgaagggcaaaactttttctrgatataattttctaccattaggcttgtaaaaatatgtatatatagatacacacatacatatatataaaatgctaaaatgtatttgtaagtataggattgactttagctttttaaacacagtggatggtttaggcaaaattattaactccctacacaatttttgtgaatacctttaagtgtgaaaaaagataagatacaagataaaggaaacttacattaaaaaaatagaaaatgatcttttttgtcacaacttcagttttttttttttttttttgcttttaggtatgtaatgtgggtttg

SEQ ID NO: 139562 - DNA, 601 bp, Human
tatcgttgcaattactggtggtcaaatgagaatttaatccatgttttctgaaatatgagaactttagtttacaaaaagttgaaaatgaaaagaagcttagaatgaggaaagatttggagttctcaatacacagaaatgaagggcaaaactttttctagatataattttctaccattaggcttgtaaaaatatgtatatatagatacacacatacatatatataaaatgctaaaatgtatttgtaagtataggattgactttagctttttaaacacagtggatggtttaggcaaaattattractccctacacaatttttgtgaatacctttaagtgtgaaaaaagataagatacaagataaaggaaacttacattaaaaaaatagaaaatgatcttttttgtcacaacttcagttttttttttttttttttgcttttaggtatgtaatgtgggtttgagtgggtcacagttgaactcaataaaatgctttttttgtgtgtgtagaagagaagttctgacttttagtgtgtagatggaactttatcacagtggcctccaaattttttgatcacgtatccccaccaaaaaaattttttttgaa

SEQ ID NO: 139563 - DNA, 601 bp, Human
gagtgtagacccacggagtgccagtgacaatactgtgggacacggcagccaggtagacagctggagagcaccatctttccccttttctgggaagcccagctgtcttcttaggttttctgtgactcctggctgcctcaccttgggctttttgagcacacacacagtgcgtgggcaggaatagacttgtcaccactgccatacagctgcacatcttgccgacagtccagtcatggagtcccagtcaggcaaagggcaatgaaagaaagggtaaaatggctcttcttccgtgtgtgcttgagargcacacatcttctctcgtgaagagtgcccaggcttggaaactgctccaaggaagggtggctgtgagagacacttttccgtattatgctttccttgcggaaacgtcttcagctgcttccttgccttcctagtcttctgtctccaatccattctccacactgatggcagaagtaccttcaaaacccagacaggagtgtcacttgtgcacagagatcccttcaaattcttgcttttgaaggatacagcccacgttctttaatgtggcacccaatgcttaggatgaaccgctgcctggatctgc

SEQ ID NO: 139564 - DNA, 601 bp, Human
tttttttggtttcctaacacacagctatggctcttgtacatagtaggtgctcgatgaacgctcattgggttgaactgatttaaaaattatgattatttttgtcccgcattggatgcatagatgtggcctcacagtatctcgcttgtatggctgctgtgtacttaggtctccagttgaaggaggaatcaccatcttccatttctatgcataattggcctgtgtgtgcctgtgttgtctctggtgtgtgtggcctgagggggaatgaggctgaagctggaggaaagataatgtagtgtcaagrgcatggttaactctcattctgtatctgctacgaagtaggcaccaggccctctttctcctcttctgtaagatgaagagctcgagttagacatctggaatgtttcttcccagtctggatggatcccaagaattctgtagtttgaatttctcagccttctttctcaagtcttctctgtgtgacccatgatgttctctgtgcacacaaaatgtttgtgcagtgagacctttttgtctcttttgtaaggagctgggagggaggctcctgggcagcaggttatttccctttggtctgttcctccag

SEQ ID NO: 139565 - DNA, 601 bp, Human
tcctcaggggctggaatctcatatttcccactgggtttgtggttatcatgcctcgtgtggcagtgagaatgaggagtgactaaaatatctcattttcattgtgatgagattgagagaaggaaagaaacgggcaatggttgtgttactaaatacactaacatttggagcctccaggaatctttatctgtgtgaagttgcatgaagctcagtaaactaaattggagattttttttttctaaacggttagaaactgatctcattacgaaagaaggtaaataggagatttggggaaatcactttygtaaagtaaatgtgtaaatgtgaaattcatttaaagcgtattttcctattttgggattaattttctcttttcatctatgtagtttttgtttgcttgtttttgtcttcaggtttaccttgagagtagatctaaaaggtcagaggtaaatgggttaatacttcttcagaaaaatatacaggattctgatatcctattagaatgtggaaataagaaaaactatattgctaatgagtataacgatttgattagaaggagaatatgaataattttaacttggggatggtgtttgattattgtatt

SEQ ID NO: 139566 - DNA, 601 bp, Human
cctcaggggctggaatctcatatttcccactgggtttgtggttatcatgcctcgtgtggcagtgagaatgaggagtgactaaaatatctcattttcattgtgatgagattgagagaaggaaagaaacgggcaatggttgtgttactaaatacactaacatttggagcctccaggaatctttatctgtgtgaagttgcatgaagctcagtaaactaaattggagattttttttttctaaacggttagaaactgatctcattacgaaagaaggtaaataggagatttggggaaatcactttcrtaaagtaaatgtgtaaatgtgaaattcatttaaagcgtattttcctattttgggattaattttctcttttcatctatgtagtttttgtttgcttgtttttgtcttcaggtttaccttgagagtagatctaaaaggtcagaggtaaatgggttaatacttcttcagaaaaatatacaggattctgatatcctattagaatgtggaaataagaaaaactatattgctaatgagtataacgatttgattagaaggagaatatgaataattttaacttggggatggtgtttgattattgtattc

SEQ ID NO: 139567 - DNA, 601 bp, Human
ttttctaaacggttagaaactgatctcattacgaaagaaggtaaataggagatttggggaaatcactttcgtaaagtaaatgtgtaaatgtgaaattcatttaaagcgtattttcctattttgggattaattttctcttttcatctatgtagtttttgtttgcttgtttttgtcttcaggtttaccttgagagtagatctaaaaggtcagaggtaaatgggttaatacttcttcagaaaaatatacaggattctgatatcctattagaatgtggaaataagaaaaactatattgctaatgrgtataacgatttgattagaaggagaatatgaataattttaacttggggatggtgtttgattattgtattcacgtgataatttgtccatgtatccgttcattcatttgcttatttatttcctatttatagctttgactcatccagcactgtgatgagtgcaaagcaatgaaacagatagctatacttgtaaataattcagggcagtgtgaaatttcccatagtagaggaatggacagatgttttggcatcccagaggagtgtttaaataactgcttggggaggttgagcggtagcatttaa

SEQ ID NO: 139568 - DNA, 601 bp, Human
tgcttggctttcaagatactttaaaacatcaagaataattgaccataataaatgcctccttaaaaaagaatgccatgaaaaaattaatctccttcaagaagcttgcatttaacaaaaggaattgaccttttctttaaaaaacgtagctggtacaggtactaacattgtaaggatgttggaacatacagcatggagtctgcaaaagtgacactggaggatggcgcagagatgggggaggtgctaacatttctcgtttgtatccctttgtagcacttacattattttgcccagaattgtaatwcctgctggtctctttgttagatgaaattttttggagtcagagtctttggctttataatttttctatttcttgaagaccaggcagggcaatttatgtgcagttggcacatggtaaatgtttgttgacccaattattcactccgtcatgaacacgcacatgcagtgtctactgtacatgagcatcgaatagtgatagcactgatacagggttgtgaacttgtagagtcagggtgtttccacaggaattagtcagctactgaaactgaaaatgagagaggttaagtgacttgctcaaaggccc

SEQ ID NO: 139569 - DNA, 601 bp, Human
gcttggctttcaagatactttaaaacatcaagaataattgaccataataaatgcctccttaaaaaagaatgccatgaaaaaattaatctccttcaagaagcttgcatttaacaaaaggaattgaccttttctttaaaaaacgtagctggtacaggtactaacattgtaaggatgttggaacatacagcatggagtctgcaaaagtgacactggaggatggcgcagagatgggggaggtgctaacatttctcgtttgtatccctttgtagcacttacattattttgcccagaattgtaattmctgctggtctctttgttagatgaaattttttggagtcagagtctttggctttataatttttctatttcttgaagaccaggcagggcaatttatgtgcagttggcacatggtaaatgtttgttgacccaattattcactccgtcatgaacacgcacatgcagtgtctactgtacatgagcatcgaatagtgatagcactgatacagggttgtgaacttgtagagtcagggtgtttccacaggaattagtcagctactgaaactgaaaatgagagaggttaagtgacttgctcaaaggccca

SEQ ID NO: 139570 - DNA, 601 bp, Human
gaaaaaattaatctccttcaagaagcttgcatttaacaaaaggaattgaccttttctttaaaaaacgtagctggtacaggtactaacattgtaaggatgttggaacatacagcatggagtctgcaaaagtgacactggaggatggcgcagagatgggggaggtgctaacatttctcgtttgtatccctttgtagcacttacattattttgcccagaattgtaattcctgctggtctctttgttagatgaaattttttggagtcagagtctttggctttataatttttctatttcttgaagrccaggcagggcaatttatgtgcagttggcacatggtaaatgtttgttgacccaattattcactccgtcatgaacacgcacatgcagtgtctactgtacatgagcatcgaatagtgatagcactgatacagggttgtgaacttgtagagtcagggtgtttccacaggaattagtcagctactgaaactgaaaatgagagaggttaagtgacttgctcaaaggcccaaaacttgtagatgcagagtgaggaccagcctcatgctgactgcctcagaccagtactttgcagccgttcctagcc

SEQ ID NO: 139571 - DNA, 601 bp, Human
acacgtcctgtacaaagaatgcagttcacacaaaggagatgaataggttcatttccttagtaacctacctgataacaggcatgccctggagatgggtggttttcaacggatattttgagtaattgagcattgccttatgctgtgtttcatatgtgcgtgaccaattttcaaagaattgaataataattcttagacgatatggagggcagcttctgctgtatgactgagtccatacatcgtcctggttttagagacgaggaggtgagattttagtggcttagtgacttgttgaaggtcacayagatgatgacaagtcaggatttgaatgtaggtaaattagtaaatcttgtctgatacatatgcatgttaagagtggccatccatttttgtaaataaaaatatatttactagaattaatcacatgaatatttttaactggaattaaccatatagtggggcaaggttttaatatttcttacacagatgtgattttggaggattttttttttttttttccagtagcctagttttaacttagtggttcatttgtttccttagcatctatactgctggccattagttagtggacaatcgtctttta

SEQ ID NO: 139572 - DNA, 601 bp, Human
tatttcccccgggagcaatggttcagtattctaggagactttatagaacttaactacctcaaataaggagaatcagctgtacctacaaatgcaaatgtacttcctcatgtgggtgatcttagagctgattcaggaagaacttgcaacttcattgagggagtcagacatgtaaaccaagaattataatttggtgtgatgaatgttagaattataaacaaaaggggcttggagagcttgcaggagggagcttaattctaggagtaggagagaatgtcaggattattcacagaggagatggagwaaaacaggcaggtgttctcagtagagaaaccttttcagccaagaaggcaactttgctgcagggtttagaaacatggaggcttctggatgtctccggattctgtggtctttcctctgtccctgcctcatctgcctcatcttgtctctgcttctgtttatcctagttgctgccagaggcatctttgctgacatgtggagagtcctcccctgtcagcatcagcagcccctccggggctgtcgttcagcgtcctggcccgagagatgccctccatccttacaaagtggagtgggaaccactgtc

SEQ ID NO: 139573 - DNA, 601 bp, Human
tttggcagtggcctggtcgcctcacccctcccgactccccctcaccagggactgacttgaacttggtcagaaacatcatttgtcagccggctggcctggtgtgcctcagtggcactgtgacaaccggctgagaaaaatgtctgcatccctgacacccccgttgcagagggcttcccccgaggactaaaaggttatggtgctaagtgtgagagccacactcagagctgtcttcttcatgctgtctctaaatgcttacgatcctgacattaattgattcccttttaatcttttttttttttttgtaattcttcattgaaatctctgttgaagtttgctgcttctttgtaatgaagtgcccaaagcttaaatgcagtattctaagaacagacttgccaaggtcgtaccaaagacatccctgtccccatggtacatagcgtgattgttttgctgtagccctgaattatttttgcctatttagctgccatgttgcattgtgtgttcacacataatcagctgtccgctctcagctttaggttctcctgctctattcctttctttctccctccccactttgcttcctcccttccttttccccccttct

SEQ ID NO: 139574 - DNA, 601 bp, Human
tagcatgtctttcttgaatccttatttccttaattttacttctcagccttttagctttccatttctcctctgttgtctgccaatctgatccttcaagggcattctactctcagcttttactgagtaatgtttaatttgaagtattttcagcttttgcatatctttgatgtgcattttaagtgatcattgaattattttactactcttaccagacactagtctatgggggaaaaatgttatatgtgatttttttttcaacttgatgttgtaagatgttaaatttgatgaatttttcctgtargtttgtttatggaatgattaaatgtacattgactaaacattaacacaagcaaaaatacttctcaaagtaaatattaaactttgaaaacttgaattctattattccctgagcaagactttctttcctctgtgggagtacccctctgaacatgtgttaaaagtttatgagctaatatgatttgctaaacaaacattcatttttataggcagcttccaaggaagacctctcaattgtctagtttgtcctgtggtatatttggcaggttctgtccttggcagcagactgggtaccacatggttg

SEQ ID NO: 139575 - DNA, 601 bp, Human
tagaataaatgcaaacatgtggacaaaacgacaccacatgtttattaatatggaaattatgttttaaaataacagcatggcgtaagtctatacgttttcaataactattactaagtcttgacttttgaaacaactctggcttcattttttaagtgggcatagatacgaattgagcataatgttgcccatgtggattacactttttcaaattgtctaatatttttaaatagtgtcagtataagtttatgtgttataacattcctaagcattccctgggctgtactataattttcacattattatctcatactttggttttaataggatttggtaaaagttttgaagttttaatttcagtttttcccaccgcttggaatttgatgatataaaatgaaaagaggtttccatcgttgctaacatttaccggattttgttccaaagcatggactttagtagacttttgaattaaatccacattctccacccaagcctagtgatataatccaacagttcaaagataggtatgccataaacagctatagttaaataatctaaaaaaaaattaaaacatggaaacacaataaaacaagaattgatcact

SEQ ID NO: 139576 - DNA, 601 bp, Human
atgctggctgtagattatactgtttttcttttgtttgtttttgatttttagagacagggtctcactctgttgcccaagctatagtgcagtgtcacaatcacggctcactgcagcctcgactcaagtgaccttcctgcctcagcctcctgtgtagcttggactacaggtgtgcaccaccatgcccagctaattttttgttttgtagagatgggggtctcactatgttttccaggctggtcttgaacccctggcctcaagtgatatttctgcttgggccttccaaagtgctggggttacaggmataagctgctgtgcctggccaatgatactgtttgaaattgaataattggctttattttctgagttatgtgtgtgcgtgaacgatgctctaatagcctgctagggaaatagggcagtgttaactggcagtgaaaaggtcagttcaatttcttagcatatttacttttttaaaaggggggttttcgtattctttaaaaaagtataaaatgagaatcttttcttaagcactgaaaacaatttcatgtttcattcttagatagtgatacctctaccactgcggaattttgttcacgattgctat

SEQ ID NO: 139577 - DNA, 601 bp, Human
gaataattggctttattttctgagttatgtgtgtgcgtgaacgatgctctaatagcctgctagggaaatagggcagtgttaactggcagtgaaaaggtcagttcaatttcttagcatatttacttttttaaaaggggggttttcgtattctttaaaaaagtataaaatgagaatcttttcttaagcactgaaaacaatttcatgtttcattcttagatagtgatacctctaccactgcggaattttgttcacgattgctattttcctgccctctccactcattcctcctgcagataaatakaattattcaaaaattgcattttgaaatagacacataggactcttttttttttttttttgagacggagtctctctctgtcgcccaggctggagtgcagtggcatggtcttggctcactgcaagctccgccctcccgggttcacgccattctcctgcctcagcctcccgagtagctgggactacaggcgcccaccacctcgcctggctaatatttttgtatttttagtagagatggggtttcaccgtgttagccaggatggtctcgatctcctgacctcgtgatccgcccgcctcggcctcc

SEQ ID NO: 139578 - DNA, 601 bp, Human
ctcccgagtagctgggactacaggcgcccaccacctcgcctggctaatatttttgtatttttagtagagatggggtttcaccgtgttagccaggatggtctcgatctcctgacctcgtgatccgcccgcctcggcctcccaaagtgctgggattacaggcgtgagccactgcgcccggcccccacgtaagactctttttactatgcttagtgaaaagtgaaaagtggaagggcctggtcccaagagggtggtggctgtgctagggctcctggaaacttcttgctctggtggcttcattacrtaataacaagatcctgtggcacagaccaggcgcaaattgcttcacatctgggccttgctgtcccatgtattttaactggaaaagctgcatttgctgttttctaaggtttattcaggttctaagatgttaagatgttaatgtgatattaacaacactgttgttgactgggagcttcctcggtgttcagcactgctctctgattggatctctgtcacaaccctgcctcaagacacttattactaacctgttgtaaagatgaggttactgagacttggagaggtgagagaaccagttgtaaag

SEQ ID NO: 139579 - DNA, 601 bp, Human
cctgggtctgaatgacagaaacgaatgtccttatctgtatttgcttgttttcttatttatataaggcgccaggtaggtaagagaaaagaaactatttctaacaagttattttcgtgtttactgttttaaacactaaagatatcgattttaaaagtttcagttgaacagtgagaagagcaaaaaggccagtaagtcctgtcaccttatttctctaggggccagcttcaatgcacacatttttgcctggggcgtgttcacagctttgggatgtggtgtgtgtgtgtgtgtgtgtgtgtgtgttttatttttgttgttactgcccatgagttttgcaaccccaggagccctaggttgtggggttcaactgaaccccagctttcataaagctcgagtagagaggaagtgtagtccatctgggaagatgcagaacctttgtgatctggatcaatgcacgtttcttcttggtatctgtgaacctgagaatgtagcttttttagttaggggtctcttcttctatgtaaattcaaggaaaaggccggaatatttgcttttacgctggattcaggaaaactcagtcatgatagaagcattatgttttaaa

SEQ ID NO: 139580 - DNA, 601 bp, Human
taacctttttccatttgtaaaccctgtgttcgttgacttcctttcattttctacatgatacaaccaagtctcgtgtattccattcatatattttatgtgaagttagattttacataaatgtaatagtgtatataattgggaaacatttactaattaacaaatataaaatgtaagaaaagtgtttcagaagtgtgtatttgggtcttatattagaagcctttggaggaaagatatatcaaactctataaaagttataaactttttaatcttgttcaaattacctgtaatttggatgttttakcttatatgaaataacaggaatgagaaaaatggaagaattaggtggaatagcttttcttagtcaaaaaaatatcttcagaacctagaggtccagggcacttgcctttataatgttcctttatatgagtgaagaaagtagccttgtacataatataaacgtgtgtcatattaaacatgcttttattagttagcctgagtgtgtattactcataaatttgatttttggtggtgtttcagaaaaagagcaaactttttccatgaagggctagatattttaggctttgcagatcatatgttctct

SEQ ID NO: 139581 - DNA, 601 bp, Human
ataaatctgatttcaggccttagaaaaggcaaaagatgcaggaagaaaagagagagtcctggtgagacagcgagaacaagttacaactccagaaaatatcaatttggatttaacttactcagtaagtattgaaatataacacaatttttaaataaaattttgactagggttaatgggttccagagtcttttttcttttatttttaaaatcttactggtcttcaggtgctcacaattagattaataataatctttagttcataaaacactcttgtctttgttttgtgcaaagagctcttttmtttagttatttaactagttattttaggctgggtgcagtgactcacgcctgtaatcctaacaccttgggaggtcaaggtgggaggattactgagtgagctcagaagtttgcgaccagcctgggcaacatagtgagacctcgtctctatttattaaaaaatatgtagccgggtgccgtggctcacgcctgtaatcccagcactttgggaggccgaggcgggcagatcacaaggtcaggaaatcgagaccatcctggctaacatggtgaaaccccatctctactaaaaatacaaaaaattagc

SEQ ID NO: 139582 - DNA, 601 bp, Human
atctaaaatatcaaagagtggaaaaatgagagtattatacattcattaaatttttttaaattaggaatattgaaaatgaatatgggaaatatctatttaaagcaaagaaattattccaaagccattaaattctaccgaatggcattagaccaagttccaagtgtcaataagcaaatgaggtaagtttataacaatagataataattgtaaaatttaagtgtttttctgaaacaagataactcttctgacctgttttcagtgggttgaacatttcaaagtgtttgtacatgagatttatacrtgtagtattttgatctgttcccttcttactacttgtacacatttttataatgacaagttaaaggttaaagcattgtatatgatcatatgaaataaaactaagtgaccaataaaggggttaaccctgaaggccattactaccctgatataacttaatgcggacacaaaatcataatagcagtcctccagaacatatcaatacaaggctagaaattaagctccccttacgttcttgctgtagcttgagaatgaaatagagaaaaggattacttctgagtcttagaagagggggaagctggga

SEQ ID NO: 139583 - DNA, 601 bp, Human
agcaaagaaattattccaaagccattaaattctaccgaatggcattagaccaagttccaagtgtcaataagcaaatgaggtaagtttataacaatagataataattgtaaaatttaagtgtttttctgaaacaagataactcttctgacctgttttcagtgggttgaacatttcaaagtgtttgtacatgagatttatacgtgtagtattttgatctgttcccttcttactacttgtacacatttttataatgacaagttaaaggttaaagcattgtatatgatcatatgaaataaaactragtgaccaataaaggggttaaccctgaaggccattactaccctgatataacttaatgcggacacaaaatcataatagcagtcctccagaacatatcaatacaaggctagaaattaagctccccttacgttcttgctgtagcttgagaatgaaatagagaaaaggattacttctgagtcttagaagagggggaagctgggatattttctattataatattcaggagcagaaacagtaagttctcttatggtctagtgataactgtggggacataggaagtttccaagatatttactgatca

SEQ ID NO: 139584 - DNA, 601 bp, Human
gaaacaagataactcttctgacctgttttcagtgggttgaacatttcaaagtgtttgtacatgagatttatacgtgtagtattttgatctgttcccttcttactacttgtacacatttttataatgacaagttaaaggttaaagcattgtatatgatcatatgaaataaaactaagtgaccaataaaggggttaaccctgaaggccattactaccctgatataacttaatgcggacacaaaatcataatagcagtcctccagaacatatcaatacaaggctagaaattaagctccccttaygttcttgctgtagcttgagaatgaaatagagaaaaggattacttctgagtcttagaagagggggaagctgggatattttctattataatattcaggagcagaaacagtaagttctcttatggtctagtgataactgtggggacataggaagtttccaagatatttactgatcataatttcccctaggcacagtacagtttctctgtgaaagttaatttatttgcaataccatcttttaagatcattcgtttttgaattttacataatatctcattatcattagcaaatattatctaactt

SEQ ID NO: 139585 - DNA, 601 bp, Human
atctaacttacagaacacaatgcccttgaagtacttttaagccaggtgagaccaagaatttgagcattttagaaaaaaaattgtattgagtaacatatattaagtgcttcataatcaataatcaagacaatgggtgctataataattcagtggaagaaatcattattgagaacaagaatgatcaagaaaggctttatgaaggaggcatacttgatattgactctttaggaggagagaagggataacatctgagaaaaaggcaacacctgagaccagtcagggaaataatagtctttatgawctgatcagagaattatgaataaactaattgagttgaaatagagggattatattgaggagtgtttagaaataaggtgggatcacatccattagaatggctccaatcaaagaaacaataagttttggtgagtatttagagaaattagaaacctcattcactgagatgtcaaatggtgcagctacttcggaaaacaggcagttagctaaaaaagttaaacacaaatttaccatgtgaccagcaattctgcttttaggtatatacccaagagaaatgaaaatatagatcgtcacaaaggctttt

SEQ ID NO: 139586 - DNA, 601 bp, Human
actttatttgtacttaccacgttattataaaggatacaactcagagacaaccaaatggaagagctgcatagggcagaatatgggggaagtagtgcagagcctctgttgactttctgggtgcaccaccctcccagcacctccgtgtgttcatcaacctggaaactctctgaactgtgtcatttagggtttatatgtaggtttcatgatgtaggcatgattgatttttatcattggccattggtgattgaactcagtctgcagcctttctcccttcgctggagattgagggtggaattaaaartacaactggggtggtgtcagaaaaggccaagtggggagctaagactttaacccctaaagcctgttccattcctctgatgtcagtggatgacacgtggggagcctggaattccacccctacccagcagtactgaagcatcccccaaccctttctccttgggtagtgtcagaggaggcttagtggagcgtcagggctttaactgtcacccagttgtaacaaagccctcctatcatgatgttagtaggacggactatttgggaagcaagaactcccaccctgcccaatagatacaaggacccc

SEQ ID NO: 139587 - DNA, 601 bp, Human
gtgtctcatgctctttctttctggagactgtcatctgagggccgggtccctgccgagatcttggccacgttgtacctttccatgtggaattattccccaaacggtgtatctcaaaacacttgtgtctgcattccagataacattcaggaccctgtctggaaagctgggatcgctgtggctgtagaccatgggctggcagtgggggtgtccagggcggtgcttgagaacgtcagactggccattttaattccccggctgagatatgcataggaccaacagggtcactgagcagacaaggagyctgtgagaatcattcaaaaacatccccagccacagagatggatccggtttcccagtcatccccttaatagtttgaagttcctggcaaaggttccaaagtgaaaagcgattgcaattagcatccaattcttgcagccttgcagcctggtgctctgccctgcatgtcagagttggcatccggctggatccagaggaaagggaaactgctctctctctctcctctgcctccacttctcttggggtaacaaaaaggatcttcgagaaatcatgttcagtatttcaagctctatttctatggcac

SEQ ID NO: 139588 - DNA, 601 bp, Human
ctgcagtgagatactacttcacacctactagtatgctataataaaaaagaaaataacaagtattggtaagagtgtggagaaattggaactcttaaatgctgatggtaggagtataaaatggtgctttgtaaaacagcatacaagtgccccaaaaggttaagcatagacttaccatataacccagcaattttacgtctagatatttacccaaaagtaatcagagtatatgtccacatgacaacttgtatacagattttcttagtgatattattcataatatcgaaaaatagaaataatccaatgtgcaacaattaatgaaggtataaataatatatggtctatccataatatgggatgtgattcagccatacaaaggaatgaagtactgatacgtgctgttaggttggtgcaaaagtaattgcgatttttcccattgaatgcaattgcttttgcaccaaccaatacaatacagatgaaccttgaaaacatgataaatgaaagaagccagtcacaaaagaccacgttttatgattctgtttatatgaaaggtataaattaggcaaatctataaagatttgccagggagtgtctgctaatggat

SEQ ID NO: 139589 - DNA, 601 bp, Human
acacacaggctgcgtggtagactagttgaatcagaatttctgggtgttgggacagagggatcagtatttataaagccgcctagggggttctgtgatataaatcccacatacagctctatactatgcaaatagttcttgaatgccactgactgaggagctcattaaaagtagagattcagttggtcttaaatgggatagaacatctatatttttttaatgctctccaggtagttgtcatgtgtaatggaaattacgcataattcaactgttctactgaaaaacagaagagaaaacttagttytgcaattatttgcaatttttactatgaattcttctggcattcttactatatttctgttaacttctttgtatatgattaaattatttttttttcccttttttttttttgagatggagtctcactcttgtcacccaggctggagtgcagtggtgcaatctcggctcactacaagctccacctcctgagtccacgctattctcctgcctcagcctcctaagtagctgggactacaggcgcacattgccacgcccggccaattttttgtatttttagttgagatggggtttcaccgtgttagcc

SEQ ID NO: 139590 - DNA, 601 bp, Human
gtagtattaggaggtcgtccttttcaaggtgattaggacataaaggtaggacactttatttttatttttgttttttgagacggagtcttactctgtcgccaggctggagtgcagtggcgcgatctcggctcactgcaacctccacctcccgggttcaggcaatttccctgcctcagcctcctgagtagctgggactacaggcgcctgccaccacgcctggctaattttttgtggtttagtagagatggggtttcaccatgttagcctggctcggcctcccaaagtgctgggatgatagacrtgagtcaccacatccagctggtaggacactttttgaatggaattagtgcccttataaaaagagactctggagagctagctagcccctactattatgtgaggacacagcaaaaagacagcattctatgaagcaggaagtggtcactcaccagacagccagcctgctggcgccttgttcttggacttctcagtcttcgtaactgtgaaaaataaatgtctttgtttaggctacctagcttatggtttggtgttttttttgttttgttttgttttgtttgacagagtcttgctctgtcaccca

SEQ ID NO: 139591 - DNA, 601 bp, Human
caatatgccatcccagtatggtacatttgttacaatcaatgaaccaatattcacatagtattaccatgtgaagtccatagtttatgttaggattctttgtgttttaattctgggggttttgacaaatacatgatgtcctgtacccaccattgtagtattgtatagaatagcttcactgccctaaaaatctcctgtgttgtacctattcatccctccctctcccaaacccttagcaaccactgatctttttactgtctccatagttttggcttttccagaatatcacagggttggaatcatwtagtatgttggctttgctgattggcttctttcatttagtggtatctcttgagtatcccttatccacaatgcttgggaccagaagtgttttggattttgaggtttcttggatttttgaatatttctgtttaccaattgagcatcccaaatccagagtctgtaatcctccaatgagcattttctttgagcatcatattatgtctgtgctcaaaaagtttcagattctgttgtatggatgtttattcattcacctattgaaagacatcttggtggcttccacattttggcaattttgaataaa

SEQ ID NO: 139592 - DNA, 601 bp, Human
ttcaagtttttaatatcaattggtttactgatttttttaaaatgccatttctgctttcttttcatcattgctgctttcactctgtctttcttttgtttgtatattgtaagtattatgaggtaggtataatacaatcttagtttgaaagaaatattattaagtgaaaaaggattgggttgacgtatctcataataatcatttgatggcaactactttatttacaattcaaagtgaaaaagaaaaatttatgccttctgtgaggatatagttctggagttagctctaaatacttttttttttyccaagaaaaagatgctgaaatcacagagtatgggtctttttgataatgatggtgtttgtagccacttttgtaatagaaaaaatagactctgccaaaaagcccaaagtggatgaaatgaagccattggcctggaggctcagcggaatgctgaagccaggagctagatggcatcagctgggaaaggagaccaggacagacatagatcccttttcctcattgttttcagggaaacaaacaagctaacattgtttatttttattttttgttttgccatttagaatgaaatttaattttgactga

SEQ ID NO: 139593 - DNA, 601 bp, Human
cttttgtataagaaatagcctatgtttcaggaacagaaaaccaaacaccgcatgttctcattcataagtgagagttgaacaatgagaacacatggacacagggaggagagcatcatacaccggggcctgtcggggagtggaaggcaagggaagggggagcattaggaccaatacctaatgcatacagggcttaaaacctagatgacaggttgataggtccagcaaaccaccatgggacgtgtatacctatgtaacaaacctgcacattctgcacatgtatcccatgtttgtttttaacctmaagtaaaaaataaaaaaaaaaggaaagaaatagcctgtgtttgcagctgattaactttctcagcctgtgttctgccctgagacatttggggcatagagggcttttttcattttggactatatctgtccctttaatccaaactagcaacagtcagcacaactcccctaaaaacttggagggttttctctaaatcttgttgggctttcccacatgtctcaacagctgcatccataattcttttcaggacagaccccttcccactaggtgtgtaggctgctatggaacagagccttgaagtgt

SEQ ID NO: 139594 - DNA, 601 bp, Human
aggaattagccattttaggtggagtctgggagagcctcattgagaatgtatgtttcaagtcatagaaggaagggaggctatgaccacttgggtatctgggaagagagcattgaagagaggcacaaaggtcttcatgcaggagcttgcttcctagatatatccttatttatttgttttgtaactattaaatatttctcctttcccaattgcttctattttaactttgtttctaatttcttttatcagagaattgttttattattgatatagtaaaatttgtcttttttttttttttttttttgagactgagtcttgctctgtcgtctaggctggtgtgcagtggcatgatctcagctcactgcaacctccaccttccaggttcaagtgattctcctgccgtagccttccaagtagctggaaccacaggtgcgctccactacgcccgtctaattttttgcatttttagtagagatggggtttcaccatgttgaccaggctggtctggaactcctgacctcaagtgatccacctgcctcagcctcccaaagtgatgggattacaggcatgggccaccacgcctggccaaatttgtctttttaaa

SEQ ID NO: 139595 - DNA, 601 bp, Human
cggagcttgcagtgagccgagattgtgccactgcactccagcctgggcgacagagcgactccgtctcaaaataaataaataaataaataaataaataaataaataaatacaaattaatgtatagtcagttgttctggcaccacttattactagcactttcctccccactgattttaaatgtctttaactaaactctatagttgagtgcatttctgaactgtttattctgttctattggtctgtttgtctattcctgccccctaccacacttttaaaatcactgaagctttgtagcatcttytggtgtctgccagtggagaatccccaccctaacattattctttaaaaaaatcctcagttggccgggtgtggtggctcatacctgtaatcccagtactttgggaggctgaggcaggtggatcgcttgaggccaggagttccagaccagcctgagcaacatggcaaaatcccgtctctactaaaaatacaaaaaattagctgggcgtggtagcacgtgcatataatcctagctacttgagaggctgaggtgggagaatcacctgagcctgggaggtcgaggctgctgtgagccatgtttgtg

SEQ ID NO: 139596 - DNA, 601 bp, Human
ctggccatcatggtgaaaccccatctctactaaaaatacaaaaattagccgggtgttgtggcaggcacctgtaatcccagttactcccgaggctgaggcaggagaatcacttgaacctgggaggcagaggttgcagtgagccaagatagtgccactgtactccagcctaggtgcagagctagactatctcaaaaaaaaattagttttagagcagatagcatcatagttactcctgttagtctttttgttctgttttgttcatttaatttctctgaaactgccagtgtcattatcttttacyacccagttcatgatcagcttggatccagtcaagcaactgatgtatttgagactgtttgagtacattttcttatttttttttcttgtggtatcacacttgtcatcgttaaaaacagtagatcttctggtgtcactcttgtcaccattgaaaacaatgcttctttttcaataaactttgaattggaatattttcatttcactgagatatctaatatgtataaaataaatagtaattaatcaaaaagtactgatatgaataaattatttgtatatacaccgaagacttagtaggtactaaaag

SEQ ID NO: 139597 - DNA, 601 bp, Human
aatcccagttactcccgaggctgaggcaggagaatcacttgaacctgggaggcagaggttgcagtgagccaagatagtgccactgtactccagcctaggtgcagagctagactatctcaaaaaaaaattagttttagagcagatagcatcatagttactcctgttagtctttttgttctgttttgttcatttaatttctctgaaactgccagtgtcattatcttttaccacccagttcatgatcagcttggatccagtcaagcaactgatgtatttgagactgtttgagtacattttcttwtttttttttcttgtggtatcacacttgtcatcgttaaaaacagtagatcttctggtgtcactcttgtcaccattgaaaacaatgcttctttttcaataaactttgaattggaatattttcatttcactgagatatctaatatgtataaaataaatagtaattaatcaaaaagtactgatatgaataaattatttgtatatacaccgaagacttagtaggtactaaaaggaagctacaaaaaaaaaaaaaacaacactgtccttgggtttataatctaattagggaaaactcacaggaaaa

SEQ ID NO: 139598 - DNA, 601 bp, Human
gatccagtcaagcaactgatgtatttgagactgtttgagtacattttcttatttttttttcttgtggtatcacacttgtcatcgttaaaaacagtagatcttctggtgtcactcttgtcaccattgaaaacaatgcttctttttcaataaactttgaattggaatattttcatttcactgagatatctaatatgtataaaataaatagtaattaatcaaaaagtactgatatgaataaattatttgtatatacaccgaagacttagtaggtactaaaaggaagctacaaaaaaaaaaaaaacaacactgtccttgggtttataatctaattagggaaaactcacaggaaaaacacatggaaataatttccttaatatgctgaacatgttaagaaaaagaataactggatgcaacattcaggacatttttattaaggacaatttttggacaatactttgaataattctaccagaaatttgggagttgatcttagtggatagtaatggaggaaaagggaaagcaggctatatacatagggagcaagagtgttacctccacagtactgctgcattccatctccacccctgagatatccagagga

SEQ ID NO: 139599 - DNA, 601 bp, Human
aaaacacatggaaataatttccttaatatgctgaacatgttaagaaaaagaataactggatgcaacattcaggacatttttattaaggacaatttttggacaatactttgaataattctaccagaaatttgggagttgatcttagtggatagtaatggaggaaaagggaaagcaggctatatacatagggagcaagagtgttacctccacagtactgctgcattccatctccacccctgagatatccagaggaaacagtatacaatagcacattactgtaggctaagaaatattgttactgtaatgttttttaagtttgcttattgcttaatgaatttagaaaacatgttttccttaactgacattgcataagatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgaggtaggtgtgttatcttaatttccttctgtgttttagcattttatgaattgttataaagaaggcagcaaggctttaaa

SEQ ID NO: 139600 - DNA, 601 bp, Human
cagtactttgaaagagcttctcttatacagtaagtaatcattaggattttatgtttagttaatgtcatgtcttgagtttttttaatccctagaattagtatctgatagacctagtaaattcaagaacagatgttgatggacattcataaattatttttgtttgtttgttgtttgtttgagacggagtttcgctcttgttgcccaggttgaagtgcaatggcgtgatctcggctcactgcaacctccgcctcccaggttcaagcgattctcctgcctcagcctcctgagtagctgggattasagtcacgcaccaccatgcctggctaattttttgtatttaagtaaagacagggttacaccatgttggccaggctggtctcgaactcctgacctcaggtgatccacctgcctcagcctcccaaagtgctgggattacaggcatgagccaccgcgcccagccaaattatttttattttcttatattttattccattttacttggtctttattgtgataaatatatttccctttgcatagaattttttaaatatcctctttaagatacttttctttatgtatttttcttacacctcagcaaaca

SEQ ID NO: 139601 - DNA, 601 bp, Human
gagagatagcagtaataacttttcttgaaagtggaacaacccaaaagtctgctaggcaagagtttctcggccttggcacctttgacatttgggattgtgcaattccacattgtgggaggccatccaggggattatggaatgtttggtaaaatccctggcctctgtccaatagattagctagtagctctctcacccctagatatgaaaaccagaaatgtctctagacattgccagtgtcccttgggggtgcaaaattgatgccagttgagaactcttgaagtaaccatagcacctctgcacyggaccggaaaagcgaatgtcttcaaggaaggccaggtttttttctttagagtatgagtcactctaagaatcaaatgaatgattgtctatgccatagagggtgtctaagataactttggcctatttaattttcaaaacaaatgtaatcaatagtctaccttaactgtagttgtagaaaaaacatttacacccatggaatgtgctgttttaagaagactagttttctggataaaactagcaggataatttagttttaaaacatattcttcaccaaaaattgacctgctttacagagttacag

SEQ ID NO: 139602 - DNA, 601 bp, Human
actcattttatgaggccagcatcatcctgataccaaagccacacagagacacaacaaaaaaagagaattttagaccaatatccctgatgaacatctatgtctctggaaggatgagtaatgagtaacttttattttttgttttttacctttgtatgttttacaaattctctataatgacctgcattgcagttgtattgaaggaaaatattatttttaaatgagataataaaaatattttaaagtaatttagaccacaaatggcaaaggccattcttacaaatgtaaagacaaaattattgtgttttttagcatctattgcatgtttttaaaatgttgctaattttagaaacacaagcttgaatgaaaaagcaaattccaggagactgtatacagaacaataccatttttataagacccaatagcaagcagaactaaacaatatgtcatctggtgatatgtataaagtgatcgaagattttgttgttgttattgtatacaagacatgattaacacaaaactttttattgtgattattttgtatatatttgatgtcaactgtaagaccagccactgtaaaatacatcttttttatcttcctagt

SEQ ID NO: 139603 - DNA, 601 bp, Human
tgctgttttttaaaagatgttttgcttttctgcttcactgaacatgaaaaacattagcagacaaacaaagaggtctgtcaaagcaagagtgtatgtttggaatagagcaaaatgggaagagcagggcttgaggaatgaatattttaaatatgaaaaaggaagagaaaaacagccaaaacaccaaaaaggttggagaataaaggtaaactattaagaagaaaaagaaaataaagaaataatagagactgggcacggtggctcacgcctataatcccagcactttgggaggccaaggtgggcrgatcacgaggtcaggagatcgagaccatcctggctaacacactgaaactctgtctctactaaaaatacaaaaaattagccaggcgtggtggagggcacctgtagtcccagctacttgggaggctgaggcaggagaatggcatgaacctgggaggcggagcttgcagtgagctgagatcctgccactgcactccagcctgggcaacagagcgacactccgtctcaaaaaaaaaaaaagacaaaaatgcagaatattttcattgctagtctaaagataaaaatatattcaatttttaaatca

SEQ ID NO: 139604 - DNA, 601 bp, Human
ccaaaaaggttggagaataaaggtaaactattaagaagaaaaagaaaataaagaaataatagagactgggcacggtggctcacgcctataatcccagcactttgggaggccaaggtgggcagatcacgaggtcaggagatcgagaccatcctggctaacacactgaaactctgtctctactaaaaatacaaaaaattagccaggcgtggtggagggcacctgtagtcccagctacttgggaggctgaggcaggagaatggcatgaacctgggaggcggagcttgcagtgagctgagatccygccactgcactccagcctgggcaacagagcgacactccgtctcaaaaaaaaaaaaagacaaaaatgcagaatattttcattgctagtctaaagataaaaatatattcaatttttaaatcaaatttctaaattttcagactattcaaatacagaaatgctgtttcaatatttgccagttttcccccaaagtaatcaggaaacaatgccaagaaatgctttcttttggccagattgacaaaatagcatgtgacattcaaaattaatatatcattggtacatatacccaaatttccagttatt

SEQ ID NO: 139605 - DNA, 601 bp, Human
ttaagaatgtcttgtacaatttatatattattgacaaaagtcaacaaaactactgaacagaatatatccttagtacaaaactgatggtgatttgcatgttgattacattttctaggttaagatcaccagtcatttctttaaggccattgatttcagatactctcatgcattgccctgtgttagcctctctgttgtttcgctcagaaaacattgattatgatctgccgtgcatatggaggacacagtgagggacaagagttggccctggtgcctgaggcactctaggcagagctgtgggacygagaggggaaggtctttgctccgagaggaggtactcagaggcagttcccagacgggcttgtgtttggagtgggcatgattggacacttggagtttggggtggagagaaaaaaatgtgggcagaggtctgaggacaggaagttaaggccacgtttatgggtcctttggaattgaagccactaaggaatgtttttaattttgttttctcttgaatttacggtcagccagtcttcttaagaacccttaactacgtaacaagtaactgctccttgttccatagaaccgaaacccaattcttagg

SEQ ID NO: 139606 - DNA, 601 bp, Human
caattcttaggaagtaaatgcgtagtatggtggacagaaccccgtacttttttcctgacatgaccattggtcaaccgtgtgatctggaatggatgtttacctttctggacttcattcttatcagctgtaaaatgaggatagcgttctagctttgaacttctcaaactatctgtggtgaaattattttttgccagtctgtcactgacattactagaaaaatgatcctgcacttggatgtcagcagggtccgacatccagcaacattttgatgctgtgcaagtttgtaagcacttgccctctsttcatctcattgaggacaggtggcagtttgtgggccatcagtggtttccagaccccactctgggtggcccatcctggataacccataggacccaccagctcataatggttcttccagtccccggaagagtagcatgcgagtttatggtcacagattcataataaagagtaggtttaaagggaaaaaatgtttattttctctcttccagcatttattcacttaatttgttcacttattttatttgtggctactttgctcctctattctgtgccttctctcattttttttccagagtgggaa

SEQ ID NO: 139607 - DNA, 601 bp, Human
ggcagacagggattagcggacccatccatgcagggtccatgccagctggcatatccaaggagatgctgttttccttttattctctaagcaggcaggacagtcagttccaaaagtgatgaggacaaaaagtggtgtctacgagaagtgagatggcctgcatggggcacacgggaggatctaagtgagcagtggggagccctgaggcttgcctggtttttgtactgatggagctgtttccccagcacagtgtcctgggagtaggagaggaaaaagggaaggcactgaaccaaccgaggcttargtttctcttgatgagtgaagcagaaagacaagaaggaggcaaggaccatagttccaatgtggcgtcatggcacgtggtaggccttgattctaggctggacagaaagtaggaatttaaagagtttaaaaagagaagagtgatgagagccagaggactggaaaattctagatgagtgcagggaacaggtgtcaggcaataaagagtgtagtgattatggaagtgcttacttaccttcgcatatcctgttctgaacctctagtcacttaaacaggatacaagttttcacatgtggttttaaaa

SEQ ID NO: 139608 - DNA, 601 bp, Human
tttctgacatctcgagttatgcatcatcccagactttttcatttcatcctggagcccagtttgaatgctgctttctgtggctgagctggttccacgctgacacttttgcaggaatcgtgttttctgtcccccttctccagttctcagcacaggccacactccaaggctggccctggctgtgaagtcggaacaaacccaggctgtgaggcttctctccctttctccttccttttgatttcaaagtcttaatagttaacagtatttatattctctgcagataaactgatgaggggaataactrtattctgtccattgttttggttgaattttgttaaaggttgagaaattgacagaacacatctgcttctcatgtgtagctgtcctcaagacacaagaattccttcttagatggcattttctatttttgcatgatagtggcattttgtgacttattttgagtatggtgttattaagctttcatttttaaagtgctttttggtttaccctgtgtgatttttaatggctttctgcattttttagtttgatttttatgtcttggatataaacttttccaatgaaaatggatcaattttagactgaa

SEQ ID NO: 139609 - DNA, 601 bp, Human
gcctcccaagtagctgggactacaggcacccaccaccacgcccggctaattttgggtatttttagtagagatggggtttcaccatgttagccgggatggtctcgatctcctgacctcgtgatccacccgcctcagcctcccaaagtgctgggattacaggcttgagccaccgcgcctggccagttatattttaatattctagtccaagtttgagcatggctaattaacacctttccacagttttgctggggcctgatggtgtcacaagcagagaatgaacaagtcatgctcagtgcccacmagggaggacgagacaaggagtgtacgctctgaggaggtgcataggcctaaatgtagaggacaggccgacacaagtcagccaattacagaaggaattgctggacatctatgtggggagggagtcttgagaggccggggggcgggtgctgtcacttctctaaggatcatgcctgtcagcctcagtcccaacttgcatgtccctttaccccataaatctagaccacagttttgcaggatacccgagtatccagcccactttgtatacggtatgtatcacaaaggaatcttgatgaataataag

SEQ ID NO: 139610 - DNA, 601 bp, Human
catcagtaaaatgagactgaaaacagtaccttcctgatagggttgctgaggaggaaatgggctcatgtggaaagctcttagagaaactcctgataagggcaagcatgtgcaagggtgagcatggctactgtgactcccgcctgacaaagggagtgcatgggcagggcctggaataccagtgtccactgcactgccagcgcccatgttctcaccactgccagtgtgtgacctctgagtgtgagagcctcagtttctccctaacacaagagggtcatgtttatccatgcagtgtaaccaagtrtacccctgtctcactgttgagttgaattttgtttttttaaacaagaattactagtgcttataaataaaaataaatgttggttcttgaagttaccaatttggaaagctgaatatttacttcagtaatgctgctgttaatcaaaacatttgtgaaactccttttttataattgcctgcagaggcaagttacaaaaagcacaggaaatttaatccaaaacttttacaaaatacatatgcacatacatacatatatatgcatacacacatatatatgcatgcatatatcctatctgtaaaatat

SEQ ID NO: 139611 - DNA, 601 bp, Human
tcatttttgctgaccatgtccaatccagtttacagataggtttttgagggtggtaaacttcggttacaggagcataataattgtgataaatactaagaccagaaagcatatgtaattgtgtcatggagatgttacattcaggcactatcgccagccaggattgatgactgggagctaaacacctattggcttttcccaaacaaataggtaaatcctcaaatcccaacaagatattcataatagttccttcctcttagggcttagacgggcctctatcatctatagaactaggcatctaaaractttcgttagtgtatacctccactggggggtctaaccatgtttctggctgtagaagtggtggaaaaggaatatatgcccaataagtataattgtcttttgtttcagcagtcactgggggaatactcatggcgatggtgagcacagccatcatagctaccattagattactcattgtaactggttgtcccgccttcttcagattttcttccgccatctgtgtcaacttcttgatctggccccaggggggtggctgtgcccgaccagtgttgctcgccagcacttgtgtcttccttattgt

SEQ ID NO: 139612 - DNA, 601 bp, Human
catcgctggataatagctttagcttctttccaggtaatgctgtatctgcgtttgagaccagaggcattaacatgggttaaattgtgaaagtgtctagcgttagatatttcagtagcagctaggcaatcagccatttgattccttggagtcaaaagtcctggaagagttgtatgagctccaatatgagtaatgtaaaaagagtgcattctgttcctaactgtggtttgtaattgggtaaataaagtcatcagttgttcatctgtgtggaattgtagctgagcattttcaactaactgtgtgkaatgaaccacatatgaagaatcagaaattacattggcaggcatctcaaaagcagtcagcacctcaattacagctacaagctccgctttttgagctgaagtatagggcgtctggaaaactttacgttttgaataagaagctttaccattactagacccatctgtaaaaacattttcagcacctacagctggtttagatttagttattccagggagaatccaattagttaattttaaaagttgaaataattttgttttcggaaagtgattatcaagaacacctacgaaatcagctaaatggg

SEQ ID NO: 139613 - DNA, 601 bp, Human
ttcagtagcagctaggcaatcagccatttgattccttggagtcaaaagtcctggaagagttgtatgagctccaatatgagtaatgtaaaaagagtgcattctgttcctaactgtggtttgtaattgggtaaataaagtcatcagttgttcatctgtgtggaattgtagctgagcattttcaactaactgtgtggaatgaaccacatatgaagaatcagaaattacattggcaggcatctcaaaagcagtcagcacctcaattacagctacaagctccgctttttgagctgaagtatagggsgtctggaaaactttacgttttgaataagaagctttaccattactagacccatctgtaaaaacattttcagcacctacagctggtttagatttagttattccagggagaatccaattagttaattttaaaagttgaaataattttgttttcggaaagtgattatcaagaacacctacgaaatcagctaaatgggtttgccaagactatttataaagtcctgttgtgttagtgtttttgtaagagggacaataatttttccagggtcatatgcatgcaatttaacagtttgggttctcccat

SEQ ID NO: 139614 - DNA, 601 bp, Human
tcccatgccaggcacgtaccccatctcttgtatcatatgctgactttgagggctatatagttgctcaggaattagaacttgtgctccccattgctgtaataaatctctcccctataaatttataggtacagaagttataattgactggatagtcccaggttgtccatcgagtccttcacaatgcaaaatataactgctttgatatacttcaggggttttaccaactccaactctgttaaattgagtgggttgaattggccatgcggatggccagtgctgtagagaaatgatggaaatgtcygctcctgtatctaccaatcctttcattcatttttttccttgaatggttatttcacaggtaggacatttatcagtaatttgattcacccaataagctgctttgccttgtttatttgtgcttccaaatcctcctgtttgtttaatttcactttttcccattcccacatacagcacagtcaggagctgtgctatacgctctcctggctctgctttccagggaacagaagtagatataacaatttgaatttccccattgtaatctgaatcagtgactcctgtatgtacttgcactccttttaaa

SEQ ID NO: 139615 - DNA, 601 bp, Human
ttgctgtaataaatctctcccctataaatttataggtacagaagttataattgactggatagtcccaggttgtccatcgagtccttcacaatgcaaaatataactgctttgatatacttcaggggttttaccaactccaactctgttaaattgagtgggttgaattggccatgcggatggccagtgctgtagagaaatgatggaaatgtccgctcctgtatctaccaatcctttcattcatttttttccttgaatggttatttcacaggtaggacatttatcagtaatttgattcacccartaagctgctttgccttgtttatttgtgcttccaaatcctcctgtttgtttaatttcactttttcccattcccacatacagcacagtcaggagctgtgctatacgctctcctggctctgctttccagggaacagaagtagatataacaatttgaatttccccattgtaatctgaatcagtgactcctgtatgtacttgcactccttttaaatttaaactagacctacctagaagtaatcctaccgtccccactggcatcatctgactggagacagcaacattctttaacagtctcattaca

SEQ ID NO: 139616 - DNA, 601 bp, Human
aatttgaatttccccattgtaatctgaatcagtgactcctgtatgtacttgcactccttttaaatttaaactagacctacctagaagtaatcctaccgtccccactggcatcatctgactggagacagcaacattctttaacagtctcattacaaaaggagaacctggtccatattgattaatagctggtttaaattctttgaggaatttaaaaggaaaaggctcaaatgtagccataatattcccctgttgatcaggtgagtatattctaacagagaactgccaagcatccatatcaccytctcatctagcttgctggattcctgcctaaatggaactgagagcggtcgctcgaggcactgctggaacagtcactggggcagctactttttgcccagtgtcctctggaaaagagagatttggagagtcaggccactctttttcttcaaaataatgagggggtatagaggggtagggacaaacctctccctcctttgtctctttagctggcaagcaaacctgctctgtcatctcttctgttagttacttcgttacactctccttcttcctctgattcctcctccttgtcatctatatagaa

SEQ ID NO: 139617 - DNA, 601 bp, Human
tagccataatattcccctgttgatcaggtgagtatattctaacagagaactgccaagcatccatatcaccttctcatctagcttgctggattcctgcctaaatggaactgagagcggtcgctcgaggcactgctggaacagtcactggggcagctactttttgcccagtgtcctctggaaaagagagatttggagagtcaggccactctttttcttcaaaataatgagggggtatagaggggtagggacaaacctctccctcctttgtctctttagctggcaagcaaacctgctctgtcayctcttctgttagttacttcgttacactctccttcttcctctgattcctcctccttgtcatctatatagaaaggctccaaggtggaacaaaccacaatccacactgaccagagagttacaggaatatcctcagcaccatccttgtatgcctttttcagtgtgctgcctaccttttcccagacctctacattcatagttcctcagtcctgaaaccaggggcagtatttctctaccacactaaaaagttgcataagtcagctggtgctaaccttcactccttttctgaggagatgccgaagca

SEQ ID NO: 139618 - DNA, 601 bp, Human
caggccactctttttcttcaaaataatgagggggtatagaggggtagggacaaacctctccctcctttgtctctttagctggcaagcaaacctgctctgtcatctcttctgttagttacttcgttacactctccttcttcctctgattcctcctccttgtcatctatatagaaaggctccaaggtggaacaaaccacaatccacactgaccagagagttacaggaatatcctcagcaccatccttgtatgcctttttcagtgtgctgcctaccttttcccagacctctacattcatagttmctcagtcctgaaaccaggggcagtatttctctaccacactaaaaagttgcataagtcagctggtgctaaccttcactccttttctgaggagatgccgaagcagactcaagcctcgtgcctgctcgacccttgtcccattgttaccctgatgcttccgagctccccttcttactcaccacagggattgcttaagagtactcgggtgttccccagcgtagttccacgttctccaactgtcgcttcggggcgacccttcgacccgggttcaagcccccatgttgggcaccgcttgccgagacc

SEQ ID NO: 139619 - DNA, 601 bp, Human
tctcttctgttagttacttcgttacactctccttcttcctctgattcctcctccttgtcatctatatagaaaggctccaaggtggaacaaaccacaatccacactgaccagagagttacaggaatatcctcagcaccatccttgtatgcctttttcagtgtgctgcctaccttttcccagacctctacattcatagttcctcagtcctgaaaccaggggcagtatttctctaccacactaaaaagttgcataagtcagctggtgctaaccttcactccttttctgaggagatgccgaagcwgactcaagcctcgtgcctgctcgacccttgtcccattgttaccctgatgcttccgagctccccttcttactcaccacagggattgcttaagagtactcgggtgttccccagcgtagttccacgttctccaactgtcgcttcggggcgacccttcgacccgggttcaagcccccatgttgggcaccgcttgccgagaccagctcggtcgtggagaccctaacccagcagcactagaggaattaaagacacagacacagaaatagagtgcagagtgggatcagggggctgacagccgtcaga

SEQ ID NO: 139620 - DNA, 601 bp, Human
gggcaccgcttgccgagaccagctcggtcgtggagaccctaacccagcagcactagaggaattaaagacacagacacagaaatagagtgcagagtgggatcagggggctgacagccgtcagagctgagagccacaaacggaatctgacccacatattattgacagtaagccagtgctaagcattgcttctatagattatagattagctagaagcattccttatgggaaacaaagcaattttagcgaggagcagagaaacaggccctggctgattatctgcagcaaaaacacgttgttaagrcacaggctgctcctgctattgtttatggctagagcagttttccgctcccgggggtgggggggccaggttttccttgccctgctccagtaaaccaacgacttctagcagtgtgtgtgatagccatcacgagcatgccacattgctgcagaaatcctttttatggccagtttctttaaggcctgtttatgacaggcttagggcttgctaccagcacaaactaacctataaaattagcaatgaattttttaaaaggtaattcccaagggtagcaaggatgagatgagatgagcactgtttatt

SEQ ID NO: 139621 - DNA, 601 bp, Human
ggagaccctaacccagcagcactagaggaattaaagacacagacacagaaatagagtgcagagtgggatcagggggctgacagccgtcagagctgagagccacaaacggaatctgacccacatattattgacagtaagccagtgctaagcattgcttctatagattatagattagctagaagcattccttatgggaaacaaagcaattttagcgaggagcagagaaacaggccctggctgattatctgcagcaaaaacacgttgttaagacacaggctgctcctgctattgtttatggctwgagcagttttccgctcccgggggtgggggggccaggttttccttgccctgctccagtaaaccaacgacttctagcagtgtgtgtgatagccatcacgagcatgccacattgctgcagaaatcctttttatggccagtttctttaaggcctgtttatgacaggcttagggcttgctaccagcacaaactaacctataaaattagcaatgaattttttaaaaggtaattcccaagggtagcaaggatgagatgagatgagcactgtttattaactaaattctgctggggggagttctaagtg

SEQ ID NO: 139622 - DNA, 601 bp, Human
gagccacaaacggaatctgacccacatattattgacagtaagccagtgctaagcattgcttctatagattatagattagctagaagcattccttatgggaaacaaagcaattttagcgaggagcagagaaacaggccctggctgattatctgcagcaaaaacacgttgttaagacacaggctgctcctgctattgtttatggctagagcagttttccgctcccgggggtgggggggccaggttttccttgccctgctccagtaaaccaacgacttctagcagtgtgtgtgatagccatcaygagcatgccacattgctgcagaaatcctttttatggccagtttctttaaggcctgtttatgacaggcttagggcttgctaccagcacaaactaacctataaaattagcaatgaattttttaaaaggtaattcccaagggtagcaaggatgagatgagatgagcactgtttattaactaaattctgctggggggagttctaagtggcacaccctgctgggaatgtttggaaatattcatcaagccctttaaaatgcccgtacccagccgggcatggtggctcacgcctgtaatcccagcac

SEQ ID NO: 139623 - DNA, 601 bp, Human
tctggctcactgtagcctctgcctcccaggctcaagcaattcttctgcctcagcctcctgagtagctgggattacaggtgtgcaccaccacgcccggctaatttttgtatttttagtagagacggggtttcaccatgttgctcagtctggccccgagctcctgacctcgtgatctgcctgccttggcctcccaaagtgctgggattacaggcgtgagtcaccgtgcccggccccaggttttattttttaaaggtttgctttttccacaaaatttgaatctttcaggctaggaatttggatytggatttcagaagggttttgggtgcctgagggagctatcagggttttgttggtaatttacatctgtgtaaaaagtgaaataacgttgtcgtatttactaatgaggatgtgtttctgacattccacagtattcctcagtgagcagttctgtgaggcatttccatcttatctctgtaatgagaacacctacatttttgtggagacattggttgtcatatcttatgtacccatgagtcaaagaactgtgtatgcccttgcccttcgttgactgcaaaccctaaggcaagaaggcctgtttgga

SEQ ID NO: 139624 - DNA, 601 bp, Human
aaaagtgaggcttacataatagaaaaaatatcactctaggaattctaaggggaagaaaggaaaactgtggggctagaggagtacttttagaaaatatcacagaaatttctggttaaaaagtactactaacatttcctactaatgttagtgttcagttttatctgaaaatcctcagtgatacatattacattttttcctaaggcagccattgcctatttgggcaattataagagtcagggtgatctcttactttctcttaagttcttccataaaattgaaacctataagtaagcacacatttgaaagaatacatatacagactactcttaagtgatgttttatctatattatagattcccacaagatatttcttttaaatttcagaaaacaagaattatatccctaagaagctggcttccaaattaaacaacctgcttgtttcttggcaaataagtatgctttaagatgcataatgtagttttatgttttctcaacatattaaacaaatgcatttttattttcgtgttttcagatagtggccagaactatagtgccagtagtaaaggtgaacgactaagtgccagactcagagctttacctg

SEQ ID NO: 139625 - DNA, 601 bp, Human
atttgccttcctgctgccgtgtatgagtgtcttaccccatagcccttgctcatggaatatattaatgtgttgtcatacttcaatttttttcaatcagataggttaaaaatggtatctcaatgtaattttaatttatatgtctctgtgtgagattgaacacttatttgggttaaatcatttaaatcatcttgtgaactgtcatttttccagtggatttttggttaatctcttttcctcgatttttaagagtgctttataaattagagttactagatctttatttttagttatattatctgtsagctctttatctagtgatattatttatctgtagtatatgttacaaatatttttcccagtttttagttgccttcgactttaccacaggtatttttagggtcaaatttattgttctgttctattgttgtctctggattttgaggcaccctgcacccagattcttttctagtacttgtacgatttcattttatacattcagattgctaatctatttggagtttattttttgtgtaaggtatggacctaaatgtacacctcttcaaatggctgtttctcccagcaccattttttaaaaagacca

SEQ ID NO: 139626 - DNA, 601 bp, Human
tatttacttagttctggcacacatattaagtagttccagtattgctaactcataacactgtgcataacaaacctactcactggaacttcatatttgtttatagttcttttttgtccttagcctgaaggtatataggaaaatgctgtgtttaacagttacttagagttttttcttcctttgctgagttattaatttgaagcacaatcaagtttatgtttttatgtttgtattccaatttgggttctttttaccttattcttgttgatttcatttatatacgtatttggttttttgactataygaaacagcattgttctaaaaattaaatctacattaaaaagtatatacgcagagaactgccatcccctctcccccaatttctttttagcctgtatttattttcacagaaacaagcagatacatatatattttcttatatccttttctttcttacatgaaagacagcatattatagatattcttttgcactttgttttttttttccacatagtgtatcctggaaatcactccatgttagttcttagagatcttcctcattcatttttacaactgcatagtattctcttctgttggatttacc

SEQ ID NO: 139627 - DNA, 601 bp, Human
atacgatttttacatatgtacacccccatgaaacgttcactacaagtgagttaattaacatacctgtcactccaaaaagttttctcctgccctttggtaatctctccctcccactcttgtcctcgagcaatgactgacctgcttttggtcagtatacattagtttgcatttaggagaattttatattaaaagaatcatggagtatctacttccttttctggcttcttttactcagcattattattttgattttcaatctttatcagtagttcattcttctttattactcagtagtattcarttgtctcaatatatacaatttacatggtcatttcatatggacattgggttgtttccaggttttcactatttcaaagaaatttatgtgtaagtttgtgtggacttaatgctttcatttctcttgggtaagtacctaaggagtggaatggctgggtctttttataaatgtatgttttatcttttgaagaaagtgtcaaactattttccaaaggactgtgccattttacattcctaccagcagcatatgagagttccagctgctccacatccttgccaacatttggtatggtcagtcttttta

SEQ ID NO: 139628 - DNA, 601 bp, Human
ttgacttattaagtttaatgtgtgagaaacatatttcagattggtgacagtagctagactttagtaaccactagttaagtaaggaagccattaacttgaaaattagagtaatcgtaggcactgtttggatcctttagcaccccaagtcatttattacatttacttgtcatacctcttggaacattccttagtctttgttttttataccttttcctgtttttgaaaagtgtagagcttttttttttgtttagttttctttttcagggcatttattctgcagaatgcctttcagttggcagargtttctcatttttggcaggagtaccatggatcgtcagtgctgtgtgtccaaaagcacatgatatctgtttatcccattcctgataatatctttggtcacttggttcaactagtatttgccatgtttctcactgagtaaagttaatatttttcacttcataacaagtaattctggagaagtactttgagaatctaaatgtctggtgtgacattgtactttcatatactagttttagcatccattgatgattcttacccgaatcatttgtgactaaccaaatagtgattttctaattccatc

SEQ ID NO: 139629 - DNA, 601 bp, Human
tgacaaacctgaatgtgataggcagcaactatatagaaacttgtgtttatatgagttaaatactaatacgagttaatactaatatcatatttcagcttaacttacgtatgtctgcaaaatctttggcagtcagctttttaattttgttgaatcgtgcgtaaagataggctgattcctttggtaagggtggtacagcatcaatgtcaacttcttcacagtatacagagccacttaaacaaacacacagcagacacgtgggcatttctaaattgggaataaaatcataaaaatatgaacaatmgtttgaaaatatttctcctctagtagtaaaattattgctattatgaatgctattactaatttgaagagatgttttacagaatcataagaaagatagtcatggtaactcgttacctatattgtgcttgataattcaccagaatattgtttgagaatctctttttattttgttttactggtgattgcttaaatgctgaattgattgacagttacatttccttatttgaaaaccaaaaaaatttacaaagcaggagttaaggtaaacatgagcttgacttattaagtttaatgtgtgagaaac

SEQ ID NO: 139630 - DNA, 601 bp, Human
aaaatgtgaaaaacatgtcgttaaatagactgtgaacagggcatttatttacagtatgagaactggaaccagaagacagtgttaccttgttcaacctcagatgggaatgtgcatgtcaagtaattcaaattttttgccactctgagcatgtctgagaaagcccatgaaagcacaatgtgtattaattttggggttataaataaattttagcaagtgggtattcacaaatatggaatccacaaataacaaggatcaactatacttcaatccacatttgggagctatcagtggcagcatgaayctggttatggttagtctcataaatgtgtagcggggctagtatgcatttctcggtgtgatttttttcagaactcttgacaatattaggagtctagaaaactgacaagaaattagtgatctaggactgggatttggtactgcagaaatggaggattctggtgtgcttatggcaacactaactgagttaaggtttgctagaagttcaagattgataatgacctggtaaggaattaaataccactgttctcaacagtatttccatattagaatcatccaaggagtttgtttgtttttaatgatg

SEQ ID NO: 139631 - DNA, 601 bp, Human
agcactttgggaggccaaggtgggcggatcatgaggtcaggagatcgagaccatcctggctaacacggtgaaaccccatctctactaaaaataccaaaaaaaaaaaaaaaattagccaggcgtggtggcgagcacttgtagtcccagctactcgggaagctgaggcaggagaatggcatgaacctgggaggcggagctagcagtgagccgagatggtgccactgcactccagcctgggcgacagagtaagactccatctcaaaaaataaataaattaaattaaattaaattacaataaaasaagtaaccaggtgtggtggcacatgcctgtagtctcagctacttgcgagactgagggacaagaatcccttgaacccaggaggcagaggctgcagtgagctgagatcacaccactgcacttcagcctgggcaacagagcgagaccctgtctcaaacaaaaaaaccccccaaaaaacaaaaatcaataaacagcaaaatcataaacacaaagcacaaaaatgtgaaaaacatgtcgttaaatagactgtgaacagggcatttatttacagtatgagaactggaaccagaagacagtgttacc

SEQ ID NO: 139632 - DNA, 601 bp, Human
gcactccagcctgggtgacagagcaagactccatctcaaaaaaaaaaaaaaaaaaggtgtatctgcttttaaaaagtcctctaagagtcccttaacttctgagttccttataagaaacatcagatgagctctgatgtaactttaaaatgtcccttaaagttgaataaagataccttaattgtaatgaaaaatgaaaaaatggactatttgtacactttctaacagattgtacattttttgacagaatttacctgtgtgtgattatcataaactttatgataatgaatatttgatagtttcygaagttacctttagaagcaagaaaccttgccttttgaatgagattatgtctgttaccagcaatggcatggtcatcattttatctggggaatgattacatcagagctatggaaatcctggactaaagtgattactcctgtaggtcatgcattttgagacaaattgtctacctaaaccgaagtagattactttccctttttcctacataatatttgcttgaattgttaagaaatgtatttaattcttactacatataaaattttatattacatgctctcatgaaattcaaaggaaaatctcc

SEQ ID NO: 139633 - DNA, 601 bp, Human
cattactcttttaccttatcttcaatatgtatcctgtggtagattttgctaattcttttctgtgttgctattttaatactttcttaagcaccctacccttccaccatgtgggcatcaagctcttgtcttcccagtgagtctcatttacatgaggtagaataacctaattctactagtgactgtagcagcttaggacattaaacaaaactatagggcagctgaatttattattttcttttctttttttttagagatggagtctcactctgttgcccaggctgtagtgcagtgtcatgatctsagctcactgcaacctccgcctcccaggttaaagcaattctcctgcctcagcctcctgagtagctgggacgacaggtgcccaccaccacgcccagctaattttttgtatttcagtagagacagggtttcaccatgttgcccaggctggtctcgaactcttgagctcaggcaatctgcccgccttggcctcccaaagtgctaggattacaggcatgagccaccgtgcctggccaagtttattattttcataccaacttgtcataaatcccttctgtaattcctgtctaaaccccagaatatt

SEQ ID NO: 139634 - DNA, 601 bp, Human
tgtccattcatctgatctctgaatatccggctctaatgccaacttctggtactctttgtgtttgtcttgataggaactaatgaggtgagtccctatgtgggattgaattttgaccctggtgctgccataacctctcctgtacctctggagtttcccatctcagttccaccaatttctagctaagtggttacttcttagaaatgtgtgtgcttgtatgtttttagtagagacgaggtttcaccatgttggctggtatggtatcgatttcctgacctcgtgatctgcccgcctcagcctcccaaagtgctgggattacaggtgtgagccaccatgcccggcctaaaaaaatacaaaaaattagacaggcgtggtggtgggcgcctgtagtcccagctactcgggaggctgaggcaggagaatgctgtgaacccaggaggcagagcttgcagtgagctgagatcgcaccactgtactacagcctgggcaacagagcgagactctgtctcaaaaagaaaaaaaaaaaaaaaaaaaaaagaaatgtgtgtgcttagccgggcatggtggctcacgcctgtaatcccagtactttgagaggtcaatg

SEQ ID NO: 139635 - DNA, 601 bp, Human; identical to SEQ ID NO: 80990

SEQ ID NO: 139636 - DNA, 601 bp, Human; identical to SEQ ID NO: 80989

SEQ ID NO: 139637 - DNA, 601 bp, Human; identical to SEQ ID NO: 139625

SEQ ID NO: 139638 - DNA, 601 bp, Human; identical to SEQ ID NO: 139626

SEQ ID NO: 139639 - DNA, 601 bp, Human; identical to SEQ ID NO: 139627

SEQ ID NO: 139640 - DNA, 601 bp, Human; identical to SEQ ID NO: 139628

SEQ ID NO: 139641 - DNA, 601 bp, Human; identical to SEQ ID NO: 139629

SEQ ID NO: 139642 - DNA, 601 bp, Human; identical to SEQ ID NO: 139630

SEQ ID NO: 139643 - DNA, 601 bp, Human; identical to SEQ ID NO: 139631

SEQ ID NO: 139644 - DNA, 601 bp, Human; identical to SEQ ID NO: 139632

SEQ ID NO: 139645 - DNA, 601 bp, Human; identical to SEQ ID NO: 139633

SEQ ID NO: 139646 - DNA, 601 bp, Human; identical to SEQ ID NO: 139634

SEQ ID NO: 139647 - DNA, 601 bp, Human; identical to SEQ ID NO: 80990

SEQ ID NO: 139648 - DNA, 601 bp, Human; identical to SEQ ID NO: 80989

SEQ ID NO: 139649 - DNA, 601 bp, Human
gtatatgaaaatacttgagaatttgcgtctgtttcaggcataaggttaagtacattatgaatagaatattgagtgatttgaagctgggcttcaccatatcgaattaataattatgctttgggctgggtgcggtggctcaagtctgtaatgacagcactttgggaggccaaggctagcggatcacaaggtcaggagtttgagaccagcctggccaatatggtgaaaccccgtctctattaaaaatacaaaaaaaattagctgggtgtggtggcacgcgcgtgtagtcccagatactcaggargctgaggcaggagaatcacttgaacccgggaggtggaggttgcagtgagccgagatcacaccactgcaccccagcctgggcgatagagtgagactcggtctcaaacaaaaaaaaaaaaaaaaaaaaaaaaaatatatatatatatatatatatatatatatgctttgggtccacttcacttttcctaccatcccccactgcttgcttgcctccattttgtttgtttgtttgtttctctctgtcctcctgaggctgttttaaaactctattaatcttctcaaccacctcttctggaatcca

SEQ ID NO: 139650 - DNA, 601 bp, Human
gttccttcctatatctactttcttctattaggattattttcttcttgactgaagatcaccttctaataattccttttgtgcagatgtgttgatcagttatttttgtttacctgaaaggatgtatttgttagatatacattctggggttgacaagtgttttctttcagcattgtgaagatacggttgattttttccccctacactttcatttccttcctagcttccagtattttattgttgccttcttcccacctacttttctttttctttttttatttaatgtttttttttttttattttwttttttttttgagatgaggtctcactatgttgcctgggctggccttgaatccctaggctaaagcgatccacctgactcaacctttcgagtagctgggactacaggcacgaactaccacacccggctcgaagatacaatttctatgtcttcttttttccattgtttgttttgagaaatcatctctcaatctaattttttcacttttaaaagtaattttttttctctcactgtttttaagatgttctcattgtctttggttttcagctgtttcactctgtatacaaagatataattttcttg

SEQ ID NO: 139651 - DNA, 601 bp, Human
ttttccttcgttccttcctatatctactttcttctattaggattattttcttcttgactgaagatcaccttctaataattccttttgtgcagatgtgttgatcagttatttttgtttacctgaaaggatgtatttgttagatatacattctggggttgacaagtgttttctttcagcattgtgaagatacggttgattttttccccctacactttcatttccttcctagcttccagtattttattgttgccttcttcccacctacttttctttttctttttttatttaatgtttttttttwtttattttattttttttttgagatgaggtctcactatgttgcctgggctggccttgaatccctaggctaaagcgatccacctgactcaacctttcgagtagctgggactacaggcacgaactaccacacccggctcgaagatacaatttctatgtcttcttttttccattgtttgttttgagaaatcatctctcaatctaattttttcacttttaaaagtaattttttttctctcactgtttttaagatgttctcattgtctttggttttcagctgtttcactctgtatacaaagatata

SEQ ID NO: 139652 - DNA, 601 bp, Human
cttcctcctagttgtgacaaccaaagaatgtttccaggcattaccaaatgtaacccgcccctcaattgagaaccacttgtttaggtttacctaaacatttatcattttccttcgttccttcctatatctactttcttctattaggattattttcttcttgactgaagatcaccttctaataattccttttgtgcagatgtgttgatcagttatttttgtttacctgaaaggatgtatttgttagatatacattctggggttgacaagtgttttctttcagcattgtgaagatacggttgattttttccccctacactttcatttccttcctagcttccagtattttattgttgccttcttcccacctacttttctttttctttttttatttaatgtttttttttttttattttattttttttttgagatgaggtctcactatgttgcctgggctggccttgaatccctaggctaaagcgatccacctgactcaacctttcgagtagctgggactacaggcacgaactaccacacccggctcgaagatacaatttctatgtcttcttttttccattgtttgttttgagaaatcatctctcaa

SEQ ID NO: 139653 - DNA, 601 bp, Human
gagttttttaatgcagtttaacaatttttgtcttttaattggaacatttaggctgtttatatttaatgtaaaatttaatgtttgaattgaaatatactttctatttgctttttatttgtcctacatgttctatgttcctttttctgttttctttctttttaacttgttgcttggtttttattatttcattagtaattatacactttttaccattcttttctttgtagagattaccacatacatccttgacttatcaaagtcttaatataaattagtacctttacctcttcctggacaatasaagaaccaggatgaacttcaactccatttaccctatcccagtatatattctgtttcagttctgtgttttaattatatatgtatttttaaaccctcaaaagattatttttattttgtcaaagtttatttagatcagatttttcatcctcatcactattaacgttttgcgccagataattctttttttatggggagatgccctgtatattataggctatttatcagcaatccgtggcctctacccactagatgccattagtaccttcctcctagttgtgacaaccaaagaatgtttccaggc

SEQ ID NO: 139654 - DNA, 601 bp, Human
agcaactgtaagtctcattcggtgctggtgggaatgcaaaatggtacagccactttggaagacactttggcagtttcttttaaaacttaacatactgttgccatacaacccagcaatcgtgccccttggtatttacccaaataagatgaaaatctatgtccacacaaaaacctgcacgcagatatgtataggagctttattcataattgccaaaacttagaagcaaccaacatgttcttcaataggtgaatggaaaaaaaactatggtatattcagacaatggaatattattcaacaccaraaagaaatgagccatcaagccatgaaaatacatggaagaaccttaaatgcatataatatataactaaatgaaataagccaacctgagatggcatatgtatgatttcaactctatgacattctagaaagggcaaaactatgcaagctataaaagaatagtgaatttggggcggagagggatgaataggtggaacacagaggattcttagggcagtgaaactcttctgatacagtatagtcagccctttatatcacaggttctgcatctgtggattcaaccaaccatgagcgaaaaatgtag

SEQ ID NO: 139655 - DNA, 601 bp, Human
tactggatagcacatgtatgtaagtaaactattaatacttgagactgggaaaagaactaacctaaaggacaaaggggaaaacaaagcaaaacaaaacaaaaaaaacaggtctctggagcttaaaaaagaccaggaagagtttgtgttccaccagtcagagtggaaaaccttacaattcacagggcatctggtagagtactcagaagagcattagctcagtagaggaaaataattagccctaggctaaaggctgctgtgatcccatttaataaagcttaaaagcaagcctttctgaaagaattaaactgcgtacaataacttgacagtgtctcagataacccaacaaatgttttaggatccaatgtaaatttaccaggtacacaaagaaacaggaaaagttgacccataatgggaaaaatcagtttattgaaaccagttcagaaatgacagtgctgatatactaataaagtaggtgtttaaaaatcattatacctatattctatatgttcaagaagtgagaagaaggattaaccatgtaatgtagaaacatagaagatatttttaaaaacccaaatcaaacttttaaagatgaaaactacaa

SEQ ID NO: 139656 - DNA, 601 bp, Human
agttttcagtacagtcatgggctgtacaggtttgtagcctaggagcaataggctctaccatatagcctaggtgtatagtaggttgtcccatctaggttcgtgtaagtacactttatgatgtatgacaacaaaatcatgtaacatcacatttctcagaatgtatccttgtcgctaagtgacatatgactgtaatttgttgatatccagattcttagaagtctgcttcacaacctaagacaagctgtgggaaattccaagggtatctaaactgaaaaccatgagcatgagctcagggtaatgmatgccttcctcaagccacagtgtctaccacccaaatgtttaggaaatgcagggtgatcagtgctaagtcttggcaaatattgtgattgtttcttagtagaaacctacaatggtagtagcaaacatatggctgccatcctgggtccttggcctaagtacagatgtcactaactgacctattttttacattctgcatacagtatatcacctgaaggccaagaaaatgagcatggttttgtggagatcaccttccctgtattgccataacaacattcctactagtttgacaactagtaaccag

SEQ ID NO: 139657 - DNA, 601 bp, Human
aaattattttagaccatattcttaccatacctttcctatgtgtagatatgtttattatttatttatttatttatttagagacagggtctggctctgccacccaggctggagtgcagtggcaccatctcagctcactgcaacctccgcttcctgggctcgagccaatctcacacctcagcctcccgagtagctgggactacagacccgtgccaccatgcccagctgatttttatattttttttgtagagacaggatttcactatgttgcccaggcaggtctcaaactcctgagctcaagtgwttcacccacctcagcctcacaaagtgctaggattacaggcatgagcccccacacctggctttagatatgtttagatacacaaataccattctgttccagttgcctacagttttcagtacagtcatgggctgtacaggtttgtagcctaggagcaataggctctaccatatagcctaggtgtatagtaggttgtcccatctaggttcgtgtaagtacactttatgatgtatgacaacaaaatcatgtaacatcacatttctcagaatgtatccttgtcgctaagtgacatatgactgtaat

SEQ ID NO: 139658 - DNA, 601 bp, Human
atcccagcaactcgggaggctgagacagaagaatcgcttaaacccgggaggcggaggttgcactgagtagctaggactacaggtatgcaccaccatgcccagagtgcagagagactctatctccaaaaaaaaaaaaaaaaaaaaaagcacatacaattatgtacagtacagtacataatactttcatatacaactatattactggtttatgtatttactatactatactttttatcattgttttagagtacatgccttctatctatttaaacaaacattaactgcgcaacagcctgaggtrgttccttcaggaggtatttcagaagaaggcattcttatcatgagtgttattacccatgaagaccttccagtgggacaagatatggagggggaagacagtgatattgatgatccagacccaatgaaggcctaggctaatgcgtgtttgtctcagtttttaacaaaaatgtttgaaaagttaaaaaataaaaatagaaaaaagcttacaaaattacgctataaagaaagaaaatatttttgtacaactgtacaatgtatttgtgttttaagccaagtgttattaagaaggaatttttttaaa

SEQ ID NO: 139659 - DNA, 601 bp, Human
ttagctgtgtgtggtggtgcacgcctgtaatcccagcaactcgggaggctgagacagaagaatcgcttaaacccgggaggcggaggttgcactgagtagctaggactacaggtatgcaccaccatgcccagagtgcagagagactctatctccaaaaaaaaaaaaaaaaaaaaaagcacatacaattatgtacagtacagtacataatactttcatatacaactatattactggtttatgtatttactatactatactttttatcattgttttagagtacatgccttctatctatttaaamaaacattaactgcgcaacagcctgaggtggttccttcaggaggtatttcagaagaaggcattcttatcatgagtgttattacccatgaagaccttccagtgggacaagatatggagggggaagacagtgatattgatgatccagacccaatgaaggcctaggctaatgcgtgtttgtctcagtttttaacaaaaatgtttgaaaagttaaaaaataaaaatagaaaaaagcttacaaaattacgctataaagaaagaaaatatttttgtacaactgtacaatgtatttgtgttttaagcc

SEQ ID NO: 139660 - DNA, 601 bp, Human
aggcagcatgtcataggcgtaatctatagcagtagcggtttaaatgaatctcctttgtgcttaaacagcatatctttaacttattggagagtagctagtaggagcgggcttaactaggagcctgtacgtctgtccacatttcagtgtttcagaggagtgtctttctccttgagcacagtgtttatagataagagagcaggttgcactcagagcatgggaacataacggcgataagaaggctttcctcctcagagacctcttgtggctttccacaacttattgtcccatatttttatggccrgtttatgcaggcactccataagccttttccccaacaacaatttgtaaacaaatgagcatggatgtgttccagggaaactcattaccagtaaaggtggtggatcagacatggccccctctctgggccctactgttctgcaggttttcaaagattacttgggagatttctctccacctgtttgctaagacgttctgtgactgatgtaatccacaacccattttcccagccgttttctgttttgtgcttttattctctagctttataattgtctggggggaagggcgtgatggtgccatataa

SEQ ID NO: 139661 - DNA, 601 bp, Human
atgctataatcaaagttaacaataggaagtcttgctactggtgtaaaaactgttgtttgctgaattccaagctgtctgtttgatctgtgcttgtgtgaggttgaacttttcctcaaccttctgtggtagatcttcctcctttgcttcctaggaatttcttcattttttccaaagtcagtttgaaaaatgataagcagaaaaaaacaaaacaaaactgcaatcttcatgtttgatttttttccaccagccaatttctagaatgaaacaatatttcaaagttagtggtgactaaatttttacytctgaaaattggcttatatatttgcttgtatgcctcagtaggcaagtctttgagaaattacacttatgatatatggactatatgctatagtattattgccaaatcataatttggaattcttctatcagaatcaaaaaacttttttttttttttaaatagagatggggtcttgctccatcgcccaggctggagtgcagtggttcagtcatgactcactgcagccttgaactcctgggctcaagcagtcctcctgcattggcctcccaaagtgctgggattacagcatgagtcaccatgcct

SEQ ID NO: 139662 - DNA, 601 bp, Human; identical to SEQ ID NO: 22157

SEQ ID NO: 139663 - DNA, 601 bp, Human; identical to SEQ ID NO: 22158

SEQ ID NO: 139664 - DNA, 601 bp, Human; identical to SEQ ID NO: 22159

SEQ ID NO: 139665 - DNA, 601 bp, Human; identical to SEQ ID NO: 22160

SEQ ID NO: 139666 - DNA, 601 bp, Human; identical to SEQ ID NO: 22161

SEQ ID NO: 139667 - DNA, 601 bp, Human; identical to SEQ ID NO: 22162

SEQ ID NO: 139668 - DNA, 601 bp, Human; identical to SEQ ID NO: 22163

SEQ ID NO: 139669 - DNA, 601 bp, Human; identical to SEQ ID NO: 22164

SEQ ID NO: 139670 - DNA, 601 bp, Human; identical to SEQ ID NO: 22165

SEQ ID NO: 139671 - DNA, 601 bp, Human; identical to SEQ ID NO: 22166

SEQ ID NO: 139672 - DNA, 601 bp, Human; identical to SEQ ID NO: 22167

SEQ ID NO: 139673 - DNA, 601 bp, Human; identical to SEQ ID NO: 22168

SEQ ID NO: 139674 - DNA, 601 bp, Human; identical to SEQ ID NO: 22169

SEQ ID NO: 139675 - DNA, 601 bp, Human; identical to SEQ ID NO: 22170

SEQ ID NO: 139676 - DNA, 601 bp, Human; identical to SEQ ID NO: 22171

SEQ ID NO: 139677 - DNA, 601 bp, Human; identical to SEQ ID NO: 22172

SEQ ID NO: 139678 - DNA, 601 bp, Human; identical to SEQ ID NO: 22173

SEQ ID NO: 139679 - DNA, 601 bp, Human; identical to SEQ ID NO: 22174

SEQ ID NO: 139680 - DNA, 601 bp, Human; identical to SEQ ID NO: 22175

SEQ ID NO: 139681 - DNA, 601 bp, Human
aaaataaaataagttcttcagtgcccaatgaatagctctgcaagacagcacggggactctcagttattaaatgaatgaacactaagattgacattctggtttcttattatcttatgtatctgaaataactaggcttcaaaaaactcttaactattcttcctttaaaagtctacggccaggtgcagtggctcaagcctataatcccagcactttgggaggccaaggcgggcggatcacctgaggtcgggagttcgagaccagcctgaccaacatgcagaaaccccgtctctaataaaaatamaaaattggccgggcatggtggcacatgcctgtaatctcagctacctgggaagctgaggcaggagaatcgcttaaacccgggaggcggaggttgtagtgagccgagatcacgcccttgcactccagcttgagcaacaagtgcgaaacaccgtctcaaaaaaaaaaaacaaaaataaataaataaaaatcgactaaactagttgtatctttataagacagaaaactgatgtacgcagaagaatgacaaactattttttattcacaaatcctaagtcacttgatttcttttcgacaaaaacaa

SEQ ID NO: 139682 - DNA, 601 bp, Human
cttctgcctatttgttcaccgcactatccctagcatctagatctgtgtggtccaatgtggacagtcactaagttacacgtggctatttaagttaaattaaaaattcagttgcagctgggtgtggtagctcatgcctgtaatcccagcactttgggaggccaaagcaggaggattacttgaggccaggagttcgaggccaggctgggcaacacagcaagcccccgtctctattaaaaaaaaaaaaagattagttgggcatggtggtatgtggtcccagctactcgggagtctgaggtgggargatcgcttgagtctgggaggtcaacgcagcagtgagctgatcgcaccactgcactctagcctgggcgacagagtgaaaccctgtctttaaaaaataaaataaaataaaataagttcttcagtgcccaatgaatagctctgcaagacagcacggggactctcagttattaaatgaatgaacactaagattgacattctggtttcttattatcttatgtatctgaaataactaggcttcaaaaaactcttaactattcttcctttaaaagtctacggccaggtgcagtggctcaagcctata

SEQ ID NO: 139683 - DNA, 601 bp, Human
gccaggcgtggtggctcatacttgtaatcccagcactttgggaggccaaggtgggcagatcacctgagggcgggagtttgagaccagcctgaccaacatggagaaaccctgtctctattaaaaatacaaaattagctgggtctggtggcgcatacctgtaatcccagctacttgggaggctgaggcaggagaatcgcttgaacccaggaggtggaggttgtggtgagccgagatcacaccactgcactccagcctgggcaacaggagcaaaactccgtctcaaataaataaataaataaaatctaacacagaatcccaatattaaccatcggattatttaatttcagtggttcttttttgggtacactatacaagactactcaaattctacattcaacacgcataggatttgggagtaagaagtttatgatgaattttaaaatttgctcatccccctaaatacaattcatttatgaataagtctaaatacccttttagttttctcaatagttggattctagcaagcaaacatctgccccagccactagttaagagcccactccaaaaagaaatcaccctaagaaaagctgagaaactctct

SEQ ID NO: 139684 - DNA, 601 bp, Human
ggccaggcgtggtggctcatacttgtaatcccagcactttgggaggccaaggtgggcagatcacctgagggcgggagtttgagaccagcctgaccaacatggagaaaccctgtctctattaaaaatacaaaattagctgggtctggtggcgcatacctgtaatcccagctacttgggaggctgaggcaggagaatcgcttgaacccaggaggtggaggttgtggtgagccgagatcacaccactgcactccagcctgggcaacaggagcaaaactccgtctcaaataaataaataaataatatctaacacagaatcccaatattaaccatcggattatttaatttcagtggttcttttttgggtacactatacaagactactcaaattctacattcaacacgcataggatttgggagtaagaagtttatgatgaattttaaaatttgctcatccccctaaatacaattcatttatgaataagtctaaatacccttttagttttctcaatagttggattctagcaagcaaacatctgccccagccactagttaagagcccactccaaaaagaaatcaccctaagaaaagctgagaaactctc

SEQ ID NO: 139685 - DNA, 601 bp, Human
tttacagccacagaactagtcatactttacattcttttcgaagctacactcatccctaccctaatcattattacctgctgaggtaaccaaccagaatgcctaatgcaagctcatacttattttacacactagtaggatcccttcccttacttattacactcatccacacctgaaatagctcaggttcactaaatatcctaataataatgtttactaatcaagaactattaaacttctgatctaacaaccttatatgactagcatgtattatggcttttatagtaaaaatacccctatacgracttcacctatgactccctaaagcccacatagaagtctctattgccagctcagtagttaggaggctacggtatcatatgacttaccctcatcctcagccccctaatagaatatatatcctaccccttcctcatactatccttatgaggaatagttataacaagctctatttgtctaagacaaactgatttaaaatcacttatcactcattcctccgtaagccacatagcacttgttattatagctatccttattcaaaccccctgaagcttttcaggcgcagtcactttacttcaacttc

SEQ ID NO: 139686 - DNA, 601 bp, Human
attcataatacccattatcctcttagtatttgctgcctgcaaagccgcagtaggccttgctttcctagtctcaatctccaacgcataaggcctagactatgtacaaaatctaaatttactccaatgccaaaaattattattccaacaattatactgttacaatataactctccaaaaactctatagtctgaatatagctactcatagcctattcatcagcctcattaccctattattttttaatcaaccaaacaataattcatctaacttctcattaactttttcttctgacgcattaacrtcacctcttctaatccaaacagcctgactactacctcttataatcctagcaggccaacatcacctatctaatgaatcacccttatggaaaaaaactccgtatttccaaattaattttcctacaacttttttaaattacagcatttacagccacagaactagtcatactttacattcttttcgaagctacactcatccctaccctaatcattattacctgctgaggtaaccaaccagaatgcctaatgcaagctcatacttattttacacactagtaggatcccttcccttacttattaca

SEQ ID NO: 139687 - DNA, 601 bp, Human
aagactccaagatggcgatcggtaaccatcttggctaccctgactcagcattcccggattcaccggttcccgccatctcggcagccatcttggctaccctgacttggcattttcgcttattcccgccatcctgacagccacatcgggtaccctgactcagcatttccgggttcacctttcctgttcccgccacccggaccaacgcgcatgcccactagggcgtgtcacactcagaagcacgaaactcaacctatcccgcccctaccccgcccactcctcacccagcatccataaaagcgckctgcacctttggcacagcgcgacttccctggccctccccctgcggaccagtgaacctcgcccgagagctcagtaaagatttttgccctctttgtctcgcccctcagccttattgatccacagtgcccttccattgcctttcactatcaacaaaacaaccttcaattttcttgtagtttctgcaaacaatttacataatgttcttgatgacaataaaaatattgtgcatattgaaaaaaaagaagggatgttaacaatcaccagatattgaggaagtgtctaacagatcaataaaactgat

SEQ ID NO: 139688 - DNA, 601 bp, Human
aaattgaagaaaagtaacactgaatgtaatctgattggactccggtgaagactccaagatggcgatcggtaaccatcttggctaccctgactcagcattcccggattcaccggttcccgccatctcggcagccatcttggctaccctgacttggcattttcgcttattcccgccatcctgacagccacatcgggtaccctgactcagcatttccgggttcacctttcctgttcccgccacccggaccaacgcgcatgcccactagggcgtgtcacactcagaagcacgaaactcaacctaycccgcccctaccccgcccactcctcacccagcatccataaaagcgctctgcacctttggcacagcgcgacttccctggccctccccctgcggaccagtgaacctcgcccgagagctcagtaaagatttttgccctctttgtctcgcccctcagccttattgatccacagtgcccttccattgcctttcactatcaacaaaacaaccttcaattttcttgtagtttctgcaaacaatttacataatgttcttgatgacaataaaaatattgtgcatattgaaaaaaaagaagggatgttaa

SEQ ID NO: 139689 - DNA, 601 bp, Human
attaggtgtgagttacataatgaatggtaagaccctgggcctcttgccttcaactcagctcccaaatggtggaaagcagctttttacctgcaaagtaatagactagaggactcctctcctgggaaacacaaagccaagagaataaaaactataaatactaagtttgggggtcccctcaaataaacgaacaggtccctgtctgattatcctagtgcaagcccctcagtcaaaaagcccaccccatcctcacccctctaaaacacaaatggtaactaaatgtggtgatggatatgttaatttgattgtggtcattatttcacaatgtgtgtgtgtgtatatatatataaatataaaatcatcttattatacatcttgaatatatacaatttttatttagcaattatacctcagtaaaactgaagaaaaagccaagcccattttaacagggctctcaatgaccattttcatgtgtcattcttgaaaatagaccatccttacatttatggtcaactgattttcaacaagacaactcagaagggaaatagtcttttcaacaaacggtgctaggacaacttgacatccacctggaaaaagataaaga

SEQ ID NO: 139690 - DNA, 601 bp, Human
aactgtgtacatacaaatacctggaaaatgacagcagttaccccacaaaccactaggtttcacacaaatttttctctacggataaagttgaacagccaggtataaagtgaattccagccatattaaaaatctaaaaggtattttagaaaagataacaaaatgtggaagaatgtctttgggacctcagggtaggaaatgatttcttaaccaagtctttaagaatacaaaccgtaaggccaagatggatgcatctgaccaagtcaaaattaagaaatttggttcaacgaaagataccaaagayaaagttaacagacgggtgatagagaagaggtttattgtatttcactgaatctaagatgtcatcaattgtattttatccatcactaaggaagagaaacagtgtcaattaaaatacaatgatgttttcttgtcatgtgcagctttttagtttatgcttaatgcaaaggtctattatacattcttagacccagatttttgttacactacatttgtacttatgaaaaggaaaatgtaagtcaagacattcctaaaacctctttaactgagttctgtccctctcctctaagtcactgataccaca

SEQ ID NO: 139691 - DNA, 601 bp, Human
ataaggaatacgtactttattatctttcaaaacctttttttaagcctgaatcctgaattacactcagggtgttttgtaaagagaatgtcaatcaatactagaaaagattaaaaatgtaaattaagtgttcaactaagttagaaaaagaacagagtacacctaagagatatattaatagaagttaaataagaagtaaaaatttcagaaaatacaacataataaagaaaagtcatgcaatgatcttagatgcagaaataacatttgatgaagttcaacatctatttataaaactcttagaaamctagatcggaggaaatggtctcgaattgataagactataatacctaaaacctacagatattaactgggaaacaagagagccattacttttatgaatatgaacaaaacaaggatgcttggtatctttttactattcagcatattactaaaggccataccagtaaaactgtaagtccaaaaatgtgaataaacaagtgtgcacacacacacacacgtctgagaagagtcacactgttatcagcaggtgatatgatcaccttacataaaaaactcaacgaaatcaacaaaccattggaattaa

SEQ ID NO: 139692 - DNA, 601 bp, Human
tggtgaaaccctgtctctactaaaaatacaaaaaatattagccgggtgtggtggtgcatgcctgtaatcccagctactccagaggcggaggcaggagaatcccttgcacctgggagagagacactgcagtgagctgagacggtgccactgcattccagcctgggcaacagagtgagaccctgtctcaaaaaacaaacaaaaaaaaattggacaggaattacttatgttaagcatgaggagaagaaaagaataagggaagtctaatcaagaaaacctgatcaagcagactaaaggcaagggraaaaaaaaagaaatgaaaaaattaaggccactgccctggaacaaaagaccacttctgtcagctgctcctgcaactaggtgtggccagcattgccgtaaccaagctgacaggcccagaaggagactcttttctgcccatctgcctgacatcctcccttaaggtgacttatgaatggaagtcacacacctcaaggacagaacacaggatggtaacctgggtccctaatcatctgtggcgctagctaccttgctccccacttgtgagggcaaataaacttctactttccctaagccatctaag

SEQ ID NO: 139693 - DNA, 601 bp, Human
ttcaggagcaaagaatatacacttaataaaaacaaccataaaatgccggtcttctttgatgactcccagggaattcactgtatttgaaatcatacattcatcaaatatttagttggcctgttcccggattatccatacacaaggaaatcaatgatccttcatcttcattctagaaagataaaaaactacactgtttatcccccctccctccaccccaggcaatctgctctccactttcttcctagagctgtttctcagccccctgcgtggctagtcatggcaggggttccgctctcatcartggactgtgggcagaagtatgaggccatctcccctgcataaagagtactgctgctctgcactcgttcctcacgctgcaatccccacacatgcacacgaggatgagcccaccatgcccggctaattttattattttttgtagagacagggtctccctatattgcccatgctggtatcaaattcctgggctcaaggaatcctcccacctcagcctccccaaagtgctgggagtacaggtgtgagccaccatgcccagcctaaaattgaatcttaactattgaaagcagtagtctcaaagaga

SEQ ID NO: 139694 - DNA, 601 bp, Human
caccccttatcatcccattgaaacatggccacccttatcctgctcaatgccaataccccatcccacaacagactttaaggggcctaaagcctgttattacctgtctactacagcatggcctcttagtccctaccaactccccttacaactctcccatcctacctattcaaaaaccagataaatcctacaggctagtccaagaccttcgtttcatcaatcagattgtcctccccattcatcctgtcatgcctaacccttatactctcctatcctcaataccgccttccacaactcattattytgttattgacctcaaagatgccttctttaccatccccttacatccctcttcccagcccctttttgcctttacttggactgaccctgacacccaccagtcccaacaactcacctggaccgtcctgccctaaggtttcagagacagcccacactactttagccaggccctctcccgtgacctgctttcttttcgtccatttgtttcccatctcattcaatatgtggatgaccttcttctttgcagcccctcttaccaatcctcccagcaagacactatcctgcttcttcaacacctctactc

SEQ ID NO: 139695 - DNA, 601 bp, Human
taggagaagggaggaggaacagtgttctagtcagaaagagcatgtgcgtgggccccaaggtgagaggacactagcatacagggctggcaaggctacagcttaaacacctcagggaaaatggtacaaaatcagcctgaaaaagtgatgcagagctcacaagatcatacaaaggacttgggtctttattttaggaacaatagaagctctaaattgtattaaataaaatgtgacaaaataggatttacattttaaaaagattactctggctgtgatgttaaaaaggaaaagaggaggccaggcrcagtggctcacgcctgtaatcccaggagttcaagaccagcctggccaacatggtgaaaccccatctctactaaaaatacaaaaaattagctaggtttggtggtgggtgcctgtggtcctagctacttgagaggctgaggtaagagaattgcttgaacccgggaggcggagcttgctgtgagccaagatcactccactgcacttcagcctgggcgacaagagtgaaactccatctcaaaataaaaaaaattaaaaaataaaaataaaaaaaggccaggtgcggtggctcacgcctgtaatc

SEQ ID NO: 139696 - DNA, 601 bp, Human
caaatgcttctgaagatgtggagaaccttgatcattcatatcttgctgatgggaacataaaatggtatagacactttggaaaatagtttaggagttcctttaaaaactatgcaatactataaacatagcaactgcattccttggcatgtattccacagaaataaaaacttatgctcacatagcatgaatgtacatgaatgtttagagcagctttttttttataacagcacaaagctggcaacaactcagatgtctttaaaaggtaacttcaataacagtggtaccttcatgccatggagtcatactcatcaatcaaaaggaaccaactctggatacaagcaacaacttggatgaaccatcagagaattacgctaaatgaaaaaagccaaccccaaagtgttgcctactggatgattccatttgtataaaattcttaaaataacaaaattaacaaacagaacagattagtggttgccaggagttaaggagtgggcagatgggaggaatgtggatgtggcaacatgaaggatccctgtggcgacagaaatgttctgcatcttgacaatgacaaagtcaatatcctggctgtgaaactgttcgt

SEQ ID NO: 139697 - DNA, 601 bp, Human
acagataatttgaatagcctgataactactaaggaaactgaattcagaattaagatacttgcaaaaaagaaatctctccaggcccagatggtttcatgggagaattctaccaaacaattaaataattaaaagtaattctatacaaatagctccacaaaatagaagatagaacgcttcccaattgattctgtgaagtgttattctgctaccaaaaccaaagtaagtatcaaaaaaagtgtattataggacaatctccctcatgaacacagattcaaaatccttaacaaaagactggcaaatygaatttagctttttataaaaaaaaaattataccccataaccaagtggtatttatttcaggtatgcaaggctggttcaatatttgaaaataaatcaatgttatccaccacattaagagactaaaaaagaaaaatcacatgatcatatcaaccaatacagaaaaagtagttgaccaaccaaattcacattgatttgcaatgaaaatgctcagaaaaaaaagatgaggtgcaggaaagtgaatgtaataaagagcatctgtaagaaatctgcacgtaacattatacttattggtgaaagagta

SEQ ID NO: 139698 - DNA, 601 bp, Human
cttactatggatgacatatcagtttattcacatacttttctctttctaagaaacataaaatactggtgtgcctcaccatcagtggcatctctgatatgactgacacattactctgccattattttgccctgagaagtaatactggcagcccagctagacagaaaacttttagacaatgactattctactgtagccaaacaccacagaaaaaaatgaggggtacccagccccatctatgtcagcaaaggctgagaagggaacttagactttgaccctcgagaggctgtaacaaggcgacacmcctcctagggtgttgtcagggaaggccaagtaggaagctgagccttttattcctatcagttggtaacaagtggaccccctccacccccactgtggtgtcagcaaagaacacatggagagccctaacttccacctgcacttgggagtagtgggcaccctccccatctcctcctgggcagtgtcacaggagggcgagtggagagtcaggactattagcatcacccagcagcaacaaagaaacccccaacgatgtcaatggaggccgagtagggcccctgaattgttcctcctcctggcagta

SEQ ID NO: 139699 - DNA, 601 bp, Human
cccacaggcagtagctgctcagagcaggatacaggtggggtggggagaaagggcttcactttgttcatatattaatataataagcttgctgccattctttcctcatgtaattgatacatgatttattctggtatgaataagcctattctgaattcactaggtacatgtcattaaaggcctagtaagttttggtgtcattatgcccagctatgagtagacatctccctgcctcactaagcacatgctgtttttcagcctctcttgatctctcagaaagctgcttggattacctccctccaayttgctatatgtaattacggcaatgacaaggcaattacaatcagacttggctctccaacaccaagtacatttaataagcaggaacaccttaatatccaaatgtgatccacaggcaagttttcatgacaaattaccatttcatatataatttagctggttagaaagtacaaaagaactgtataattttcttcaaaagaatcataccttttgatcttcgatctcttgttcttttagtagtcgctcgaggtcagccatgtcattatgcttaaataacttaatgtcactacgggatgcctgtaat

SEQ ID NO: 139700 - DNA, 601 bp, Human
taagtttcaagatatttaattttacttcttgttgctcatttaaaaaaaagttctatggcttacagatcttgtagaaaaagagcacatacaaaacttgaatctgatgttttccaaatttatacaatactaggcaaaacaaatggcagcagactgcagttctagtactgaaaacagactagctttctattactgcatcatcataagaaacatctttttatactttgtaaaagaaattaatcagtggaatgggctgttttcagattttgcctatagatttttctaaattgtgtaaatgtgaaaygttagcctagagcagagttagtataaaatggcaagatcatgcatattcatcatgagaatgtgtatattcatgaagtgatgcacttaggctgacacctaaacaaagatgacagaatcctaaatgaataatgcaaatatttggaaaattgaaaattaacacaaaatacacaaaattaagaaatgtgatgagcatttttatcatttattctagttatgactgagttgcactggcaaagtccacttgaaactgtgtctgagatgaagacacacatcatggtgtcctgctcagaaccacagacct

SEQ ID NO: 139701 - DNA, 601 bp, Human
ccaagagtttgagaacagcctgggtaacgcagtgagacccctactccacaaaaaagggaaaaatcagccaggtgtggtggcatgtgcctgtagtcccagctaactcagaaagctaaggtggaaggatcacttgagcccaggagggtaaggctgcagtgagctgtgttcacaccactgcactccagcctgggcaacagagcagtcttgattactctttgaaggccagcactggcattcagtgttgttcttcttccctgatctgagcaaaatatgcttatgaggcctaatgcgcaaagcaacrcagacgttatacactaaaagcggtcataaacaaaaggcacatctgtcaaatagtccaaatattaaaattacagctgaacatggttgcttaccaattctggaagaggacaaatagttccagtattcatatacaatccttctactacaatgaaacgccgagttacacgagccttgcgaggattctttaaaagagaaaaagcagacatcttacatttcagtaactctgaagacaagatctgttacatattccccagcactttcaccttacaagatttattcctaaaaaaatattctgaatgaa

SEQ ID NO: 139702 - DNA, 601 bp, Human
tcttaaaagctacgtatggccgactcagtggctcatgcctgtaatcccagcattttgggaggcccaggcgggcagatcatgaggtcaagagattgagaccatcctagccgacatggtgaaaccccgtctctactaaaaatacaaaaattagctgggggtgtctgcgcacgcctatagttccagctactcgggaggctgaggcaggagaactgcttgaacctcggggaggaggttgcagtgagccaagatggcgccactgcactccagcctgacgacagggcaagactgtcttgcgggggaraaaaaaaaagctaaagctaagttttggccaggtgtggtggctcatacctgtaataccagcactttggcaggctgaggcaggaggatcgcttgagcccaagagtttgagaacagcctgggtaacgcagtgagacccctactccacaaaaaagggaaaaatcagccaggtgtggtggcatgtgcctgtagtcccagctaactcagaaagctaaggtggaaggatcacttgagcccaggagggtaaggctgcagtgagctgtgttcacaccactgcactccagcctgggcaacagagcagtct

SEQ ID NO: 139703 - DNA, 601 bp, Human
taggaatgtaaaatggtgcaatcgctgttgaaaacagtatgtcagttccttattaagttaaacacagaattaccatataatccagcaattaccctgctagatatatacataaaagaactgaaaacaggaattcaaacaaatacctgtacacaaatgttcacaacagcactatttgcaatagcaaaaaggtagaaagaacccaaatatccatctgtggatgaacatataaaacaaaacgtggtattatccatgcaatggactataactcagcattaaaaaggtatgaaatactgatacatgrtatacaatgttaatgaactttaaaaacatcaagtgaatgaagccagaaagaaaaggtcatatattatatgatgccatttataggaaataaccagaaaaggtaaatccatagagacagaaagcagattggtagttgctgggagctagagggagaagaaaatggggagtgactgtttaatgggtttgaggtcttcttcgtgagtcatgaaaaggtttttgacctaaagttgatggttgcacacatggtaaatgtaataaatgtcactgtcctgtacaatttaaattggttaattttgtgtta

SEQ ID NO: 139704 - DNA, 601 bp, Human
aaccacagtgagatactacctcatgctcactagggtggctaaaacaaaccaacaaaaaaccctggaaaatataagtgctgacaaagatgtagagaaactgtaaccctggtatatagctgataggaatgtaaaatggtgcaatcgctgttgaaaacagtatgtcagttccttattaagttaaacacagaattaccatataatccagcaattaccctgctagatatatacataaaagaactgaaaacaggaattcaaacaaatacctgtacacaaatgttcacaacagcactatttgcaatarcaaaaaggtagaaagaacccaaatatccatctgtggatgaacatataaaacaaaacgtggtattatccatgcaatggactataactcagcattaaaaaggtatgaaatactgatacatggtatacaatgttaatgaactttaaaaacatcaagtgaatgaagccagaaagaaaaggtcatatattatatgatgccatttataggaaataaccagaaaaggtaaatccatagagacagaaagcagattggtagttgctgggagctagagggagaagaaaatggggagtgactgtttaatgg

SEQ ID NO: 139705 - DNA, 601 bp, Human
attaaacaaagattttaaaataaaacacaaaagcacaagcaacaacaaaacacataaactggacatcatcaaaatttttaaaaactgtgtgtcaaaggacagtatcaaataaatgaaacaaacccccacaaaataggagaaaatatttgcaaatcatgtatctgataaacatctagtatccagaatatacaaggaattcttttaaaaacaaaaaaacaacccaatttaaaaaatgggcaaagcacctgaatagatatgtctccaaaggtatacgcatggccaaacaaacaaacaaacaaamaaaaaaacaagaaaagaggctcagcatcattagccatttgggggaaacaggatcaaaaccacagtgagatactacctcatgctcactagggtggctaaaacaaaccaacaaaaaaccctggaaaatataagtgctgacaaagatgtagagaaactgtaaccctggtatatagctgataggaatgtaaaatggtgcaatcgctgttgaaaacagtatgtcagttccttattaagttaaacacagaattaccatataatccagcaattaccctgctagatatatacataaaagaactgaaaa

SEQ ID NO: 139706 - DNA, 601 bp, Human
attcacctgcctcggcctcccaaagtgctgggattacaggcgtgagccaccgtgcccggccagattaaacaaagattttaaaataaaacacaaaagcacaagcaacaacaaaacacataaactggacatcatcaaaatttttaaaaactgtgtgtcaaaggacagtatcaaataaatgaaacaaacccccacaaaataggagaaaatatttgcaaatcatgtatctgataaacatctagtatccagaatatacaaggaattcttttaaaaacaaaaaaacaacccaatttaaaaaatgggsaaagcacctgaatagatatgtctccaaaggtatacgcatggccaaacaaacaaacaaacaaaaaaaaaaacaagaaaagaggctcagcatcattagccatttgggggaaacaggatcaaaaccacagtgagatactacctcatgctcactagggtggctaaaacaaaccaacaaaaaaccctggaaaatataagtgctgacaaagatgtagagaaactgtaaccctggtatatagctgataggaatgtaaaatggtgcaatcgctgttgaaaacagtatgtcagttccttattaagttaa

SEQ ID NO: 139707 - DNA, 601 bp, Human
aaagataaagggcatccaaattgaaaagaaacaagtaaaattatctctattcacagatggtgtaatcttatacatagaataagatccacaaaagtattatttgagctaataaattcagcagaagttacattatgcaaaagcaatacacaaatatctgttgtatttctataaatagcagtaaacaatctaaaaaggaaattaaggaaacaattccatttatagtagaataaaaaaatcaaatacttagtgataaatttaaccaaagaggtgcaggacgtatatactaaaaatcacaaaacaytgctgaaggaaatatctaaatagatggaaaaatcccaagttcatggactggaagacttaatatcattaagatggtaatacttcccaatgtgactacatattcaatgcaatccccaccaaaatcccaacaatactttttacagaaatggaaaagctaatcctaaaattcaaatggaatttcaagagaccccaaatagctaaaataattttgaaaaagaacaaagttgaactcacatgtcctgatttcaaaactcactacaaagctacaataattgacacagtgtggtactggcataggaca

SEQ ID NO: 139708 - DNA, 601 bp, Human
ggcactgataagatcaatatcatcaatctgccggaaaaggaggagtgacagttattccacagtttaaagaaaaaaaaggccaacttcaagcctagagacaaaatttaacagcattaaactgtctgttaatatctggattcaaactacctatctacatgaaaataaaaaataaaccatataacatctatcgctgaatgaactgtagtctcatggcccatctgaaactgtctcattttatacatttttaccatttcattatacatgacaaattaactcacagcaaagacaaataaattataaraaaataaaacccaaagctgttcgatattaaaagtagtcacaggtacaaaataagactatttcctcgctaaaacagtggtctagctggccttcctcatgggatgcactgagataaataaaaagtctatcgaagttttgagcactttattcttgtattcagtttgcctctcagcatttcataagtcaatttatccaaacgtcatggcgatggaatctttgaccaactggacagcagaagaacctaatgtgctctaaaatgacctaatgggctttgagtcctacatctttctgaccactcaga

SEQ ID NO: 139709 - DNA, 601 bp, Human
ttctgttcttactgctgttcaatgtattttttcacaccatgcaaaagtaattttgctagggtatcagataggctgtttcacttttttgctcaaaaccatgccagggcttcctctgtgtgccaatgtcctcatcacggctcacaagtccctgtgtgcggatggcccatgacccagccctcatcttccaccagatttcccactcctttcctcctgtcacattggcctctttgctattttgtttactgttctctgtaaccatctagataccagcacggtttgcccctgcgacccttatgaatgygtgtttactgtgaggtgccatggagtcttccaactgtggatactgagtaggcaactgggtgtgagacctgcagctgcagtggtccagggtggtgatacgaagctgggagctgtctctatacaggtgtcatgaaacgatgtggagctccaggtgtgggagaaggcaattcttcaagaaggtaatgagaagaaaagagaagcacagacaaagccttgaagagcaaggtgttgaaagaaagccttcagaggagaccgagatggagccattcaaagatgtaaaaggaaatccaggcgtgcagtg

SEQ ID NO: 139710 - DNA, 601 bp, Human
tcacagtattaaaaaattgctttcagtcaggtgtggtgcctcacgcctgtaatcccagcactttgggaggccaaggcaggtagatcacctgaggtcaggagtttgagaccagcctggccaacatggtgaaaccctgtctctactaaaaatataaaaattagccaggtgtggtggtggacacctataatcccagctactcgggaggctgaggtagtacaatcgcttgaacctgggaggcagaggttgcaatgagctgagatcgtgccactgcactccagcctgggcaacaaaagcaagactytgtctcaaaacaaaaacaaaaacaaaagcaaaaaacaaaaaaaacaacaaaaaaaactgctttccaaatagcatttcatatgaatcaaatggcctcaattttcctcaagaaatacaaggcgcgatggctcacacctataatcccagcactttgggatgccaaggttggggggatcacgaggtcaggagttcaagaccagcctgaccaatgtggtgaaaccccgtctctactaaaaatacaaaaattagccaggtgtggtggcacgtgcctgtaatcccagctactcaggaggctgagaca

SEQ ID NO: 139711 - DNA, 601 bp, Human
ttaaattaaatttaatcctgtatttttactacagctgccatgagatgctatgtcatactactattattattattattatttttgagatggcatctcgctctgtcactcaggctggctgcagtgcagtggcacgatctcggctactatctagtcaggttcatttaaagtctattttatcctataacaacaaatattatttgacttttgacctacctcctaggacacaaatgtgatatatgtctatttgaaactgagctaaacattttagattcctttcatttagtttgtttcacctaaaacratttgtttttccctcagaatgaaatgacaataaaaagtactaggtagcacaatggcatcttcccagtttaggactcaacaagcctttacagaatgactactgtgtgttacaataatgtgaattctggaaactcatctgacctggccttccaatcacccttggaacattattaattagcgtctcctttctttaaatataaatatatcatgctagatctctcaataaagcaggctacaggtctgaatcatggaatcttgagcatgtggaatgtgggggaaccttctagattagttctttact

SEQ ID NO: 139712 - DNA, 601 bp, Human
tggcactgtgggccggcagagcattcaaactccccagtgggctctcctgcagcctccctgacttggcacctggcctcaggacccttctctccagctcttctgcggcttgcactctgtactcccagatgaacctggaggtctccaagccactgaaaaccctgagcaaagcacacaccacctcatctgatggaaagccacgatgcccacaggatgcccgacacacacacttctctagttttggtgtagacatcgcctgctctcaaaagcctgagcaatgccccagggcagaactgaccatgtycatgccccctgctgtgactgcctggcccagtgctgtggtgggatggccaactccttggactacctcgtatatgctttgtgaacagaatccagtctccttaaaagtaagacattagtctttcacttttggtgttttttcttgatgctgtacattttccccactgttgcttgttttttctcaaatgttactgagtgttgctgactgaaggagcagcagaggcgcatgcccacccccaccccacactgccgatcttccctgcaggacggtccttgtggcaggaactcctggtgtggcatgtgc

SEQ ID NO: 139713 - DNA, 601 bp, Human
ctgcacctggctgaaaagggcaggctccttaaggtgctttgagctgctaccagagtgatcttccaaatcctggtctggcactgtgggccggcagagcattcaaactccccagtgggctctcctgcagcctccctgacttggcacctggcctcaggacccttctctccagctcttctgcggcttgcactctgtactcccagatgaacctggaggtctccaagccactgaaaaccctgagcaaagcacacaccacctcatctgatggaaagccacgatgcccacaggatgcccgacacacacrcttctctagttttggtgtagacatcgcctgctctcaaaagcctgagcaatgccccagggcagaactgaccatgtccatgccccctgctgtgactgcctggcccagtgctgtggtgggatggccaactccttggactacctcgtatatgctttgtgaacagaatccagtctccttaaaagtaagacattagtctttcacttttggtgttttttcttgatgctgtacattttccccactgttgcttgttttttctcaaatgttactgagtgttgctgactgaaggagcagcagaggcgcatg

SEQ ID NO: 139714 - DNA, 601 bp, Human; identical to SEQ ID NO: 24156

SEQ ID NO: 139715 - DNA, 601 bp, Human; identical to SEQ ID NO: 24157

SEQ ID NO: 139716 - DNA, 601 bp, Human; identical to SEQ ID NO: 24158

SEQ ID NO: 139717 - DNA, 601 bp, Human; identical to SEQ ID NO: 24159

SEQ ID NO: 139718 - DNA, 601 bp, Human; identical to SEQ ID NO: 24160

SEQ ID NO: 139719 - DNA, 601 bp, Human; identical to SEQ ID NO: 24161

SEQ ID NO: 139720 - DNA, 601 bp, Human; identical to SEQ ID NO: 24162

SEQ ID NO: 139721 - DNA, 601 bp, Human; identical to SEQ ID NO: 24163

SEQ ID NO: 139722 - DNA, 601 bp, Human; identical to SEQ ID NO: 24164

SEQ ID NO: 139723 - DNA, 601 bp, Human; identical to SEQ ID NO: 24165

SEQ ID NO: 139724 - DNA, 601 bp, Human; identical to SEQ ID NO: 24166

SEQ ID NO: 139725 - DNA, 601 bp, Human; identical to SEQ ID NO: 24167

SEQ ID NO: 139726 - DNA, 601 bp, Human; identical to SEQ ID NO: 24168

SEQ ID NO: 139727 - DNA, 601 bp, Human; identical to SEQ ID NO: 24169

SEQ ID NO: 139728 - DNA, 601 bp, Human; identical to SEQ ID NO: 24170

SEQ ID NO: 139729 - DNA, 601 bp, Human; identical to SEQ ID NO: 24171

SEQ ID NO: 139730 - DNA, 601 bp, Human; identical to SEQ ID NO: 24172

SEQ ID NO: 139731 - DNA, 601 bp, Human; identical to SEQ ID NO: 24173

SEQ ID NO: 139732 - DNA, 601 bp, Human; identical to SEQ ID NO: 24174

SEQ ID NO: 139733 - DNA, 601 bp, Human; identical to SEQ ID NO: 24175

SEQ ID NO: 139734 - DNA, 601 bp, Human; identical to SEQ ID NO: 24176

SEQ ID NO: 139735 - DNA, 601 bp, Human; identical to SEQ ID NO: 24177

SEQ ID NO: 139736 - DNA, 601 bp, Human; identical to SEQ ID NO: 24178

SEQ ID NO: 139737 - DNA, 601 bp, Human; identical to SEQ ID NO: 24179

SEQ ID NO: 139738 - DNA, 601 bp, Human; identical to SEQ ID NO: 24180

SEQ ID NO: 139739 - DNA, 601 bp, Human; identical to SEQ ID NO: 24181

SEQ ID NO: 139740 - DNA, 601 bp, Human; identical to SEQ ID NO: 24182

SEQ ID NO: 139741 - DNA, 601 bp, Human; identical to SEQ ID NO: 24183

SEQ ID NO: 139742 - DNA, 601 bp, Human; identical to SEQ ID NO: 24184

SEQ ID NO: 139743 - DNA, 601 bp, Human; identical to SEQ ID NO: 24185

SEQ ID NO: 139744 - DNA, 601 bp, Human; identical to SEQ ID NO: 24186

SEQ ID NO: 139745 - DNA, 601 bp, Human; identical to SEQ ID NO: 24187

SEQ ID NO: 139746 - DNA, 601 bp, Human; identical to SEQ ID NO: 24188

SEQ ID NO: 139747 - DNA, 601 bp, Human
taagttcccatggcacacagtacatcacttcacttaaagttgcaggacccaagaactcactgatgatgttgaggccttagtgtatatacacagagaaccacatcgaacaatgatatagtgcttgctggacccatgagagtaatgaaagtctattgaattaccctccattttgattttccatttttcttttttccttcctgatgtttctggattccctctttcattatttcctttctgtggtaagaacatcctttagctactcttttaggactggtctgctgggaacggattcttttagttytctttcacttgagaatgtctttattttcccatcatcctgaagggtatttctgattgatatggaattcttggtagacaatacttatctttcagcacttgaaaaatgctgccttttcattttctggcctctgtagttcctgatgaaaaatccaatatcatttgttcttcccctgtaagttaggtgttatatctttttcactgcacacaagactttttttgtctttggttttcaaaagtttgattatgatatatgtagatgtggattcttttgggtttatcctgtttgggtttcacgcatacc

SEQ ID NO: 139748 - DNA, 601 bp, Human
ctcaacagaagcagatgcttgtgccgtgcttctcatacagcctgcagagctgtgagccaaataaaccttctttataaactagccagcctcaggtattcctttatagcaatgaaaaatggactaatacagttacttaaaacatattttagagttccattttttatttttctagggttttatatgtatcctgtggtatagtcttttcttagtggtaactccaagtagtacctaacataaacataacttcctaaggtccactggtgtcaatattttaccggtttgtgacaaatgtagaaacctygctcctttgtaattgtcttaactattatttcttgttcagtaaatccttaatgttgctggtaggttcttggaaactgtgacttcaagcagaatgatgtactatataataaaccaactttaccacaggagttaagttcccatggcacacagtacatcacttcacttaaagttgcaggacccaagaactcactgatgatgttgaggccttagtgtatatacacagagaaccacatcgaacaatgatatagtgcttgctggacccatgagagtaatgaaagtctattgaattaccctccatttt

SEQ ID NO: 139749 - DNA, 601 bp, Human
tttatttttaagagtgtggagattttcattattatattactaattaatagtttgattctactgtggtcagagagcacactctggtttcaactgtattaattggttgaggtttgttttatggcccaggttataatgtatctcagcaaagttctgtgagagctcaaaaataatttatattctgctatttttggctgaggtgttctaactggtctattgattactgaaaaaggtactttgaagtctccaactatagttgtagatttgtctatttctcctttaatgtctgtatctttttatttcrtgtattttgtaactcttttgttagacgcatataaatttaggatcactgttttctttgtgtactgacacttctatcattatttaatgcccctggtaattttctttgctctgaagtctgtttcatctaatacaaacatgaccattcctgcttcttttgattaatgtttgcatagtatatatttttctacccttttactttcaactcacctgtatcattatattagaagtttgttatagacagcatatacttggctaatgtgtttttaacaatatgccaatctttcatttgttctgcttgttt

SEQ ID NO: 139750 - DNA, 601 bp, Human
ttatttcctcgtcatgccgtggtccactggctagaacttccagtacaatgtcgaatatgagttgtgattgccttgttcctgattttaggtagaaagaattcaggctttccccattaggtataatggtagctgtaggatttttgcaaaatgctcattatccagtccacaaaggtctcatctcttcctatttttgtgaggattttcatcatgaatgggtgttgaatttgatcaaatgctttttatgaatcaactgctatactcatgtaatcttttagtctgacaatacgataattacattgattttttttttttttttttttttgagatggagtctccctctgtcgcccaggctggagcacagtggtgcgatcttggctcactgcaacctctgcctcccaggttcaagcaattctcctgcctcaataatcctactctcctgagtagctgggattacaggcacgcgccaccatgcccggctaatttttgtatttttagtagagacagggtttcaccatgttggtcaggctggtcttgaactcctgaccttgtgatccacccgcctcagcctcccaaagtgctgggattacaggcgtgacccacc

SEQ ID NO: 139751 - DNA, 601 bp, Human
ccctctgtacaagaacactgttcttgtttacattactgatgcacaccactgaccatccgattccttctacagggtaacctgagacagccaggatgttggcagtgatggaccagctcaatgccatacaacatcactgaagttgcaaagcagttcagggaaccatgtactgtctgagacatcatcacaggtctaaataaacacacaaccatcatgggagcagctggcatgggaagatcaatatggtgatcccaggccacatcttaaaaccaggcaatatgagctttttttttttttttgagayggagttcgttcttgttgcccaaactacagtacaatggcgcgatctcggctcactgcaacctccgcttcccaggttcaagtgattctcctgcctcagcctcctgagtagctgggagtacaggtgaccgccatcacacctaattctttatattttttcgacagggtttcaccatgttggccgggctggtcttgaactcctgacctcaggtgatctgcctgccttagctcccaaagtgggattacaggcgtgagccaccaagcctggcttattttttcaggtgtttgtatgtatgttccttat

SEQ ID NO: 139752 - DNA, 601 bp, Human
tagtatagattgctattatgaaataaaattcatttttgtatgtttatcttacatcctgtgactcaaaagtttttttcttttttataagcaatatgatttctattcaattactttggaaacccaattaatgcttgaatccaaagggtatagaaaaaggccaaacatttaaaaataacagatttagcgatgatttgtatggttttttccctcataatatgaatgctttcagcaggacagtaaattgcaaaacatatcaaatcatattaaggcagacgaccaagctgtggctgcatttaaagcyattactaagaaaataatcttggagttgagagctcttctttccaggtgtctggtcaactgacccaggaatggccagtcctggagttggtagatgggaaaataggccctacctgtcttatcactgctcatgctgctggccctctgtacaagaacactgttcttgtttacattactgatgcacaccactgaccatccgattccttctacagggtaacctgagacagccaggatgttggcagtgatggaccagctcaatgccatacaacatcactgaagttgcaaagcagttcagggaaccatg

SEQ ID NO: 139753 - DNA, 601 bp, Human
atatttaaccatggccatttaaagtcttgtcatccaacgatagttaattgttttactctggcactttcctgaaaactattgtaagcaacagtgaatctaaagtgtttcatctttgaggagatgcaatggaaaggactctgacaagtacaggtttctgatgttaagatcacaccattggactgggtaagaattatcataactcttgtgaagtaattaactaattcatgatgctgtcacaatggcaatgacattttaacctgagttttggaggacacactcaaaccacagcaggatagaagakacatttttactatattgaatcttctaatccatacacgtctctccacttacttagattttgtctgatttttttcatcactattttgaagttttcagtatacaagtcccaacatgttttattaggtttacatctgaatatttttttggagacaaggtctcactgtgtggcccaggctggagtatagtggcatgatcatggctcactgcagcctccatctcccaggctcaagcaatcctccaacctcagcctcccaagtagctgggactaaaggcgaacaccaccacacttgcctagtttttt

SEQ ID NO: 139754 - DNA, 601 bp, Human
ttaaaatgctgtataccacagaaataactaaacttccttgtcaattgcaacattagtataatgaactctcattagatatttaaccatggccatttaaagtcttgtcatccaacgatagttaattgttttactctggcactttcctgaaaactattgtaagcaacagtgaatctaaagtgtttcatctttgaggagatgcaatggaaaggactctgacaagtacaggtttctgatgttaagatcacaccattggactgggtaagaattatcataactcttgtgaagtaattaactaattcaygatgctgtcacaatggcaatgacattttaacctgagttttggaggacacactcaaaccacagcaggatagaagatacatttttactatattgaatcttctaatccatacacgtctctccacttacttagattttgtctgatttttttcatcactattttgaagttttcagtatacaagtcccaacatgttttattaggtttacatctgaatatttttttggagacaaggtctcactgtgtggcccaggctggagtatagtggcatgatcatggctcactgcagcctccatctcccaggct

SEQ ID NO: 139755 - DNA, 601 bp, Human
ggtcatctatagtttggtgctattatgaatataagtactatatacattcatgtggtggtgaacatagttttcagttctctgggataaacacctagggagtgcaactgcgagtcattatagaaagcacatatttagttttctgatactgccgaactattttccagagtgatcataccattctatattctcaccagcaatgtatgagatacagcatttggtgctgtcactacttgcaattttagtcattgtgatagctgtgtattaagacctcaatgtgatttcaacttgaattttcctaacrgctaatgacgttaaatgttgtcatggacatttctgtcatttgtatattccctttggtaaatgtctgttcatatctctaccccattttctaactggatttttctttactgttgagatttaaaagatctttacgtattctagatatgtcttttgtcaaatatgttgttttataaagattttctcccagtctgtagcttgtctttcatccttttataggatgttcaaagcaaaacctaaattttcatttagttcaatatatcacttttcccttttaaggacagtgttttgtgtcaaggcttta

SEQ ID NO: 139756 - DNA, 601 bp, Human; identical to SEQ ID NO: 24189

SEQ ID NO: 139757 - DNA, 601 bp, Human; identical to SEQ ID NO: 24190

SEQ ID NO: 139758 - DNA, 601 bp, Human; identical to SEQ ID NO: 24191

SEQ ID NO: 139759 - DNA, 601 bp, Human; identical to SEQ ID NO: 24192

SEQ ID NO: 139760 - DNA, 601 bp, Human; identical to SEQ ID NO: 24193

SEQ ID NO: 139761 - DNA, 601 bp, Human; identical to SEQ ID NO: 24194

SEQ ID NO: 139762 - DNA, 601 bp, Human
actgtaacagaaataaacactgccttataccaaaaaatgtacacctagggaaatcataaactgcagaaagtaaaagacaaagggaaaatcttcaaggaagcagagaaaagcagcaccttacctgcagaggaacaagggtaagataaaaaagccaaaattatccagaatgtagtatataaggacaaaaggagggaaaataggaaaagagaataagaggtaggatagagtgagaaagtccatctaaaatatgtctaaacaaggtgtcagaaggagagaataccagagagaatgaataagaggtaagttggacaagataatgtctggcaattttccacaagtgccgaaagacacaaatactgacacagaaagcccaataaatcccaggctatcaggtgttacaaataaaaggatgggatggtaaaagtcttgaattgagatgtcaagaatgggtataaatagaaaaaaacagatcccacaaagggaagctgtctggggaagtgattgcagtggcagcaatattaaagtgaacatgtctgatgtgtagcaggattacagaacgaaactcagagggtagggtgaggatgtcaacagagaagttgac

SEQ ID NO: 139763 - DNA, 601 bp, Human
gagttagtgggtgcagcgcaccagcatggcacatgtatacatatgtaactaacctgcacaatgtgcacatgtaccctaaaacttaaagtataataataataaaaataataatcataaaaaaataataaaataaaattacaaaaattatctgcacatggtggcacatgcctgtaattccagctactcgggaggctgaggcaggagaatcgcttgaacccaggaggtggaggttgcaacgagctgggatatcgtgccactgcactccagcctgggcaacaagagtgaaactctgtctcaaaaaaaacaaacaaacaaacaaacaaacaaaaaacacgaatagaatgaaaatggtagaaattaggcagggtgtggtggttcttgcttgtaatcccaatgctttgggaggccaaggtgggaggatcacttgaaggcaggagttcaagaccagccttgaccttatagcaagaccctgtccctacaaaaaaattttaaaattagctgggcatggtggcgcgtgcctgtagtcctagctagggaggctgaggtgggaggatcgctggatcccaggagtttgaggctgcagtgagctgtgattgagcca

SEQ ID NO: 139764 - DNA, 601 bp, Human
ctaatgctagatgacgagttagtgggtgcagcgcaccagcatggcacatgtatacatatgtaactaacctgcacaatgtgcacatgtaccctaaaacttaaagtataataataataaaaataataatcataaaaaaataataaaataaaattacaaaaattatctgcacatggtggcacatgcctgtaattccagctactcgggaggctgaggcaggagaatcgcttgaacccaggaggtggaggttgcaacgagctgggatatcgtgccactgcactccagcctgggcaacaagagtgawactctgtctcaaaacaaacaaacaaacaaacaaacaaacaaaaaacacgaatagaatgaaaatggtagaaattaggcagggtgtggtggttcttgcttgtaatcccaatgctttgggaggccaaggtgggaggatcacttgaaggcaggagttcaagaccagccttgaccttatagcaagaccctgtccctacaaaaaaattttaaaattagctgggcatggtggcgcgtgcctgtagtcctagctagggaggctgaggtgggaggatcgctggatcccaggagtttgaggctgcagtga

SEQ ID NO: 139765 - DNA, 601 bp, Human
gtgaagagaatgtaatcggttaataatggccttccaaagatatgcccaggttctaaattcccaggagctgtgaatgttcactttatttggaaaaagaggaaacagaagagaaggaggcaatgtgaccacggagtcagagactgaagtgatgtggccacaagtcaagggatgcctggcgccaccataagctagaagaagtatataaggaattctcccacagagccttcagagagactgtggcctttctgacaccctaatttcagtgtctggcctccagagctgtgagatgacttgagccatsccatttgtggaaatttgttgcagcagccacagaaaccaatacagagaaaatcacctcacttagctttgttttggagtagggatagacagatcctgtctccatcacaactcctggcctttgtgtatgactgggaatgccatagattttttttttgagatggagtttaactcttgtcgcccaggctggagtgcagtgatgcaatctcagcacactgcaacctctgcctcccaggttcaagagattctcctgcctcagcctcccaagtagctgggattacaggcatgtgccaccatgtccagc

SEQ ID NO: 139766 - DNA, 601 bp, Human
gaaagctacattattagatgatctttactaccataccacaatgaaagagccaagtgtgttcgagggagagtgaaaaaagcctttgatagagtgaaagactcatggacagaattagcaagacagggaaggcccagagcaggaaggatcttgtgtggaagggaagattctgaggcataagagaataaggagctttgggggctctaagcaagggaacaaaatcaaggcaggaatgttcatgaagatagctctggtgaagagtacagactgcagactggtgacttagatggatgatgaggcccartgatgagatgagagggaaaacgacaaaggagagtcactgaaaataaacccagggagggaaggaggaacccaagaagaaatagagctttagtatttaacatcatgacagaaaatttaaaagtacgatatgcaactaaatttaaaaaaaaaagctgcacaggaagaaaacgggagaattacacagaggccaaaaataatgactcccatggggtctggtggcttaatgcttttggcactaaagagctaggaaagcagggaaagaaaagcctccggtatatacaaaccgggaagtccaacaaat

SEQ ID NO: 139767 - DNA, 601 bp, Human
tcctcatacacagatacttcctatgtctacaaaaaaagcctagaggctgtgccaactcagtatcccagatatgtggtttcaaaatatgattctctataatttgaagaacagctattttctacgtctggagaagtaaaagtacataataagcctaggacatgttgctacgtgagaaagcaagaatttaccaaagacaaaggatcatgttaaagaatacaggatccaatatggccaatgacgaaaactctgagcatccaaaaatataacccaaatgcaattgattgaaatatactgaatatayaactcaaaaacaaaaaaaaagaaaatttaaagttatctgcctactgtggagcattttgcttctagtcagatctgaatttaaagcaaacagatgagcttcctttaaaaatagctcttgtcctacctagcagcaatcctagatgtgagaatactctcaaagctacttccttaatagataattacaggacctggagatgatgtttagagtttagtggagcaagcaagaagacatctaagggtttctaaaatggtcaacattttgtggctcttctaatttaccaagttattgatactttatgaa

SEQ ID NO: 139768 - DNA, 601 bp, Human
gaggactatgccatcacttcacagtttggctaactctgggtactgccaagatggttatttttcctcatacacagatacttcctatgtctacaaaaaaagcctagaggctgtgccaactcagtatcccagatatgtggtttcaaaatatgattctctataatttgaagaacagctattttctacgtctggagaagtaaaagtacataataagcctaggacatgttgctacgtgagaaagcaagaatttaccaaagacaaaggatcatgttaaagaatacaggatccaatatggccaatgacraaaactctgagcatccaaaaatataacccaaatgcaattgattgaaatatactgaatatacaactcaaaaacaaaaaaaaagaaaatttaaagttatctgcctactgtggagcattttgcttctagtcagatctgaatttaaagcaaacagatgagcttcctttaaaaatagctcttgtcctacctagcagcaatcctagatgtgagaatactctcaaagctacttccttaatagataattacaggacctggagatgatgtttagagtttagtggagcaagcaagaagacatctaagggt

SEQ ID NO: 139769 - DNA, 601 bp, Human
aatctttgtttctcatggtgggtatgttcaccaaacctgacagttgttgctaatgagacaattcagggtagtgctggccaggacagaaagaccaagtatatgatttaggatggggactttgggtcacatggtatatcagttgagaaagacagcaatcatgcctacagaatgaaacctcaacagaaactggacaccaaggctcgagtgagcttccctggttggtaatatagtctctgtgttgtcagatgtaagggatgagaggaagaaacattatccatgactccagggtctctctctctcwctcactctcgctggttctaacgtgtatcctttccctaccctaattcaaaccatgagtgtaataccttttagtgagtctgagtcctcctagcaggttactgaacctgagggtggtttaggaaaatccctggaacttgcagttggtgccagcagtgatgggggtcttgtgtggatctttccctgagtagaatcctcactccttgcaggtggagttagatatcgggcagactcctggagccttctggaggactatgccatcacttcacagtttggctaactctgggtactgccaagatggtta

SEQ ID NO: 139770 - DNA, 601 bp, Human
cttcacggggatgtcttctgtaatttctagaatggaaagaaaaagttgaaaaaaaatcagtattttacctattgggggtgaatatttaaaaaaatgttaactgcttgtgtagtaaggaatttggccttatcctaagagttctgccttttgtcccagctcctgaggtgaacctctaaatccttggaatttcctggtaggaatctttgtttctcatggtgggtatgttcaccaaacctgacagttgttgctaatgagacaattcagggtagtgctggccaggacagaaagaccaagtatatgrtttaggatggggactttgggtcacatggtatatcagttgagaaagacagcaatcatgcctacagaatgaaacctcaacagaaactggacaccaaggctcgagtgagcttccctggttggtaatatagtctctgtgttgtcagatgtaagggatgagaggaagaaacattatccatgactccagggtctctctctctctctcactctcgctggttctaacgtgtatcctttccctaccctaattcaaaccatgagtgtaataccttttagtgagtctgagtcctcctagcaggttactgaa

SEQ ID NO: 139771 - DNA, 601 bp, Human
aagtgtgaagattactgtgaggtctcaagttacttgactaatcaatcccatttgaatttcaatccaagcagcatattttacacacacctgaaggaaatatcttcagtgtgttcatgtgtgtgtctatgtgcatgtatgtgtaggggataggtgtaattagggaagggctgaccgaacaacattgataagtacatgctagaagtctgctgttgttggtaacacagaaacatacacagtcttcatattcaaagtcttcacggggatgtcttctgtaatttctagaatggaaagaaaaagttgaaaaaaaatcagtattttacctattgggggtgaatatttaaaaaaatgttaactgcttgtgtagtaaggaatttggccttatcctaagagttctgccttttgtcccagctcctgaggtgaacctctaaatccttggaatttcctggtaggaatctttgtttctcatggtgggtatgttcaccaaacctgacagttgttgctaatgagacaattcagggtagtgctggccaggacagaaagaccaagtatatgatttaggatggggactttgggtcacatggtatatcagttgagaaagaca

SEQ ID NO: 139772 - DNA, 601 bp, Human; identical to SEQ ID NO: 24195

SEQ ID NO: 139773 - DNA, 601 bp, Human; identical to SEQ ID NO: 24196

SEQ ID NO: 139774 - DNA, 601 bp, Human; identical to SEQ ID NO: 24156

SEQ ID NO: 139775 - DNA, 601 bp, Human; identical to SEQ ID NO: 24157

SEQ ID NO: 139776 - DNA, 601 bp, Human; identical to SEQ ID NO: 24158

SEQ ID NO: 139777 - DNA, 601 bp, Human; identical to SEQ ID NO: 24159

SEQ ID NO: 139778 - DNA, 601 bp, Human; identical to SEQ ID NO: 24160

SEQ ID NO: 139779 - DNA, 601 bp, Human; identical to SEQ ID NO: 24161

SEQ ID NO: 139780 - DNA, 601 bp, Human; identical to SEQ ID NO: 24162

SEQ ID NO: 139781 - DNA, 601 bp, Human; identical to SEQ ID NO: 24163

SEQ ID NO: 139782 - DNA, 601 bp, Human; identical to SEQ ID NO: 24164

SEQ ID NO: 139783 - DNA, 601 bp, Human; identical to SEQ ID NO: 24165

SEQ ID NO: 139784 - DNA, 601 bp, Human; identical to SEQ ID NO: 24166

SEQ ID NO: 139785 - DNA, 601 bp, Human; identical to SEQ ID NO: 24167

SEQ ID NO: 139786 - DNA, 601 bp, Human; identical to SEQ ID NO: 24168

SEQ ID NO: 139787 - DNA, 601 bp, Human; identical to SEQ ID NO: 24169

SEQ ID NO: 139788 - DNA, 601 bp, Human; identical to SEQ ID NO: 24170

SEQ ID NO: 139789 - DNA, 601 bp, Human; identical to SEQ ID NO: 24171

SEQ ID NO: 139790 - DNA, 601 bp, Human; identical to SEQ ID NO: 24172

SEQ ID NO: 139791 - DNA, 601 bp, Human; identical to SEQ ID NO: 24173

SEQ ID NO: 139792 - DNA, 601 bp, Human; identical to SEQ ID NO: 24174

SEQ ID NO: 139793 - DNA, 601 bp, Human; identical to SEQ ID NO: 24175

SEQ ID NO: 139794 - DNA, 601 bp, Human; identical to SEQ ID NO: 24176

SEQ ID NO: 139795 - DNA, 601 bp, Human; identical to SEQ ID NO: 24177

SEQ ID NO: 139796 - DNA, 601 bp, Human; identical to SEQ ID NO: 24178

SEQ ID NO: 139797 - DNA, 601 bp, Human; identical to SEQ ID NO: 24179

SEQ ID NO: 139798 - DNA, 601 bp, Human; identical to SEQ ID NO: 24180

SEQ ID NO: 139799 - DNA, 601 bp, Human; identical to SEQ ID NO: 24181

SEQ ID NO: 139800 - DNA, 601 bp, Human; identical to SEQ ID NO: 24182

SEQ ID NO: 139801 - DNA, 601 bp, Human; identical to SEQ ID NO: 24183

SEQ ID NO: 139802 - DNA, 601 bp, Human; identical to SEQ ID NO: 24184

SEQ ID NO: 139803 - DNA, 601 bp, Human; identical to SEQ ID NO: 24185

SEQ ID NO: 139804 - DNA, 601 bp, Human; identical to SEQ ID NO: 24186

SEQ ID NO: 139805 - DNA, 601 bp, Human; identical to SEQ ID NO: 24187

SEQ ID NO: 139806 - DNA, 601 bp, Human; identical to SEQ ID NO: 24188

SEQ ID NO: 139807 - DNA, 601 bp, Human; identical to SEQ ID NO: 139747

SEQ ID NO: 139808 - DNA, 601 bp, Human; identical to SEQ ID NO: 139748

SEQ ID NO: 139809 - DNA, 601 bp, Human; identical to SEQ ID NO: 139749

SEQ ID NO: 139810 - DNA, 601 bp, Human; identical to SEQ ID NO: 139750

SEQ ID NO: 139811 - DNA, 601 bp, Human; identical to SEQ ID NO: 139751

SEQ ID NO: 139812 - DNA, 601 bp, Human; identical to SEQ ID NO: 139752

SEQ ID NO: 139813 - DNA, 601 bp, Human; identical to SEQ ID NO: 139753

SEQ ID NO: 139814 - DNA, 601 bp, Human; identical to SEQ ID NO: 139754

SEQ ID NO: 139815 - DNA, 601 bp, Human; identical to SEQ ID NO: 139755

SEQ ID NO: 139816 - DNA, 601 bp, Human; identical to SEQ ID NO: 24189

SEQ ID NO: 139817 - DNA, 601 bp, Human; identical to SEQ ID NO: 24190

SEQ ID NO: 139818 - DNA, 601 bp, Human; identical to SEQ ID NO: 24191

SEQ ID NO: 139819 - DNA, 601 bp, Human; identical to SEQ ID NO: 24192

SEQ ID NO: 139820 - DNA, 601 bp, Human; identical to SEQ ID NO: 24193

SEQ ID NO: 139821 - DNA, 601 bp, Human; identical to SEQ ID NO: 24194

SEQ ID NO: 139822 - DNA, 601 bp, Human; identical to SEQ ID NO: 139762

SEQ ID NO: 139823 - DNA, 601 bp, Human; identical to SEQ ID NO: 139763

SEQ ID NO: 139824 - DNA, 601 bp, Human; identical to SEQ ID NO: 139764

SEQ ID NO: 139825 - DNA, 601 bp, Human; identical to SEQ ID NO: 139765

SEQ ID NO: 139826 - DNA, 601 bp, Human; identical to SEQ ID NO: 139766

SEQ ID NO: 139827 - DNA, 601 bp, Human; identical to SEQ ID NO: 139767

SEQ ID NO: 139828 - DNA, 601 bp, Human; identical to SEQ ID NO: 139768

SEQ ID NO: 139829 - DNA, 601 bp, Human; identical to SEQ ID NO: 139769

SEQ ID NO: 139830 - DNA, 601 bp, Human; identical to SEQ ID NO: 139770

SEQ ID NO: 139831 - DNA, 601 bp, Human; identical to SEQ ID NO: 139771

SEQ ID NO: 139832 - DNA, 601 bp, Human; identical to SEQ ID NO: 24195

SEQ ID NO: 139833 - DNA, 601 bp, Human; identical to SEQ ID NO: 24196

SEQ ID NO: 139834 - DNA, 601 bp, Human; identical to SEQ ID NO: 117697

SEQ ID NO: 139835 - DNA, 601 bp, Human; identical to SEQ ID NO: 117698

SEQ ID NO: 139836 - DNA, 601 bp, Human; identical to SEQ ID NO: 117699

SEQ ID NO: 139837 - DNA, 601 bp, Human; identical to SEQ ID NO: 117700

SEQ ID NO: 139838 - DNA, 601 bp, Human; identical to SEQ ID NO: 117701

SEQ ID NO: 139839 - DNA, 601 bp, Human; identical to SEQ ID NO: 117702

SEQ ID NO: 139840 - DNA, 601 bp, Human; identical to SEQ ID NO: 117703

SEQ ID NO: 139841 - DNA, 601 bp, Human; identical to SEQ ID NO: 117704

SEQ ID NO: 139842 - DNA, 601 bp, Human; identical to SEQ ID NO: 117705

SEQ ID NO: 139843 - DNA, 601 bp, Human; identical to SEQ ID NO: 117706

SEQ ID NO: 139844 - DNA, 601 bp, Human; identical to SEQ ID NO: 117707

SEQ ID NO: 139845 - DNA, 601 bp, Human; identical to SEQ ID NO: 117708

SEQ ID NO: 139846 - DNA, 601 bp, Human; identical to SEQ ID NO: 117709

SEQ ID NO: 139847 - DNA, 601 bp, Human; identical to SEQ ID NO: 117710

SEQ ID NO: 139848 - DNA, 601 bp, Human; identical to SEQ ID NO: 117711

SEQ ID NO: 139849 - DNA, 601 bp, Human; identical to SEQ ID NO: 117712

SEQ ID NO: 139850 - DNA, 601 bp, Human; identical to SEQ ID NO: 117713

SEQ ID NO: 139851 - DNA, 601 bp, Human; identical to SEQ ID NO: 117714

SEQ ID NO: 139852 - DNA, 601 bp, Human; identical to SEQ ID NO: 117715

SEQ ID NO: 139853 - DNA, 601 bp, Human; identical to SEQ ID NO: 117716

SEQ ID NO: 139854 - DNA, 601 bp, Human; identical to SEQ ID NO: 117717

SEQ ID NO: 139855 - DNA, 601 bp, Human; identical to SEQ ID NO: 117718

SEQ ID NO: 139856 - DNA, 601 bp, Human; identical to SEQ ID NO: 117719

SEQ ID NO: 139857 - DNA, 601 bp, Human; identical to SEQ ID NO: 117720

SEQ ID NO: 139858 - DNA, 601 bp, Human; identical to SEQ ID NO: 117721

SEQ ID NO: 139859 - DNA, 601 bp, Human; identical to SEQ ID NO: 117722

SEQ ID NO: 139860 - DNA, 601 bp, Human; identical to SEQ ID NO: 117723

SEQ ID NO: 139861 - DNA, 601 bp, Human; identical to SEQ ID NO: 117724

SEQ ID NO: 139862 - DNA, 601 bp, Human; identical to SEQ ID NO: 117725

SEQ ID NO: 139863 - DNA, 601 bp, Human; identical to SEQ ID NO: 117726

SEQ ID NO: 139864 - DNA, 601 bp, Human; identical to SEQ ID NO: 117727

SEQ ID NO: 139865 - DNA, 601 bp, Human; identical to SEQ ID NO: 117728

SEQ ID NO: 139866 - DNA, 601 bp, Human; identical to SEQ ID NO: 117729

SEQ ID NO: 139867 - DNA, 601 bp, Human; identical to SEQ ID NO: 117730

SEQ ID NO: 139868 - DNA, 601 bp, Human; identical to SEQ ID NO: 117731

SEQ ID NO: 139869 - DNA, 601 bp, Human; identical to SEQ ID NO: 117732

SEQ ID NO: 139870 - DNA, 601 bp, Human; identical to SEQ ID NO: 117733

SEQ ID NO: 139871 - DNA, 601 bp, Human; identical to SEQ ID NO: 117734

SEQ ID NO: 139872 - DNA, 601 bp, Human; identical to SEQ ID NO: 117735

SEQ ID NO: 139873 - DNA, 601 bp, Human; identical to SEQ ID NO: 117736

SEQ ID NO: 139874 - DNA, 601 bp, Human; identical to SEQ ID NO: 117737

SEQ ID NO: 139875 - DNA, 601 bp, Human; identical to SEQ ID NO: 117738

SEQ ID NO: 139876 - DNA, 601 bp, Human; identical to SEQ ID NO: 117739

SEQ ID NO: 139877 - DNA, 601 bp, Human; identical to SEQ ID NO: 117740

SEQ ID NO: 139878 - DNA, 601 bp, Human; identical to SEQ ID NO: 117741

SEQ ID NO: 139879 - DNA, 601 bp, Human; identical to SEQ ID NO: 117742

SEQ ID NO: 139880 - DNA, 601 bp, Human; identical to SEQ ID NO: 117743

SEQ ID NO: 139881 - DNA, 601 bp, Human; identical to SEQ ID NO: 117744

SEQ ID NO: 139882 - DNA, 601 bp, Human; identical to SEQ ID NO: 117745

SEQ ID NO: 139883 - DNA, 601 bp, Human; identical to SEQ ID NO: 117746

SEQ ID NO: 139884 - DNA, 601 bp, Human; identical to SEQ ID NO: 117747

SEQ ID NO: 139885 - DNA, 601 bp, Human; identical to SEQ ID NO: 117748

SEQ ID NO: 139886 - DNA, 601 bp, Human; identical to SEQ ID NO: 117749

SEQ ID NO: 139887 - DNA, 601 bp, Human; identical to SEQ ID NO: 117750

SEQ ID NO: 139888 - DNA, 601 bp, Human; identical to SEQ ID NO: 117751

SEQ ID NO: 139889 - DNA, 601 bp, Human; identical to SEQ ID NO: 117752

SEQ ID NO: 139890 - DNA, 601 bp, Human; identical to SEQ ID NO: 117753

SEQ ID NO: 139891 - DNA, 601 bp, Human; identical to SEQ ID NO: 117754

SEQ ID NO: 139892 - DNA, 601 bp, Human; identical to SEQ ID NO: 117755

SEQ ID NO: 139893 - DNA, 601 bp, Human; identical to SEQ ID NO: 117756

SEQ ID NO: 139894 - DNA, 601 bp, Human; identical to SEQ ID NO: 117757

SEQ ID NO: 139895 - DNA, 601 bp, Human
ctccaagatgacaaagaaaagaaggaacaaaggtcgtgctgaaaagggccgcggccacgtgcaggctattcgctgcactaactgtgcccgatgcatgcccaaggacaaggccattaagaaattcgtcattcgaaacacagtggaggccgcagcagtcaggggcattctgaagcaagtgtcttcgatgcctatgtgcttcccaagctgtgtgtgaagctacattaccgtgtgagttgtgcaattcacagcaaagtagtcaggaatcgatctcgtgaagcccgcaaggaccgaacacccccaycccgatttagacctgcgggtgctgccccatgtctcccaccaaagcccatgtaaggagctgagttcttaaagactgaagacagactattctctggagaaaaataaaatggaaattgtacttaaaaaaaaaaaaaaaagatttggggcctctgaacaggtgagctgtagagaaatgttccaaaataattcagacatgtggtcacttacttagataaataagcaaagtcaccaacatgcaacactctattcctcatcagttccctagcttggtgtccttttcacacctagggtccatagtggc

SEQ ID NO: 139896 - DNA, 601 bp, Human
gccgggcgcggtggctcacgcctgtaatcccagcactttgggaggctgaggcgggctgatcacctgacgccatgagttcgagaccaccctgcccaacatggtgaaaccccgcctctactaaaaacacaaaaattagccgagccgtggtggcgggcgcttgtaatcccagctactcgggaggctgaggcaggagaatcgcctgaacccgggaggcgaaggttgcagtgagctgagatggcaccactgcactccagcctgggggggacaagagcgagacttcatctcaaaaaaaaaaaaaaaagattttcaccaaataatacaattaaaaactgaaaagcagcttacttactgttttttggtccctggctcaactcatcttgccactctttgggagcaagagtctcagaagcatctttctcaggaatgcaatccctcttctaagctaagtgcgtaaaatatccatcaagacaacgagaacaagtagggatacacacctgaacttcatcatcctttcggatgggcatggatcgcacgttgtacttctgtctcagctctttggaaagaggggaagacataatcttccttcgaatgtgggaaggtg

SEQ ID NO: 139897 - DNA, 601 bp, Human
agttaaagagaactgacctaactcccatcttgcttctaacctccaagatgtccttgttcattcctgggcatagaccaaactaactttgggaggaacttagtctacaggttaactttgaaacaaagatgctaacagtgctttcctgaaacaaacccccttcttgcctgggtaccagactgcctttgtaggctaacaaattagctgcaagactagaaattacagtttaggcagctagaggcttccccaattgctcctagggataacacactgtaaagcctaagatttgtgtgattttttttttcagaccctgcactgatggatccgctggtgccacccagatcaataaactggctcatctgatcttgtggcccccatccaggaaccaactcagagcaagaagacagcttcaactccctatgccttcatctctgatacgacctgtcaacacgccccactccctggccccctacctgccaaattatccttaaaaaaactcccatccctaaattttccgggagaatgatttgagtagttaactctggtctctcgttctggctctgcatgaattaaactctttctctattgcaattcctgtctagat

SEQ ID NO: 139898 - DNA, 601 bp, Human
gagaaaattacagcagttaaagagaactgacctaactcccatcttgcttctaacctccaagatgtccttgttcattcctgggcatagaccaaactaactttgggaggaacttagtctacaggttaactttgaaacaaagatgctaacagtgctttcctgaaacaaacccccttcttgcctgggtaccagactgcctttgtaggctaacaaattagctgcaagactagaaattacagtttaggcagctagaggcttccccaattgctcctagggataacacactgtaaagcctaagatttgygtgattttttttttcagaccctgcactgatggatccgctggtgccacccagatcaataaactggctcatctgatcttgtggcccccatccaggaaccaactcagagcaagaagacagcttcaactccctatgccttcatctctgatacgacctgtcaacacgccccactccctggccccctacctgccaaattatccttaaaaaaactcccatccctaaattttccgggagaatgatttgagtagttaactctggtctctcgttctggctctgcatgaattaaactctttctctattgca

SEQ ID NO: 139899 - DNA, 601 bp, Human
caagtttagcactactgcagcagggaccaacggctgttctcaacccacactgcttatttgggaacccatttcatctttttgaaataggcatgaaaaaatattgatggtgtgtatgtaaatggctttagagactgcctgaattctttaatcactagctgcactacagattacacctaagggtcatttatagaaaccttcacctaaatagatgcaacaaattatttacctgtaagtgcaaacgataacgtgactgtgcttcagttacagctcctgaatctagattgggagcaattctgtttaytggtcctcaactgcctcttcaatgaccaaacattgaaacctcctttccaaaaattgccaacagtgagaaaattacagcagttaaagagaactgacctaactcccatcttgcttctaacctccaagatgtccttgttcattcctgggcatagaccaaactaactttgggaggaacttagtctacaggttaactttgaaacaaagatgctaacagtgctttcctgaaacaaacccccttcttgcctgggtaccagactgcctttgtaggctaacaaattagctgcaagactagaaattacag

SEQ ID NO: 139900 - DNA, 601 bp, Human
aaaagattaaccttgtaaatcaagtaaacaaactcatgcatacaccattcaccctatcattatattaaaaggttaaaaaaaagagcccacttcggcaacctgtaagaagttgacaacaaggaatctgttactccatctcaaaagcagcaacagaccaagagtatttaaatctgaacccattaatgtgtgcaacctagtgctagtcagagggcagcaacaaatgcttaacggaacaaaccaattctttcccaaaggttagtggacaggaatcccagtggtcctcagtttgtgaggacaagtrtttctgaacagattcttcttcccagtttgtgactttcttgcattggtatgtattgaaaacagagatgacagttttcaaggtctactggcaagtttagcactactgcagcagggaccaacggctgttctcaacccacactgcttatttgggaacccatttcatctttttgaaataggcatgaaaaaatattgatggtgtgtatgtaaatggctttagagactgcctgaattctttaatcactagctgcactacagattacacctaagggtcatttatagaaaccttcacctaaatagatgc

SEQ ID NO: 139901 - DNA, 601 bp, Human
aaaatctttagtgagaagatgacaatacgatcttactccaacagttccaatcctaaaagacatccaaattatgataaattttagtcttatgaatgcgaggaaagggtgaaaagaggtgctggaaatacagcatgcagaccaaacaaaaatctccacagtcactgaactcatattctagtatagggagcccgaaaacatttacaagtgaatctacatcactttgatagagtaagaaggcaagtgtgaggaggccgaggggctttctagagtgatcaagcaaagccctacatttgaacagagwcctaaagtggtgagcaatctatctatgcacaggtatctggaagagaacagcaagttgaaaggttcaaaggcaggagattatcaagtttcatagatgtgtttctcaaacttgagtaagaatcaactggagggcttattaaaacatacacctgggtcataagccctaattttgcctcagtaggcctgggctcttagaatttataattctaccaagttgctaggaggcgagcagactagaacatatagaatggaaaaagatgtcagaagtaagggaagatcagttaaggtctttatttttttt

SEQ ID NO: 139902 - DNA, 601 bp, Human
taaaaaactccagaaatcactctttagccatcaaacctggcttatttactaatttcctaccaacaaaggagaaaaggcaagatggtatcagtaattcttaaagcctcttctgtgcttcattataagatttgtttctttttcactgagaaatatatgattctgctcttctcactacagttttacaagctgtcatatacaaatatatttgtttccaaagtaacttcaggctgggtgcggtggttcatgcccccaatcccagcactttgggaggcagaggcaggcggatcacctgaggtcaggrgtttgagaccagtctggccaacacggtgaaaccccttctctactaaaaatacaaaaattagctgggtatggtggcacatgcctgtaatcccagctacctgggaggctgaggcaggagaatctctggaaccctggggggggcggaggctgcagtgagctgagatggtgctattattgcactccagcctgggcgatcaatcgagattccatctcaaaaaacaaacaagtaacaaaacagcagggtgtggtgaatgcctactcaggaggctactgcgggagaatcgcttgaacccaggaagca

SEQ ID NO: 139903 - DNA, 601 bp, Human
gtaccaatctacaaataagcaagttgaataaaatacagtccagaaatagacccacatatatgtgggaatttatatatataataaaggtggcatttcaaatcagagaggaggcccttcaatgaaatctgtctggaccattgggaaataagtcaatttagatccatttagattcttacctcaatttagtcattaattccaaattgtaatttagacttgccctgggccttttaaactgtaactttatatccttttagagtctatttctatttgctgtctagttttttttttttcaggatatggrttgggaatcatggcctgaaggccaggccctgcctgctcagtcccagatatcatttgtatgtgacgagccctgcagaggtcctcaccagctgggagtcactggctggtcagattcacgttggcagcacctgacaggatgtggctacaaatgaccagagcgggttctgtcgtcaaacttgggacccgtactttggagcataacggggaagaaagtgcttaaaggattgctcattgcaggatctcaagtttcccagcaggaactcgccatgcggggtcatgggggcgcagggacggagggaag

SEQ ID NO: 139904 - DNA, 601 bp, Human
tgaactcctggcctcaagtgatccacccgccttggcctcccaaagtgctgggactggtaggcgtgagccaccgcgcctggccaaagttttaccattggcccctacagggatcaaacctgcgaccttggggttattagcaccacactctaaccattttttttttttttttttgagacagtctcgatctgtcacacaggctggagtgcaatggcgtaatctcggctcactgcaacctccgcctcccaggttcaaacaattctcctgcctcagcctccccagtagctgggattactggcgtccrccaccatggccggctaatttttgtatatttagtagagacaaggtttcatcatgttggcaaatctagtctcgaactcctgacctcaggtgatccgccctcctcggcctcccaaagtgctgggattacaggtgtgagccacggtgcacggcccctggagaggttttaatggcccagcctcacacccaggtctggcctcccaggccaccatacctcagggagggcgcatgcacagaccagccgaagtcagcaatcttcagctctcccttgagccctaagagcagattttctggctttatgtct

SEQ ID NO: 139905 - DNA, 601 bp, Human
tgcttgggaccaaaagtgttttggattttttttaaaaattttggaatgtttgcatatacaaaatcagacatcttgaggatgggacccaagtgtaaatacgaaattcgtttgtttcatatagaccttattcacacagccactaagtcatttgcaatatttttaatacgtctgtgcatgaaacaaagtttgtattaagtacctatgcggggaattttccccttgtagcatcatgttggtgctcaaaatgtttcagattttgcagcttttcagataagggatgatcagcttgtattttgatatmacacccagaacatttgaagatgaataatcaatttttggcctcccttcccccatccgcctcaccttataccactttaagtgtgagaattatttgcttgtacatgcatttgtctgttggtgtgtaacgtatgtacagactggatgtatccagcacttgccttaatagtacatgtatttacctgaataggaaagctgcagtacttgctggccagaagagcacaccatgcttgtttttgctctaactgaatatcctgtatttgcaatttatagcagttttagggactcattagggaattttgtg

SEQ ID NO: 139906 - DNA, 601 bp, Human
gtggttgcagtgagccgagatctccactccaggctgggcactgcactccaggctgggcaacacagcaagactctgtctaaaaaaaaaaaaaaaagaaagaaaaaaagagttatattatttacgactcttttagcttcactttcttataagattgttgtgagaagtgagtaagacacatgcaaagtggtaaactgcctggctgtcataaaagtcttggctactatcacggctgggaggcaaaggagattcagagaagggcagaatgactgcataaggtgatctgcctgtaactcgtgtttcytcctttctagtataaagagataaaggacttcaaggtcttaaactggtgagggagtattacagcctttgtatggaaaggtttgactttgtgtctctgcttaaacccccattgtgttgcccctaccaattattgtgctgcccccttgtggttaactgtgctaagacctttcttttgctcttctcccattacatttcccacccttccccactcccttttagacccctcctcttagctcccagtttcccaaactgtgtgccaaggtgcccagagcacctcaggcttgaacttgtgttttgagtt

SEQ ID NO: 139907 - DNA, 601 bp, Human
aaaagaaagaaaaaaagagttatattatttacgactcttttagcttcactttcttataagattgttgtgagaagtgagtaagacacatgcaaagtggtaaactgcctggctgtcataaaagtcttggctactatcacggctgggaggcaaaggagattcagagaagggcagaatgactgcataaggtgatctgcctgtaactcgtgtttcttcctttctagtataaagagataaaggacttcaaggtcttaaactggtgagggagtattacagcctttgtatggaaaggtttgactttgtstctctgcttaaacccccattgtgttgcccctaccaattattgtgctgcccccttgtggttaactgtgctaagacctttcttttgctcttctcccattacatttcccacccttccccactcccttttagacccctcctcttagctcccagtttcccaaactgtgtgccaaggtgcccagagcacctcaggcttgaacttgtgttttgagttggttcatggtttcaatattagatacctacacccgtttctacaatgtcatgtctttgtaaagatgtattttcagaggttgctccgataaaa

SEQ ID NO: 139908 - DNA, 601 bp, Human
actttgtgtctctgcttaaacccccattgtgttgcccctaccaattattgtgctgcccccttgtggttaactgtgctaagacctttcttttgctcttctcccattacatttcccacccttccccactcccttttagacccctcctcttagctcccagtttcccaaactgtgtgccaaggtgcccagagcacctcaggcttgaacttgtgttttgagttggttcatggtttcaatattagatacctacacccgtttctacaatgtcatgtctttgtaaagatgtattttcagaggttgctcygataaaaagcaactactacatgaaaatgaatgtagaacaggaaatgacagtgtggtattgtccaatttgattctaaggtttgataagttctacagtgctctacactaagttgtaaggacataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttc

SEQ ID NO: 139909 - DNA, 601 bp, Human
ctacatgaaaatgaatgtagaacaggaaatgacagtgtggtattgtccaatttgattctaaggtttgataagttctacagtgctctacactaagttgtaaggacataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttcctctcctatgtaataygtttataacttctgcccagttctttcattttaaaactaatcctattgctaacttgttgtactagtcacttcctggtttttcctgtactggtcttctgcttctacttctgttcatctccttaaactccgaatgccccaagtgaaagttaccattttctaccccttaattttcttctaatcatgtaggctttaaattaggcatcatctttaaactacttctttcatttacctcttattcccattcaaaatgtccatatttcctttctttctcatatctctgctttccctcctttactgtgtg

SEQ ID NO: 139910 - DNA, 601 bp, Human
aaatgacagtgtggtattgtccaatttgattctaaggtttgataagttctacagtgctctacactaagttgtaaggacataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttcctctcctatgtaatatgtttataacttctgcccagttctttsattttaaaactaatcctattgctaacttgttgtactagtcacttcctggtttttcctgtactggtcttctgcttctacttctgttcatctccttaaactccgaatgccccaagtgaaagttaccattttctaccccttaattttcttctaatcatgtaggctttaaattaggcatcatctttaaactacttctttcatttacctcttattcccattcaaaatgtccatatttcctttctttctcatatctctgctttccctcctttactgtgtgaatcccaggacacatttcctgagcct

SEQ ID NO: 139911 - DNA, 601 bp, Human
ataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttcctctcctatgtaatatgtttataacttctgcccagttctttcattttaaaactaatcctattgctaacttgttgtactagtcacttcctggtttttcctgtactggtcttctgcttctayttctgttcatctccttaaactccgaatgccccaagtgaaagttaccattttctaccccttaattttcttctaatcatgtaggctttaaattaggcatcatctttaaactacttctttcatttacctcttattcccattcaaaatgtccatatttcctttctttctcatatctctgctttccctcctttactgtgtgaatcccaggacacatttcctgagcctagaatattgaaagtcatttgaacttctgagaattcagtgtcccttccttctgtttatcctcaatagagattccactct

SEQ ID NO: 139912 - DNA, 601 bp, Human
gtaaaatttgaataaagtgataaaatatttgtttctaaaaggaaggagaaattcttggtcgataacttataaatctgagggttgaatgattgatgaaattaggggtactggaaagaacaaagagaagcattatttattttgaagcttttctgtatagttacaaagggttaactaggttagaatggtccatgggctgtttactttgcttgcatgtttattttgatcttcccaagaacattcttctgttcatctttttagtatgttattggaaacagagtactcattagttcttactaagtgrttttagtttaataaattatgattatgaaataaaatgctattaggtaatatttttataatataaagggccatgtgatgtgagtaagtgcactgttttggaaatcaggggataagggactgaccctgctctcagcatggtatatgatttcaggcaactcacgtaatcagtgagtcttgtctattgagggaatggactaaatcttttctagaaaatttaaaaaggtgggatcacatggtaaaatgtgtataaagtttaaaaaggaaatggtttaccaatgtttatgacaaaaaccagcaaact

SEQ ID NO: 139913 - DNA, 601 bp, Human
cacatctcttcaagctatggccccatttttcactcccctttggaacaaaactctctgagagttgtctgtatttgtctctttttattctttcataaaaaaattatctattttttgaacacatttaaatgtcttagaattcaaaaagtagtaaatatctttgtacatttgtcagggcgtgtgtgtgtgtgtgactataactaaagattaagtagaagaggagttgctgattcaaaagtggtatatgttactaagttcaacaaatattgccaaattgacatagaaataccaagttatgcttttmtacacctttactaacattgtgttttcagatgacttgattgttgccaacttgagacgtgaaaaatagaatctcattataattttaatttgctttttattctccttttttagggaactcttcactcatatcttggcccactttctattggatttgtggtccttttactttgctttgtgggagctcttatactaaggaagatagctttgagtttgcgaaatgagttgttttccctaggttgtctctttatctttttgattctgtagatagtgtgattttgttgttgtgcatctaggtaggttc

SEQ ID NO: 139914 - DNA, 601 bp, Human
gagagttgtctgtatttgtctctttttattctttcataaaaaaattatctattttttgaacacatttaaatgtcttagaattcaaaaagtagtaaatatctttgtacatttgtcagggcgtgtgtgtgtgtgtgactataactaaagattaagtagaagaggagttgctgattcaaaagtggtatatgttactaagttcaacaaatattgccaaattgacatagaaataccaagttatgcttttctacacctttactaacattgtgttttcagatgacttgattgttgccaacttgagacrtgaaaaatagaatctcattataattttaatttgctttttattctccttttttagggaactcttcactcatatcttggcccactttctattggatttgtggtccttttactttgctttgtgggagctcttatactaaggaagatagctttgagtttgcgaaatgagttgttttccctaggttgtctctttatctttttgattctgtagatagtgtgattttgttgttgtgcatctaggtaggttccttctaaccctgaaattatattttgagattctcccttgttttcttgttccatctgg

SEQ ID NO: 139915 - DNA, 601 bp, Human
tttcacgagcagaattaattaaatttcctgtgcaattttattttttatagacaaactcgtcacttcttaaaatcttttaaaaatgtcttggtaatacaggcttggaatatgatggtattgaaatgagatcttaagggaaaaaaaactccaacgggtttttttgttgttgttgttgagatggagtcttgctctgtcacccaggctggagtgcagtggcattatctcagctcactgcaacttctgcctcccagattcaagcaattctcctacctcagcctcccgagtaactgggattataggygcgcaccaccacgcccagctaatttttgtatttttagtagagacggggtttcaccatgttggtcaggctggtctcgaactcctgacctcgtgatccgcccgccttggcctcccaaagtgctgggattacaggcatgagccaccatgcccggccaaaaactccaacttttagaggcctatttacagcacttgtcccatatttgttcacactttttctgtatgtgtgttgtgaattataaatctggcttttcctacaaatgtggcttttcctgtgtagtcatcattaagcatgattctaaga

SEQ ID NO: 139916 - DNA, 601 bp, Human
aaaaactccaacttttagaggcctatttacagcacttgtcccatatttgttcacactttttctgtatgtgtgttgtgaattataaatctggcttttcctacaaatgtggcttttcctgtgtagtcatcattaagcatgattctaagaagtagctcaaaatctcctaagaccaaaaaccacaaaaaacaaaaaaaaaaacaacaaaaaaccaaaaccagaaaagggatacattttgcagaataatttatattttcttctcttcatggcatcagttttctcaggagttctttttttgagatgsagtctccctctgtcacccaggctgtagtgcagtggtgcgatctgcaagctccgcctcccgggttcacgccattctcctgcctcagcctccggagtagctgggactacaggtgcccgccaccacgcccggctatttttttttttgtattttcagtagagacggggtttcaccgtgttagccaggatggtctcgatctcctgaccttgtgatccacctgcctcggcctcccaaagtgctgggattacaggcgtgagccaccgcacccgggctcaggaggtcttttaagcttttgcctgtcat

SEQ ID NO: 139917 - DNA, 601 bp, Human
gtaactgtatgtgagtatgtttttttggactctattctgttccatttgtctatttgttcatttttgtgctaataccaatctgcttgttctatctttatgataaatcttgatgtctgataatataaatctttagtttgctcttcaagattgttttggctattgtaaatcctttgtttttcacagactttaggatcaacttgtaaatttccacaaaaactgctaggattttaattggaagtgggttgaatctatagattaatttggaaaagaaccgacatctgaaccatactgagtttttctrtattcttatatcagcatggtctatccctctcttatttagctagcatttattttttgtagaaatgttttacagtttttattgcacagtttttacagatatttccatagatgtattcctaggtatttgattttttgttactattgtaaatgatactatttttaaatgttcatttaaaaaattgtttgcttctgacatacagaaatgcagttgatttttatatattggtcttgcatcttgtgactttgctaaattcactcagtgattggtagattcttttaaatttcctacatatacagacat

SEQ ID NO: 139918 - DNA, 601 bp, Human
aagattgttttggctattgtaaatcctttgtttttcacagactttaggatcaacttgtaaatttccacaaaaactgctaggattttaattggaagtgggttgaatctatagattaatttggaaaagaaccgacatctgaaccatactgagtttttctgtattcttatatcagcatggtctatccctctcttatttagctagcatttattttttgtagaaatgttttacagtttttattgcacagtttttacagatatttccatagatgtattcctaggtatttgattttttgttactattrtaaatgatactatttttaaatgttcatttaaaaaattgtttgcttctgacatacagaaatgcagttgatttttatatattggtcttgcatcttgtgactttgctaaattcactcagtgattggtagattcttttaaatttcctacatatacagacatgtcctctatgaatactgacaattttacttatcctttctaatcatcataacttttatttagttttcttgccttattgcactagccacaatgtccactatggtattgaatagaaatcatgattttagacatgattgttacgtttt

SEQ ID NO: 139919 - DNA, 601 bp, Human
ttctaatcatcataacttttatttagttttcttgccttattgcactagccacaatgtccactatggtattgaatagaaatcatgattttagacatgattgttacgtttttgaactctagaagaacaagatcaatattttaccattaggtatattgtttttttactgttaccctttatcagagtgaggaagtttgcttttattcctagtttgagattttaaaatcatgaacattggttaaattttattaggagtagtttctgcatctattgaaatgatcatatggtgtgttttctcattgtkctaataatgtaaaatatattgactatttaaaaaatttttttctaaattacataaaaattgtatatatggtgtacaacatgacattttgttatatgtatacattgcagaatggcaaaatcagtctaattaacatatgtatcacctcacatacttatcttttgtggtgagaacacttaaaatctactcttagcaattttcaagtatacgatatattgttattggtaatcaccatgatgtacaatagatctcttcagtttactcctcctatctaacagaaatttcgtatcctttgaccaacgt

SEQ ID NO: 139920 - DNA, 601 bp, Human
attactgtatttgtttgttctcatattgctataaagagctatctgagactgggtagtttttaaagaaaagttgtttaattgactcatggttccataggctgtacacaaggcatggctgggaaggcctcaggaaatttacaatcatggtagaaggtgaaggggaaaaaagtacatcttcatacagcaacaggaaagagacagcaaaggacgacatgctgcaaaaatttaaataaccagatctcatgcaaactcactcactatcatgagactagcaaagcgtaaatccatcccatgacccagkcacctctcaccaggccactcctctaacactgaagatcataattcaacatgagatttgggtggggacacagaaccaaaccatatcaattatatatagaattattcaaattttatatttcttcttgtgctagtttaggtaaattgttttaaaaggaacttcatttgtttttaaattggagaatattcctgttgtcttttacatgtttcaatattgtaagctctggtaataatgtctactttttaattcccgatattgataatttatgttttatcttctttttttcttgatcagtctttctag

SEQ ID NO: 139921 - DNA, 601 bp, Human
actgcagtggtgtgatatctgagccttggctcactgcaatctctgcctcccaggttcaagcaattctcctatctcagcctcccaagtagctgggattacaggcacgtgccaccacgcctggctaatttttgtgttttcactggagaacagggtctcactacattggcctggctggcctggaattcctgacctcaaatgatccccccgcctcggcctcccaaagtgctgggattacaggcatgagccaccgcgcctggccctaataatgagaattcttatcaaactgtttacacagaataamatgagtgggtaatggtgaagctgagtttcacatttttatgcgatattcttcagtgttgctatttgttcagtacttttaagaattatataaattttttatagtctatacataaagtcaatattatgggtcccaaatatataaaatgtttgcttgttccattgtttatgttttgaatacaaattatattttgtatgatttcattaataatttgttgagaattttatggcctaacatgtggtctactttctaaaatattccagcttcatttgaaaaggatatgcattcttcagttgttaggtg

SEQ ID NO: 139922 - DNA, 601 bp, Human
gctgggattacaggcgtgtaccactatgcccggctaatttttatatttttagtacagacagggtttcaccatgttggccaggttggtctcgaactcctgacctcaggtgattcacccgcctcggcctcccaaatgctgggattacaggcgtgggccaccacgcctggctgtcagttgccttttaatacatttaataaatggaagaagaataatattataattaatcacatatttactatttttgagctcttcattcctttctgtaaacctgagtttacatgtaatatttcctttaatccamatgattttctttatcagttcttgagtgtgagtttgttggtgatgtactctctcagcatccatttatctgaaaacatatttgttttgccttgaattttgaaaattcttattttttataatacaacagatccagtagtatgagaattatttttcaggattgtagaattctgggttgacagctttccccctctccctaccagtactttgtcttctggcctccattacttctgaagcgatgtcagttctatttcttgtcttggttctcctgtatgtatgtgactgcttttaagattatcttttt

SEQ ID NO: 139923 - DNA, 601 bp, Human
caatctttctctgaagtaatgagttttgttctagcaggcagttaaatttactagcagaccaacttgatcctgcggaggcttggttttaggctttgttgggacaggtctatttcagttttgccattacttctggtaagtggctcttattcttcaagtgtggcttttctggcgtttcagtggaaagcctgagatatttaccagttccctctaacactaaatcctgactctccaggaccagatagctgttgaaatctcttcccagttctttcagatttctagctattgcctgtccctgggcttygattttcatcctatggatgggaattcaggagtcaggccccactgactcccattttcctgagatttctgccctcaatttttggcttttctagcagctccaaacttcattctctgatactttcacccagtaagactgcagctttttacaagagctctgtcccctcctctggcccctgcctgtacacaacagactgtgtatgtagttgtctcaggatggaagaagagtaagtatgggcctcattcagtgtattccccttctttcaagggtcatatccccccgatttgtatctgcttttgtttc

SEQ ID NO: 139924 - DNA, 601 bp, Human
agctattgcctgtccctgggcttcgattttcatcctatggatgggaattcaggagtcaggccccactgactcccattttcctgagatttctgccctcaatttttggcttttctagcagctccaaacttcattctctgatactttcacccagtaagactgcagctttttacaagagctctgtcccctcctctggcccctgcctgtacacaacagactgtgtatgtagttgtctcaggatggaagaagagtaagtatgggcctcattcagtgtattccccttctttcaagggtcatatccccscgatttgtatctgcttttgtttctttgacaatgccttcaaatggtgtttttataaatatatatttttaaaaagtttataattgtcgtcatcaggaacattagtgtagtataaactactctctcattatcaaaaatctgtatgttaaaaattacttaaaattgttgttatttatcatttccttggtgtttggggcagaagggaatgcacatgatttttctgaacttctcattaagggaggcaacccagccttggtctggagatcccgaaattataccgtatgtataataaaataattattt

SEQ ID NO: 139925 - DNA, 601 bp, Human
agggtcatatccccccgatttgtatctgcttttgtttctttgacaatgccttcaaatggtgtttttataaatatatatttttaaaaagtttataattgtcgtcatcaggaacattagtgtagtataaactactctctcattatcaaaaatctgtatgttaaaaattacttaaaattgttgttatttatcatttccttggtgtttggggcagaagggaatgcacatgatttttctgaacttctcattaagggaggcaacccagccttggtctggagatcccgaaattataccgtatgtataataaaataattattttgttatttttatgagcatagcattaataaattaaatatttagtaagatttgtatctcaggatttttctacctgctaagaatagatcgtttgacaaggcagatgaggttctttgttgaattataaggtattgaagcctataatttagtagtggaaagagcacatagcaagagttgtatgatgaggttggagaggtaagcagcaaacagataatggaattttagtctaaacattcgtaaaatatgagggtggctcctgtgggagattaggttattgggaggcaaagta

SEQ ID NO: 139926 - DNA, 601 bp, Human
aatatagtttggaagtaaaactatcagtacatattgatggactggatataggggtgaaaaaagagaagaataaaggttgaccaaattctttattatctcaaagtatgaaagcttgttaagacctcttttctgtttgtattttctttcttgctcaataagaaaacaacccaaagcactttttttctaataacttatatcttcttcttttgtgataaaaaaaaataggagtggtctttagagtacaatacaaaattcttttacatttcacctcaccatatttaggtttaccaaagtagtatargaataattgtaggaaaaacatagtatatctacttggactataaaattttggtatactaaagaaagtaaatcaaaatggttatatcttgcaatagaatgcaaaatcacatggatattaaaggtaaacatttaaatgtattttatattcttggcttcttcttcagaccactccattgccttttgggacatttctgtggaaaagttgagaagcactgacctatctgaaccttccaatccagccaaacttgtctctactttgttccaggaacatgctgtgtacattcctctttccatgttttgc

SEQ ID NO: 139927 - DNA, 601 bp, Human
gtgaggaagctgagattcatttgtcatgtaagtagtttgcaataagaaaggatgaaacttatttttaggtctcttggctcccaggttagtaatttttctaatctactgcattacttcttcatgtatatttattgatctgaaaagttgtgtctcttagaattatgtagtatatgagtaaagtttgaaaatatgaacttttaaaatgtgatatttgaggtactggtttttgagtgtatgtgtacagttgattaaaatttattataacttttatttactctttctttttttttttttttttttsgtagagacaggttctcactatgttgcccaggctggacttgaactcctgagctaaagtgatcctctcaccttggcttcccagagtgcagggattacaggtgtgagccactgtacccagcctcttatttactctttattcaacagatttgttaatcaacacatgttgaccagacttaattacagcttttatatactcttcatttattcaacaactttcatgtgtcagagagtatcctaggcactgagtgcagtagtaaataatacattaaggttcttaccttcaagaaactttcattctagt

SEQ ID NO: 139928 - DNA, 601 bp, Human
gtctcttagaattatgtagtatatgagtaaagtttgaaaatatgaacttttaaaatgtgatatttgaggtactggtttttgagtgtatgtgtacagttgattaaaatttattataacttttatttactctttctttttttttttttttttttcgtagagacaggttctcactatgttgcccaggctggacttgaactcctgagctaaagtgatcctctcaccttggcttcccagagtgcagggattacaggtgtgagccactgtacccagcctcttatttactctttattcaacagatttrttaatcaacacatgttgaccagacttaattacagcttttatatactcttcatttattcaacaactttcatgtgtcagagagtatcctaggcactgagtgcagtagtaaataatacattaaggttcttaccttcaagaaactttcattctagtggtacaagacaatgagcaaaatcataatctaatctatggtgggaaaatatcagaacagctgtggccacttgagtggttggagcagggactgatggagaaggagcatggaagaactttctgggatgctgataatttcttagggctttgg

SEQ ID NO: 139929 - DNA, 601 bp, Human
ctccctagctattctcctgtctatcttgcagaagtaaccattgtgtattgtattttgggattaacatttccttgattttttattttttttttgcgggggcggggggagatttgtttaacacatgtatatgcctaaacaatgtactattcagttttgcttgtttttgaaatttagaaaaacggtattttacagcttacagttttctataatttactgcttttgcaacattgtatttttaagatttatccatgttgcataaagctatagttcatttattttaacaactgaggaacagattctrtagtataaatgcacaaaagtatttacctattttcctgatagtttgggttgtttgcagtttttgccattggaagctgaggcgcaatgaatattcttgtaatgtgtctcttggtgtaaatatgcatgaagtttgtaactagacgtagaattgtagcagttctcagaacgtggtctctagaggatgcctgggtatcctaaaaacctattcaagggtttaatgaaattaaaatgattttcataataatgccaagatgttaaatgtctttttcattgagttgacatatgcacaaatggtacagaa

SEQ ID NO: 139930 - DNA, 601 bp, Human
aatggtacagaagtaatagtgagttaaacggctggcaccttagcacaaatcaaagcagtaatgctggttgtagttgtgatcattgtattctttttctttttcttttcttttttttttttttgagacaaggtctcactttgttactcaggttggagtgcagtggcatgagcacaatcactgctcactgcggcctcggtctcctgggctcaagtgatcctattgttttctttctcgtcatgtacttccaggaaaagaaaaaagccaattcgagtcacttattcttttgattctttttcgtagmaaagcatcaatgcattttctaaatgattgaattcatttaaattcgggaaacatttactgagtgcctatggaattctgggatatgagtgtatgtttaaggcagtgtgatttccagttaccatcctttctgttctaaacacgattgtgtcatattaaaatataaaaagagtaaaaaatatcctgaataaaaatagatcaagctgtacatatatatagattataagtgcaaaatactgagtgtggttaaagcctatgctatgcttgctgggtttcctgtacagaagtaggcattggagacagt

SEQ ID NO: 139931 - DNA, 601 bp, Human
cacaatcactgctcactgcggcctcggtctcctgggctcaagtgatcctattgttttctttctcgtcatgtacttccaggaaaagaaaaaagccaattcgagtcacttattcttttgattctttttcgtagcaaagcatcaatgcattttctaaatgattgaattcatttaaattcgggaaacatttactgagtgcctatggaattctgggatatgagtgtatgtttaaggcagtgtgatttccagttaccatcctttctgttctaaacacgattgtgtcatattaaaatataaaaagagwaaaaaatatcctgaataaaaatagatcaagctgtacatatatatagattataagtgcaaaatactgagtgtggttaaagcctatgctatgcttgctgggtttcctgtacagaagtaggcattggagacagttttgctcttgtggtacaacatggatgactagaggcaggtccaggatgttacttttactgccagccgtcgcttccctccaaatagactattggaaggggaacctcccgccaaacgctgcctactgctatagtgttggataagttgcaagcttaggaagatgagatgacat

SEQ ID NO: 139932 - DNA, 601 bp, Human
agttaccatcctttctgttctaaacacgattgtgtcatattaaaatataaaaagagtaaaaaatatcctgaataaaaatagatcaagctgtacatatatatagattataagtgcaaaatactgagtgtggttaaagcctatgctatgcttgctgggtttcctgtacagaagtaggcattggagacagttttgctcttgtggtacaacatggatgactagaggcaggtccaggatgttacttttactgccagccgtcgcttccctccaaatagactattggaaggggaacctcccgccaaaygctgcctactgctatagtgttggataagttgcaagcttaggaagatgagatgacatgatttaggaacttcaggatgaagtgaagtatctcctgccttgtgactgactggatctgcatcgtatcagatacctcctcaaggcaggaattttaacctgctgttataagacctggttctatatatggatagcccaggtaggctaagttgtggcagccacagattgttagatgaggagggacaccacagactgtgtatgtgtgtgtgttgagggcaaggtgaggtgaggaatggtgcaatgagcc

SEQ ID NO: 139933 - DNA, 601 bp, Human
ctgttgaatttccgtgttctctcttagatgacctattcaaagtgtgattatctactcgctattttggttcttctttgtggagcaggtgagtaccagataactctagtcaaccttctggacccctcttcccccaatttgagatctcttcttctgttgtctgtaactgagtttaatgcttgtttgttcatgttaggattttatatcatcgtcctcaattaggttgttaactggaattttataatctttgtccacaggaagtttaaaatgtatgatttcttgcattgtgctttgtatgtagtartacacgatatttatccagttaatggatttgacagccattgctgtcaaggagcagtccttctttgtgtatgaagggtgccttatcaatattatttccatttgtaactttatttatttatgtattcatttttgagacagggtcttgctgtgtcacccagactggagtgcggtggagtgcggaggtttgctgcagcctcatcctcccaggttcaagcaattcttccgctccactcccagagtagctaggactacaagtgcgtgctgccacgcccagctaatttttttcttttgtatgtttttg

SEQ ID NO: 139934 - DNA, 601 bp, Human
tctaaagcttgtggtaagtattaaaaaacagcattttcctttttatgcatggattgttttaattatgctatgctaatactaggtacatgcataatatatatttttatttttttaatgcttgtatggctggcgtgtgtgttttcacatgcatagaaaatgaaagtgttactggagtacaatttatggtgaatctgccttgggctaggtatcaaaacaaattgatgcccataaatgtttgctgactattctttataattacatataaggtggttaaaaaatcctgtcatgggctatctcatgacataaggtaatattaaagctagatcctgagagcaacatgaaagcaaaaaattaatgttttgaaatatgtatttgatttaaaatcttgattaaatggctgacaaaccatcattttcttctagttagcttctgaagacctctgccaatctttcctcatatatatttcttatgtctttggtgtatcttgaaatcatttttactcttgagacctgattatattatctatggaccaaaactgtgaaccagagaactctttctatagagctaacacattttactagaccactgaggttactataga

SEQ ID NO: 139935 - DNA, 601 bp, Human
ggtaatattaaagctagatcctgagagcaacatgaaagcaaaaaattaatgttttgaaatatgtatttgatttaaaatcttgattaaatggctgacaaaccatcattttcttctagttagcttctgaagacctctgccaatctttcctcatatatatttcttatgtctttggtgtatcttgaaatcatttttactcttgagacctgattatattatctatggaccaaaactgtgaaccagagaactctttctatagagctaacacattttactagaccactgaggttactatagagcctaytatcatggtatctcatttttaaatgttcttttaatagaaagactagttgacactattttgaagaatagtcgtatgattttatttgtagaggcaaattaaatgtctaatatagtatttataagaatgtatgattacatcaatttattctcttatttaagatcagtataggtcagaataaccattaactgtaagttggaggaagctaggtacatttcaagttccttctagctattttgaaaaatacaatacattgttgttaactatagtcaccctactcttctatcaaacatttgaacttgt

SEQ ID NO: 139936 - DNA, 601 bp, Human
acatctcttcatttccctcttcccacccatataaccttgccagtctctgctaccaatccactctaccttcatgtgatcaactttttagctcccacatatgaatgagaacttgttatatttgtctttcagttcctggcttatttcactcgacataatgaccttcagttccatccatgttgctgtgaatgacatgattacattcttttttacgatgccactgggccccaggggagtacgcattctgttgtgagctgggcttcaaaatatcaccttgctgtagctgcttaggactcggggggarcgtgggacccagtgtgaacttcctcactggaataggaaatgcttttgtgctgtctctgggcagccctctatgtgaattttttgtcctgcaaggggctagggtctctcctgtgactaaaattccaggggttcacagtaggaatgtggaccattgggcatctctaacttaacctttccctgtgtggagtctctcctagcttcttgccaatcccggctgggcaggctgtcttgtttcgtctccttccttgcttttctgttgaataccagtgttcctcttggataatctactcaaagtgtgatt

SEQ ID NO: 139937 - DNA, 601 bp, Human
agttccatccatgttgctgtgaatgacatgattacattcttttttacgatgccactgggccccaggggagtacgcattctgttgtgagctgggcttcaaaatatcaccttgctgtagctgcttaggactcggggggagcgtgggacccagtgtgaacttcctcactggaataggaaatgcttttgtgctgtctctgggcagccctctatgtgaattttttgtcctgcaaggggctagggtctctcctgtgactaaaattccaggggttcacagtaggaatgtggaccattgggcatctctmacttaacctttccctgtgtggagtctctcctagcttcttgccaatcccggctgggcaggctgtcttgtttcgtctccttccttgcttttctgttgaataccagtgttcctcttggataatctactcaaagtgtgattatatactcatggttttagtttttagtggggaagtggatatgagagacctctggtcagttatcttgactatattgtaaagtctgtattttttgttgtgtgtagtctctgaaatctctgatcctttagcttatagtaagattttagcttgtaagatttttttagc

SEQ ID NO: 139938 - DNA, 601 bp, Human
tctctgggcagccctctatgtgaattttttgtcctgcaaggggctagggtctctcctgtgactaaaattccaggggttcacagtaggaatgtggaccattgggcatctctaacttaacctttccctgtgtggagtctctcctagcttcttgccaatcccggctgggcaggctgtcttgtttcgtctccttccttgcttttctgttgaataccagtgttcctcttggataatctactcaaagtgtgattatatactcatggttttagtttttagtggggaagtggatatgagagacctctgktcagttatcttgactatattgtaaagtctgtattttttgttgtgtgtagtctctgaaatctctgatcctttagcttatagtaagattttagcttgtaagatttttttagcttttaagattttttagcttgtaagatattttttagctagtaagattttagcttgtaagatttttagcttgggccgggcacggtggcttacacctgtaatcccagcactttgggaggctgaggcaggcagatcacaagatcaggagatcgagatcatcctggctaatatggtgaaacctcatctctgctaa

SEQ ID NO: 139939 - DNA, 601 bp, Human
gcacctgtagtcccagctacttgggaggctgaggtgggagaatggcatgaacccaggaggcggagcttgcagtgagccgagattgcgccactgcactccagcctgggcgacagagcgagactccatctcaaaaaaaaatttttttttggcttgtaagattcatttttagcatgtaagattttgctttagcttgtaagatttttttttgacagattttattgaattcctagggccaaaagaaaataatagaaaagaacaaaaaactctttcagtctttgcagattggctctgtgttggggcwctcattcagtgtttacccagtccatttacaactctgccttagccttcccttcctgcttgtgctgactctaaagaacagcttgaggtgaaagcttagggtcttttcttctaagttctgttccttgggcatgcatatggcttttctactctccaatacatagaaatgcttttcagtgctgtcatttcccaaataaactctcctctgtcatctctgttttggttttcagtgtgtttattgtttgcctcaactttagacctctgccccagatagcaacagcttgttcatttgcaatgttttcaa

SEQ ID NO: 139940 - DNA, 601 bp, Human
tttctatctatattggtgagattacccttggtatcgtagtcaaactaaattcacaaaatgtgtcaatttctctgttcgctcttggtctattctctgtgatagtatacttaagatggaattgtctttcatgtttggttgaactcaaatataaatcttgtctgggcctgatggtggttttttctttcttcattgttattttgttattcttcttccttcccttcttctgtctctttcttgctccttctttcttttcttcttcttttgtttaagtggatagagtttgtttcctttttttttttttgagactgagtcttgctctgttgcccaggctggagtgcagcagcatgattatggcacactgccacctccgccttccaagttcaagtgattcatttccctcagcctcctgactagctggactacaggcacccaccaccacacccagctaatttttgtatttttggtagagacggggtttgccatgttggccaagcttatctcaaactcctgacttcaggtgatccacctgcctcggcctctcaaagtgtgtgagccactgcacccagccagaatctatttctttaatggttatagttctgtt

SEQ ID NO: 139941 - DNA, 601 bp, Human
ttttgttattcttcttccttcccttcttctgtctctttcttgctccttctttcttttcttcttcttttgtttaagtggatagagtttgtttcctttttttttttttgagactgagtcttgctctgttgcccaggctggagtgcagcagcatgattatggcacactgccacctccgccttccaagttcaagtgattcatttccctcagcctcctgactagctggactacaggcacccaccaccacacccagctaatttttgtatttttggtagagacggggtttgccatgttggccaagctkatctcaaactcctgacttcaggtgatccacctgcctcggcctctcaaagtgtgtgagccactgcacccagccagaatctatttctttaatggttatagttctgttgaagttttaaattaatgaatctttttaaagttacattttcacaaaaattgtccatctgtctatattttcaagtttattggcataatgttgttctagcactctttgtcttcataacttataattatgctttttaaaagttcttagtgtttatctgtgcctctttttttcttattatccttgacaaagatctatttt

SEQ ID NO: 139942 - DNA, 601 bp, Human
gaactccaccaatggggagctgaacgcggacgaccccatggccggccactccagcgcccatcagggcgcctgcagagatggaggtgggcgatgaaacgaaatgctgctgtttcttccccctgaatcttctccgtgcggccccttggggagcgagcttgtgtgagggccttggggcccacccacagcggcccagggccagacgctggctggaagccaggacacagactgcagggtcttggccggcggccccatccccgggacgaggggtcacttccttcacgtaagactggccaaaatttcytttttttttttttttttttttttgagacggagtctcgctttgtcgcccaggccggactgcggactgcagtggcgcaatctcggctcactgcaagctccgcctcccgggttcccgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccac

SEQ ID NO: 139943 - DNA, 601 bp, Human
aggcctggcctggaggggtgctgtggggccatcttgcccaggcccacctgggagggacacaggcattgctgccaggggtgaggctgtgccccaggcctccccaaaactaaaggggaacggaggggtggggccgcggctgaagccagccccgcaaccaaaatgctgcaccaaagctcggtcgccacaggcacggccaccgcagcctttcacagcctggccccggcgaggggcaggtgggccctgctaggagggtgcttctcgaggcacctgttccccgaggctgtgctccgaccctcagaasctgaggggggtgggccggctggcgtcgcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggtctgcgggcggccctggactggctggcggactcccagcgggtcagcttgaggcagtgcccagggcggtggccgtgagtctggtttttgctttaccaagtgtacggaaatggcgtttacgtttctctgatg

SEQ ID NO: 139944 - DNA, 601 bp, Human
ggcctggaggggtgctgtggggccatcttgcccaggcccacctgggagggacacaggcattgctgccaggggtgaggctgtgccccaggcctccccaaaactaaaggggaacggaggggtggggccgcggctgaagccagccccgcaaccaaaatgctgcaccaaagctcggtcgccacaggcacggccaccgcagcctttcacagcctggccccggcgaggggcaggtgggccctgctaggagggtgcttctcgaggcacctgttccccgaggctgtgctccgaccctcagaagctgagrggggtgggccggctggcgtcgcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggtctgcgggcggccctggactggctggcggactcccagcgggtcagcttgaggcagtgcccagggcggtggccgtgagtctggtttttgctttaccaagtgtacggaaatggcgtttacgtttctctgatgctcttt

SEQ ID NO: 139945 - DNA, 601 bp, Human
ggccatcttgcccaggcccacctgggagggacacaggcattgctgccaggggtgaggctgtgccccaggcctccccaaaactaaaggggaacggaggggtggggccgcggctgaagccagccccgcaaccaaaatgctgcaccaaagctcggtcgccacaggcacggccaccgcagcctttcacagcctggccccggcgaggggcaggtgggccctgctaggagggtgcttctcgaggcacctgttccccgaggctgtgctccgaccctcagaagctgaggggggtgggccggctggcgtygcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggtctgcgggcggccctggactggctggcggactcccagcgggtcagcttgaggcagtgcccagggcggtggccgtgagtctggtttttgctttaccaagtgtacggaaatggcgtttacgtttctctgatgctcttttgaagccatacaacttaggg

SEQ ID NO: 139946 - DNA, 601 bp, Human
agctcggtcgccacaggcacggccaccgcagcctttcacagcctggccccggcgaggggcaggtgggccctgctaggagggtgcttctcgaggcacctgttccccgaggctgtgctccgaccctcagaagctgaggggggtgggccggctggcgtcgcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggyctgcgggcggccctggactggctggcggactcccagcgggtcagcttgaggcagtgcccagggcggtggccgtgagtctggtttttgctttaccaagtgtacggaaatggcgtttacgtttctctgatgctcttttgaagccatacaacttaggggctttaaaaaaaaaaaggaaaaatgaaaccctccgaaaaaaagatgcccaacatcattggtcattagagaaatacaaatcaaaaccacgatgggataataataggtctacaaggatggcaaaaatcagaaagacaaacaataaca

SEQ ID NO: 139947 - DNA, 601 bp, Human
cggtcgccacaggcacggccaccgcagcctttcacagcctggccccggcgaggggcaggtgggccctgctaggagggtgcttctcgaggcacctgttccccgaggctgtgctccgaccctcagaagctgaggggggtgggccggctggcgtcgcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggtctgygggcggccctggactggctggcggactcccagcgggtcagcttgaggcagtgcccagggcggtggccgtgagtctggtttttgctttaccaagtgtacggaaatggcgtttacgtttctctgatgctcttttgaagccatacaacttaggggctttaaaaaaaaaaaggaaaaatgaaaccctccgaaaaaaagatgcccaacatcattggtcattagagaaatacaaatcaaaaccacgatgggataataataggtctacaaggatggcaaaaatcagaaagacaaacaataacaagtg

SEQ ID NO: 139948 - DNA, 601 bp, Human
gtgaaggtaagggcccaacttcttttgcttgtgaatatccagttttcctagcaccatttgttgaaagactgtcttttctccattgaatggtcttggcacctttgttgaaaatcatttgaccaccaacctacttttttatacagctcctttatctgtatagccattatgaaaagagaggggaatggagagaggcttctaagaatagccttttgaaaacaggatattatgaggttacaactttctgttgcttttacgggtatattatttcacctgtgctgcagagctagtatattttgggggyaggctagttaagtcccatttataagccaagttttcccaaactattcattcagctactttagcctaatattaatactgcaatgtctagtatttttgatctagaaaaattttgggtgatttcagaatactcaattttatccttctaggaaggattgtcttatctagcatggcaaggtaattccaccatataattctaaattatgtctagatagtaccacaagcaattttctattttttaatgtttttacttctctaaatttgtgcccagaaaatatgatagtatttagattactctaagatt

SEQ ID NO: 139949 - DNA, 601 bp, Human
tcctaaatcctccaggtcaaaatcgtagaacctctgtgtttctctcttcttcattctttagacaatatatagttaataaagttatcagccttttttcagaatcttttagtatcttctgtttcctggatcagatccttattatttcgtatctgagccatacaccagcctcttaaagagcctccgtaaatacactttattttcttcaagcacttctatcattgctactactctgccaatggaagagacatgatgaaaacagatctccatagtttctaggatcaggtcattcaagggtacctgyagtcggaccccaacttacttttctaagttttaatccacattatttcttcacataaacttcaggccctaatcaaattagtttatgcatctgaacatatctggtgcttttgtgtgtgtgtcattccttctatttctttaccctgttttgtgtccatcatacatttctttatttttaaacacactgtgaagtttcaaatcttccatgaaaccctccttgattactccagctgaatataatcttaactttctccaagttcctgaaggagcttttgtgtggtgcttcctatatcatgtctggtgt

SEQ ID NO: 139950 - DNA, 601 bp, Human
ggtccccttgatgactgagaccacatcttatacagtcatgtgtcacttacttatggggatatattctgagaaatatgtcgttaggcaattttattgttctgtgaatatcatgtattgtacttatacaaacctatatgttatagcctagtatatgcctagtctgtatggtatagcctattattgctctaggctacaaacttatatagcatgttgctgtactgaatattgtaggcacttgtaacacaacggtaagtatttgtgtagttaaacatatctaaacataaaaaagatacagtaaaawtgcagtattacaatcttatggaaccatcgttatatatgtggtctgccattgaccaaaacattgttatggggcacatggctatttctttgtatccaacaccacttgtagtatgatacttccaacataattggagttcagtatatatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaat

SEQ ID NO: 139951 - DNA, 601 bp, Human
ttgttatggggcacatggctatttctttgtatccaacaccacttgtagtatgatacttccaacataattggagttcagtatatatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaattgtatcgcaaaatgaatgaaaattaaaggaggaatttatgccatttatttatttattaatyattttagagactgggtcttggtctgttacccagactagggtgcagtggtgtgatcatagctgaagagatcctcctacctcagccccccaagtagctgggactgcaggtatgtgccaccatgcctggataatttttaaattttttgtggagatgagatcttgccatgttgcccaggctggtctcaaactcctgggctcaagtgatcttcatgccttggcctcccaaagttctgggattacaggcatgagccactgagcctggccaatttgtatcttgtaaatgcatatgttctgaaaatta

SEQ ID NO: 139952 - DNA, 601 bp, Human
accacttgtagtatgatacttccaacataattggagttcagtatatatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaattgtatcgcaaaatgaatgaaaattaaaggaggaatttatgccatttatttatttattaatcattttagagactgggtcttggtctgttacccagactrgggtgcagtggtgtgatcatagctgaagagatcctcctacctcagccccccaagtagctgggactgcaggtatgtgccaccatgcctggataatttttaaattttttgtggagatgagatcttgccatgttgcccaggctggtctcaaactcctgggctcaagtgatcttcatgccttggcctcccaaagttctgggattacaggcatgagccactgagcctggccaatttgtatcttgtaaatgcatatgttctgaaaattatgattaaaatataatcatagattaaaacatgataatg

SEQ ID NO: 139953 - DNA, 601 bp, Human
cataattggagttcagtatatatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaattgtatcgcaaaatgaatgaaaattaaaggaggaatttatgccatttatttatttattaatcattttagagactgggtcttggtctgttacccagactagggtgcagtggtgtgatcatagctsaagagatcctcctacctcagccccccaagtagctgggactgcaggtatgtgccaccatgcctggataatttttaaattttttgtggagatgagatcttgccatgttgcccaggctggtctcaaactcctgggctcaagtgatcttcatgccttggcctcccaaagttctgggattacaggcatgagccactgagcctggccaatttgtatcttgtaaatgcatatgttctgaaaattatgattaaaatataatcatagattaaaacatgataatgaaacttacgatgagatatttccttc

SEQ ID NO: 139954 - DNA, 601 bp, Human
taaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggtaatccttaatgatatgttcttgttctttgttattttaagtacaatggaaataaaaacaaagtaattttaatcatttgcaacatggtattgcacttctcccatttgatagaagtggaagtttttaatagygtgaacctatcaaggtcatataattctttgcctactattcttaaatggttttttcatttaattttttatgacaaaataattaccaatgactatattatagtttcagaaagatgtcaaattctaaaagtgattttaaaggagttttgcctttcactactagtgataacagaaggcataattataaaacttgttaactagaaaagattgatattaattgattttatgataatatatacctgctaaataatgaatttattttaggtttgcattgcaagttttgaatttgttaatatccgtgtt

SEQ ID NO: 139955 - DNA, 601 bp, Human
ttctaaaagtgattttaaaggagttttgcctttcactactagtgataacagaaggcataattataaaacttgttaactagaaaagattgatattaattgattttatgataatatatacctgctaaataatgaatttattttaggtttgcattgcaagttttgaatttgttaatatccgtgttgttcatagattgttactagagatttagagggatcattttttaatttttcatctttggtagtcacatttccagttttctggcagtggtttctactaatgttaattgaattgaagagtgcyatagcacattttagattcctggcatcatttaatgccctcatttttaagtcaagcaagatacagcatagtcttagggttagattgatagagtaaatcacgtttaatgcttatctattgttatcaataccttttttattttaaagaatttggaaagaatgttgtcttcttaagtcttgttttaaaatggctctgtaaattctacccgtttttaattttacatgcttttaattataggatttacagttatattgcgattttcctaatattattgatgtcagtattaagcaagcaaaccaagag

SEQ ID NO: 139956 - DNA, 601 bp, Human
tttgtaccccctacaccttgcacagtactcagggcctagtttagaaaaagcttgataaatattttatggatgcataaaaggatgattaacaattatcaacctcaatgtggatatataataaatgtttctgggagagtttattgatcttaatgtgaacaaactgtagtaacccaaagaacttctccatgggactgtatttggacttggcttaattttaagtctgcaatacagagaagttaagtaactttccaagggcacagtgttagttaagtggtagggctatttaaactcaaatgcatgmtttgaaaacctaagctcttaagtgtgacactaacttctttgctaagtatccgtaaagctccttaaaaatattatactgacattttgttggaattgtgcaacaaactgggaagagttgacatttctttctcatattaaattttttattttagggatacattgtatttctccttgtatacaagtattattttatgtttttcagtaattcttgatcattttattcatattgatacatcatgtttcttgctgaattttattcatgatatgttatgctttttctgttgtttattaaaattaatac

SEQ ID NO: 139957 - DNA, 601 bp, Human
taaagctccttaaaaatattatactgacattttgttggaattgtgcaacaaactgggaagagttgacatttctttctcatattaaattttttattttagggatacattgtatttctccttgtatacaagtattattttatgtttttcagtaattcttgatcattttattcatattgatacatcatgtttcttgctgaattttattcatgatatgttatgctttttctgttgtttattaaaattaatacttcttctctgtgtattttcctaccaaattatttatggatataggaaagtaatwtttgcttattattgcattttcccagtgtattatgtgttagtaacattttgtttttactgtcattttcctcttcattctggcatttatttctctttataattttggtaaaatatatataaaataaaatttagcatcttaaccatttttaagtgtacagtttagtagtgttaagtatattcacttttgcatccaatttccagaactcttttatcttgcaaaattgaagtctacacccattaaataaaaactcaccatttccccctcttcccaatccttgcaaccagcattctactttctttt

SEQ ID NO: 139958 - DNA, 601 bp, Human
gatataggaaagtaatttttgcttattattgcattttcccagtgtattatgtgttagtaacattttgtttttactgtcattttcctcttcattctggcatttatttctctttataattttggtaaaatatatataaaataaaatttagcatcttaaccatttttaagtgtacagtttagtagtgttaagtatattcacttttgcatccaatttccagaactcttttatcttgcaaaattgaagtctacacccattaaataaaaactcaccatttccccctcttcccaatccttgcaaccascattctactttctttttttttttttttttttttgagatgagtcttgccctgtcatccaggctggagcacaatggcgcgatcttggctcactgtaacctgtgcctcctgggttcaagcaattttcctgcctcagcctcccgatagctgggattacaggtgcacgccaccatgcttggctaattttttgtatctttagtagagacggggtttcaccatgttggccaggttggtcttgaagtcctgacctcatgatccgcctgcctcatcctcccaaagtgctgggattacaggtgtgagcca

SEQ ID NO: 139959 - DNA, 601 bp, Human
tcatcaaaacttgttattttctgttttctgatagtagccatctgatgggtgtgaagtagtatctcattgtgattttgattcacatttccctaatgattagtgttgctgagcgtcttttcatatatgtattgccatttgtatatcttctttgaagaaatatatattcaagtcctttgctcattttttaatcaggttttttttgctgaattatagaaattatttatgtattctggatattaatcccttttcaaatatatgatttgcaaatattttctcccattccatagattgcttttcactmtgttgcttgtgtcctttgatgcgcagatgttttaaagttttagctagttcaacttttgttgcctatttttctttttactttgttgagatataacatgaacccagtaaagcacactaatcttacgtgtatagctcaatgaatttttacatatttgtacatctttgtagccacacccacctcaaaaaacagaatagttctcttactcctagaaggtttccacatgcatcttcccacatattcacctccacccctaacttaagatacctatcatctaccatcacttagttttatctattaata

SEQ ID NO: 139960 - DNA, 601 bp, Human
tatttgtacatctttgtagccacacccacctcaaaaaacagaatagttctcttactcctagaaggtttccacatgcatcttcccacatattcacctccacccctaacttaagatacctatcatctaccatcacttagttttatctattaataaaggttgtataaatggaatgatactgtatgtattcttttaaaatctagattcttttagttagtataatgtttggagattcatttatgttgttacatgtgtcagttcattcctttttattgctgggtagtattgaattgtttgactgtayctcaaattttaaatgtattctgttgatggacatttgggttgctttcactttggggattttagggataaatttaccatgaacattcttatacatattttttggtggacttatgcactctttttttgtatatatatatcctagagataggattattgagtcatagtgatagctttagtatactgccaaacaattttttgtagttctatcagttcactcttctttcagtaatgcatgaaaattacagttgtctcatatccccatcaactcttaattttgtcagtctaaaaatgtcttagtttg

SEQ ID NO: 139961 - DNA, 601 bp, Human
cagtcagaacatatacaaatttatcacttaagttcaccatcttatataggcccagtgtgtggtgccccaaaacaattacagttgacccttggacatcacaggtttgaattgtgtgggtccacttatatgcaattttttttcagccaaacatggatggaaaatatagtattcacaggatgcaaaacctgcatatgtgtagggctgacattttgcatatatgggttctgcagggctgatttcagaacttgaatatgttcagattttggtatatgcaggggtcctgtaactaatcccccttgtwttctgagggacaactgtacaatagttacatcaaaggtcattgatcacaaatcaccgtaacaggtataatagtaataaagtttaaattttgtgaaaattaccaaaacatgacacataggaagtaagcatatgctattggaaaaattgcactgatagacttgtacttgctccacttaagtttgtcagaaaccttccatttgtaaaaaaaaaaaaaaaaaaaaaaaaaaaaaaagggtcatatctgcaaggagcaataaagggaagtgcagtaaaacaaaatgtgtctgtatatcaataagag

SEQ ID NO: 139962 - DNA, 601 bp, Human
ctggagaagtacctcttcgatcacagcatcttactttgtagtgtggactggaagttttctgggtacagctattattttgtcagctgtaatttttggtcattcctttcttatcctggtaactatgttttcatctctcttatattggatctgattttctaaatctcatgtttgccctgtttttctaggtacagcctctggtatttgttggtatctttaatgtgattgagacaaattagaaaattaatttagagaggatttttacatttttatgatattgaattttcctaccatggttaatctyctatatatttaaataaaaagttgcataagagtgttttgaagtttttgttaattattgatattgcatcctctttgttacaaatggggcttttttcattatataactgactttttgtatgtaaaaatataatacgtctatatattttcccatgtaagtaacatgctgcatttttggctgactacatgttcacatatgtattaagatacaatcaggccgggcatggtgactcacgcgtgtaatcccagcactttgggaggccaaggcgggcggatcattaggtcaggaatttgagaccagcct

SEQ ID NO: 139963 - DNA, 601 bp, Human
gtagtgtggactggaagttttctgggtacagctattattttgtcagctgtaatttttggtcattcctttcttatcctggtaactatgttttcatctctcttatattggatctgattttctaaatctcatgtttgccctgtttttctaggtacagcctctggtatttgttggtatctttaatgtgattgagacaaattagaaaattaatttagagaggatttttacatttttatgatattgaattttcctaccatggttaatcttctatatatttaaataaaaagttgcataagagtgtttygaagtttttgttaattattgatattgcatcctctttgttacaaatggggcttttttcattatataactgactttttgtatgtaaaaatataatacgtctatatattttcccatgtaagtaacatgctgcatttttggctgactacatgttcacatatgtattaagatacaatcaggccgggcatggtgactcacgcgtgtaatcccagcactttgggaggccaaggcgggcggatcattaggtcaggaatttgagaccagcctggccaacatgttgaaactctgtctctactaaaaatac

SEQ ID NO: 139964 - DNA, 601 bp, Human
tgtctatctttttattttgcatttattttattttctgatgttttggtgttaccagtgtgttaaaaggtatttcatcaagtgtcttgatgtttctttgtttgcaaaactggaaatctttgccacatcatgtagaacaaaataaatcggaagcaaattttctgtttattaacagtggttgcagaattagaggaaacagaattagagaaaactaggtcaataacaaacaaatagaaacattaaagcacttttaactgatgattttctaatatttttaagaatagtggtctacaatgcatgtttyaacggtaaaactgcaatgaaaccccactgttaatacagatcattttggatctcatctatgattatatactatcacttatgaggcaatttcatggtataaatcctaagaaactatagaagcttgcaaatttatcttgcttttttaaaacagagaaaaataagaactttgttattcaattattttaatttttataaaatgcaacttatatttggcatatgtagagggtagattacttacagaagggaggttatgccatcactttacctttgtgtaaaactggtaatctatcctaatttcaaa

SEQ ID NO: 139965 - DNA, 601 bp, Human
ctatctttttattttgcatttattttattttctgatgttttggtgttaccagtgtgttaaaaggtatttcatcaagtgtcttgatgtttctttgtttgcaaaactggaaatctttgccacatcatgtagaacaaaataaatcggaagcaaattttctgtttattaacagtggttgcagaattagaggaaacagaattagagaaaactaggtcaataacaaacaaatagaaacattaaagcacttttaactgatgattttctaatatttttaagaatagtggtctacaatgcatgtttcaamggtaaaactgcaatgaaaccccactgttaatacagatcattttggatctcatctatgattatatactatcacttatgaggcaatttcatggtataaatcctaagaaactatagaagcttgcaaatttatcttgcttttttaaaacagagaaaaataagaactttgttattcaattattttaatttttataaaatgcaacttatatttggcatatgtagagggtagattacttacagaagggaggttatgccatcactttacctttgtgtaaaactggtaatctatcctaatttcaaagta

SEQ ID NO: 139966 - DNA, 601 bp, Human
tgattgaccttgaggtattggtagattttatataaatgtttctgagtagaatgaatatgtttataaaatgcaccttaaaaataggtgaacaagttcataatatagtgcataagacaaatatttaaaaactgcaaaatattaaaaatgtaatattaaagataattatacaaatacaatggtggtgcagtggaatggctgtatgttcacctttgcttgtgcaaagaggtgagcattagagaggacctcttagaaacagtggtacttgaactgagttttgatgaatgaataaaggttcattgcycagaagaagtgggtatacattcttaggtagaaagatagcatgaagaattatcaaggcatgaagcagcatggcatttgcttgaaatgatttaagtcatttaatatggctggaacgtaggttgtatgttggcagtggcaggagctgagattggagatggaggcagaaaccagctcatggaaggctctatatgctacatttgttttaggctttatcttataaatgatggaaaactattaaggatggtattgttgctattaattatcattgccttcttacatgctttttcataaaatcaacttt

SEQ ID NO: 139967 - DNA, 601 bp, Human
aaagagattatggcaggttcaacataacattggaataactggccttttcagtacaaacttatctggaattatgaagacaaagcatataaatgatacacttaatttttaatggaactgacagaaatgattatgttgatatgatactagatatattttttggctaaatttaggtgttcacagaaactactaaaagtataaatcgtaccccatgctttaatactatacaggcatgcctcattttattgcaccttgctttattgtgcttcttagatattgtattttttacatattgaaggtttayggcaacccagtgtctagcaactctgtcagcaacattttcccaacagcatgtgctcatttcatgtctctgtgtcatattttggtaattctagcaacatttcaaactttaaaaaaatcatatggtgatctgtgatcagtaatctttaatgctagtattgtaattattctggggtgtcccaaacagagagaatataagaaggcaaacttcatagatgaatgcagtgtgtgctctgactgctccatcaatgagccattcctctgtctctctccctctcctggggcctccctattccctgagaca

SEQ ID NO: 139968 - DNA, 601 bp, Human
gtatgtaaaatcacttttgaaaaaaaagttttgtcatcccatcaatatcttagaactactaatagacaatctgtatgttgtgtcttttggatttagaaaattcaaccaaaaattatgcagaagtatgtgcttctgtatttttgggccattgtacattatggtccatgagaaagcggtgttgacagagaagaataccagggggactgccagtcatcagacccctcagggtgcacctatgtcctgctgcagaactgaagtagtatttcttaatgtcagctcccatccagaaacacaaaccatstcagccttagaactcatgtgaaatggcattggtagttttaatttattcatttcatcacaagcatagattattgtgttatttaaaatgtaaaacaggaagcataggagtcataaatttccttttttctcaatgcatgcctccaaattattatactatcatgtatttttcttctttaaatctgttttgggggcttgaacatactaaatgctccagtacttgtggactgatatttgaatatatgtgcgtttaactctaataggaagaaaacacccttattcatgggaatgtatgtgccaaaaa

SEQ ID NO: 139969 - DNA, 601 bp, Human
tgtatgttgtgtcttttggatttagaaaattcaaccaaaaattatgcagaagtatgtgcttctgtatttttgggccattgtacattatggtccatgagaaagcggtgttgacagagaagaataccagggggactgccagtcatcagacccctcagggtgcacctatgtcctgctgcagaactgaagtagtatttcttaatgtcagctcccatccagaaacacaaaccatgtcagccttagaactcatgtgaaatggcattggtagttttaatttattcatttcatcacaagcatagattaytgtgttatttaaaatgtaaaacaggaagcataggagtcataaatttccttttttctcaatgcatgcctccaaattattatactatcatgtatttttcttctttaaatctgttttgggggcttgaacatactaaatgctccagtacttgtggactgatatttgaatatatgtgcgtttaactctaataggaagaaaacacccttattcatgggaatgtatgtgccaaaaatattctgcttatcagagaagaagacaggaagacaggaaatcctcctttcatcaaacttagtgatcctggca

SEQ ID NO: 139970 - DNA, 601 bp, Human
atattctaatctccttgactgagaattattttcatttttataaaaagaccttttctttttttttttttttttttttgagatggagtcttactctgtcgcccaggctggagtgcagtggcgcgatctcggctcactgcaagctccacctccaaggttcacgccattctcctgcctcagcctcctgagtagctgggactacaggcgcccgccaccacacccggctaattttttgtatttttagtagagacggggtttcaccgtgttagccaggatggtctcgatctcctgatcttgtgatccrcccgcctcggcctcccaaagtgctgggattacaggcttgagccaccgctcccagccaaaaagaccttttctttcagtaacctaattttagttttccatttagtgagttgtaaattatagtattttttttttgcttaaattgacttttaaaaaacaattctctttaacatttctcatattttataattgattgattctctaaacatgagctgtatttgttttgctttgttctctcctttttcaaaatactgagctgaaatgcatgtgtttgacctataggtgctttctaccccagtactac

SEQ ID NO: 139971 - DNA, 601 bp, Human
cactgcaagctccacctccaaggttcacgccattctcctgcctcagcctcctgagtagctgggactacaggcgcccgccaccacacccggctaattttttgtatttttagtagagacggggtttcaccgtgttagccaggatggtctcgatctcctgatcttgtgatccgcccgcctcggcctcccaaagtgctgggattacaggcttgagccaccgctcccagccaaaaagaccttttctttcagtaacctaattttagttttccatttagtgagttgtaaattatagtattttttttttgcttaaattgacttttaaaaaacaattctctttaacatttctcatattttataattgattgattctctaaacatgagctgtatttgttttgctttgttctctcctttttcaaaatactgagctgaaatgcatgtgtttgacctataggtgctttctaccccagtactactcacctttctcacaataagtatcagtatattaccttactttatgaatactaaaacttcttattttggaaaacaaaattttatcctttgcaaagtctctcttgaaggcctgtcagattatgggtaatgatta

SEQ ID NO: 139972 - DNA, 601 bp, Human
tacaggcgcccgccaccacacccggctaattttttgtatttttagtagagacggggtttcaccgtgttagccaggatggtctcgatctcctgatcttgtgatccgcccgcctcggcctcccaaagtgctgggattacaggcttgagccaccgctcccagccaaaaagaccttttctttcagtaacctaattttagttttccatttagtgagttgtaaattatagtattttttttttgcttaaattgacttttaaaaaacaattctctttaacatttctcatattttataattgattgattytctaaacatgagctgtatttgttttgctttgttctctcctttttcaaaatactgagctgaaatgcatgtgtttgacctataggtgctttctaccccagtactactcacctttctcacaataagtatcagtatattaccttactttatgaatactaaaacttcttattttggaaaacaaaattttatcctttgcaaagtctctcttgaaggcctgtcagattatgggtaatgattaaaggctcccattaatataattgaaactatttgagtttccctgtatcatttagtatttttaactca

SEQ ID NO: 139973 - DNA, 601 bp, Human
gggatcctacacagtttgaagagagacatttgaaatttctacagcaacttggcaaggtaaattgtcagaattttttcaaatagagtataatcatttcatttaggaaaaacttaagagcgtttctaaagttcactttctacaacattttaaggagtgcttgtagaaaaaaaaggtttggttgtcagatgttggagaaatgctgtgttaaataaacagctatctttactgaatgaagggggccagcccctccacacctgtgggtaattctcgtcaggtgggaccagagactgagaaaagaaakaagacacagagacaaaagtatagagaaagaaaagtgggcccaggggaccagtgctcagcatatggaggacccgcaccaacactggtctctgagtttcctcagtatttattactgttttcactatctcagcaagaggaatgcggcaggagagcagggtgatagtggggagaaggtcagcaagaaaacatgtgaggaaaggaatctgtgtcacaaataagttcaagggaaggtactatgcctggatgtgcacataggccagatttatgcttctctccacccaaacatctcagtggagtaaag

SEQ ID NO: 139974 - DNA, 601 bp, Human
actgacagttacccatggctggggaggcctcaggaaacttacagtcatggcagaaggcacctcttcacagggcagcaggagagagaatgagtgccagcaggagaaatgccagatgcttacaaaaccatcagatctcatgagaactatcacgagaacagcatggaggaaaccacccgcatgattcagttgcctcccaccaggtccttccaatgacatgtggggattatggggtttacaattcaagatgagatttgggtgaggacaatgccaaaccatatcactcccttacttgatttctttyctggtcctatctcaaacccttctggttttctatcttaaatctttcttttcgctgtatttttcttcatctccttcttccataagaaaaatagaggcattccgaattaaaagtgagactgatttttgcctatcaaagtgacaaggatttagaaaaagtataatgatcattgttggcagggatgtgataaaatatacattttcccactgcttattggaacatcaaatggtaaccactgccagacagcttctaatgcagtgtgtatcaagtccctttgaaatgttcttatcttttgaacagcta

SEQ ID NO: 139975 - DNA, 601 bp, Human
gttagtgatgaggaatccggcgaagatactgccgattgctaggtgctgaactgagttaattcggagaggattatcattaataacaatcagaattgtaaaacaaggttgtcctattacagcacctaaggttataaagtaagcacaagtaaatacataaaaacgttaggtcaacgtgtagctcatgaggtggcaagaaatgggccacattttctaccccagaaaatctcacgacaacctttatgaaatctaagggctcaaggaggatttagcagtaaaccaagagtagagtgcttggttgagkttgaataaggccacgaagcacgcacacactgcctgtcaccctccgcaaatatcattctagaaatattatttaaattctctatacatgaatagaggagataagtcgtaatatggtaagtgtactggaaagtgctcttggacaaacaaagtgtcgcttaacccaaagcatccagcttacacccggaagatttcatcacaacctggtcactttgagccaaccctagccccaaacctcactaaaaatactattaaaccatcgtaatcaaaccatttaccttagacaaaagaataggcaatagaa

SEQ ID NO: 139976 - DNA, 601 bp, Human
acattttctaccccagaaaatctcacgacaacctttatgaaatctaagggctcaaggaggatttagcagtaaaccaagagtagagtgcttggttgaggttgaataaggccacgaagcacgcacacactgcctgtcaccctccgcaaatatcattctagaaatattatttaaattctctatacatgaatagaggagataagtcgtaatatggtaagtgtactggaaagtgctcttggacaaacaaagtgtcgcttaacccaaagcatccagcttacacccggaagatttcatcacaacctgrtcactttgagccaaccctagccccaaacctcactaaaaatactattaaaccatcgtaatcaaaccatttaccttagacaaaagaataggcaatagaaattcttatcttggcacaatagatacagtaccgtaagggaaagatgaaagaactgagcaaagacaagcccttataccttctgcataaagtattaagtagaaataactttacacagagatagccaagtcccccgaaaccaaatgagctatgcaagaatggctgaaagagcgtactcacctacgtggcaaaatagtgggaagattc

SEQ ID NO: 139977 - DNA, 601 bp, Human
actaaaaatactattaaaccatcgtaatcaaaccatttaccttagacaaaagaataggcaatagaaattcttatcttggcacaatagatacagtaccgtaagggaaagatgaaagaactgagcaaagacaagcccttataccttctgcataaagtattaagtagaaataactttacacagagatagccaagtcccccgaaaccaaatgagctatgcaagaatggctgaaagagcgtactcacctacgtggcaaaatagtgggaagattcatgagtagtggtgataagcctatcaagcctgytgatagctggttgtccaagatagaatcttagttcagctttaaacttacccacagaattacttaatgtccctgtaagtttaactgttaatctaaagagggacagctctttagaccctaggaaccaaccttcctacagagagtacaaaataacatcgccatagttggcccaaaagcagccaacaattaagaaagtgttcaagctcaacatccaagtatcttaaattctaatcactctacggaactcctaacattacactggtctaatctattatttaatagaagcaataatgttaatataaa

SEQ ID NO: 139978 - DNA, 601 bp, Human
attcttatcttggcacaatagatacagtaccgtaagggaaagatgaaagaactgagcaaagacaagcccttataccttctgcataaagtattaagtagaaataactttacacagagatagccaagtcccccgaaaccaaatgagctatgcaagaatggctgaaagagcgtactcacctacgtggcaaaatagtgggaagattcatgagtagtggtgataagcctatcaagcctgctgatagctggttgtccaagatagaatcttagttcagctttaaacttacccacagaattacttaatstccctgtaagtttaactgttaatctaaagagggacagctctttagaccctaggaaccaaccttcctacagagagtacaaaataacatcgccatagttggcccaaaagcagccaacaattaagaaagtgttcaagctcaacatccaagtatcttaaattctaatcactctacggaactcctaacattacactggtctaatctattatttaatagaagcaataatgttaatataaataacatgaaaatattctccaccgcataagcttacataagactggaataacccactgactgacagtt

SEQ ID NO: 139979 - DNA, 601 bp, Human
attaagtagaaataactttacacagagatagccaagtcccccgaaaccaaatgagctatgcaagaatggctgaaagagcgtactcacctacgtggcaaaatagtgggaagattcatgagtagtggtgataagcctatcaagcctgctgatagctggttgtccaagatagaatcttagttcagctttaaacttacccacagaattacttaatgtccctgtaagtttaactgttaatctaaagagggacagctctttagaccctaggaaccaaccttcctacagagagtacaaaataacatcrccatagttggcccaaaagcagccaacaattaagaaagtgttcaagctcaacatccaagtatcttaaattctaatcactctacggaactcctaacattacactggtctaatctattatttaatagaagcaataatgttaatataaataacatgaaaatattctccaccgcataagcttacataagactggaataacccactgactgacagttaacagctagatattttacaataagcatcctattatttatactgttaatccaacacaggcatgctctaaggaaatattacaaaaagtaaa

SEQ ID NO: 139980 - DNA, 601 bp, Human
agctcaacttattatctctcttactattttcacaggaaccctcatcacaatgctacgctcacactgatttcttatctgaacaggcctaggaataaatatagtagttcttacccccatcttgattaaaaaaacaaatctccactctacagaagcagccaccaaatattttcttacacaagcaactgcatctataattctcatgatgggtatccttttcaacaacccgtcctccgggcaatggacaataataaacactactaatcaattttcatccttaataataacagccctagtaataaarctagaaatagccccctttcacttccgagtcccagaagtaacccagggaacttctctaatgtctggcatacttctcctcacatgacaaaaactagcccctatctcaattatatttcaaattttcccatcaataaacacgaccagtctcctatctatcacaatcctatccattaacgtaagcggttgaggaggacttaatcaaacacaattctgcaaaatcttaacctactcctcaattactcatataggttgaatgatcccagtactaacttataatccaaacgttaccattataaatctg

SEQ ID NO: 139981 - DNA, 601 bp, Human
gaaatagccccctttcacttccgagtcccagaagtaacccagggaacttctctaatgtctggcatacttctcctcacatgacaaaaactagcccctatctcaattatatttcaaattttcccatcaataaacacgaccagtctcctatctatcacaatcctatccattaacgtaagcggttgaggaggacttaatcaaacacaattctgcaaaatcttaacctactcctcaattactcatataggttgaatgatcccagtactaacttataatccaaacgttaccattataaatctgattrtttaccttattttaacaactaccacatttctagcacttagcctaagtataagcactacaaccctgtcactgtctcacacttgaaacaaattaacatgattaacacctatagtttcactaattctactatccctaggagctttacctccattaacaggatttctgcctgaatgagtcatcattcaagaattttcaaaaaacaatagtcttattaccccaaccattatagctatcataacactactcaacctgtagttttatatatgcctaatttactccatctcaatgacaatattcccca

SEQ ID NO: 139982 - DNA, 601 bp, Human
cctggttcatctcatcgggactggttggacagggggtgcagcccacagagggcaagttgaagcagggcggggcatcacctcacccaggaagcacaaggggtcaggggatttccctttcccagccaagggaagccatgacagactgtacctggaaaatcaggacacttttgcccaaatactgtgcttttccaacagtcttaccaaatggcacaccaggagattatatcccatgtctggcttggcaggtcccacacccacggagccctgctcactgctagcacagcagcctaagatccacccrtgaggcagcagcctggcaggcggaggggcgtccgccattgctgaggcttgagtaggtaaacaaagtggccagggaagctcgaactgggtggagcccaccacagctctgcaaggcctgctgcctttgtagaccacacctctgggggcagggcatagctgaaaaggcagcagaaacttctgcagacttaaacgtccctgtctgacagctctgaagagagcagtgtttctaccagcatggtgtttgagctctgacaatggacagactgcctcaggtggatccctgatgcttctgtagcctaag

SEQ ID NO: 139983 - DNA, 601 bp, Human
agaccatcgatgataggaagaaacagcatcaactaacgggcaaaataaccagctaacatcataataacaggttcaaattcacacataacaatattaaccttaaatgtaaatgggatgaatgccccaattaaaaaacacaaactggcaaattggataaagattgaagacccatcactgtgctgtattcaggagaccaatctcatgtgcagagaaacacatgggctcaaaataaagggatggaggaagatctaccaagcaaagggaaagcaaaaaaaaaaaaaaaaaaaaaaaaaaaaaaaaagcaggagttgcaatcccggtctctgaaaaaaaagactttaagccaacaaagatcaaaagagacaaaaaaggccattacataatggtaaaaggatcaactgggcaagaagagctaactatactaaatatataggtacccaatacagcagcaccaagattcataaagcaagtccttagagacctataaagagacttagactcccacacaataataatgggagactttaacacctctctgtcaataatagacagatcaatgagacagaaggttaacaaggatatccaggacatgaactcagct

SEQ ID NO: 139984 - DNA, 601 bp, Human
ttgacactttgtagatgtagtatgactattcttatatgtctctatctactgatgaggatcctactcttttagtataaagagtaccattgacttccaatcaactagtttcgataatatctgaaagatattaaataacctgacactagccttagtaaccgacaccttactggccctactactactactaattacatttttacttccacaaattaatatttatatagataaatccagcccctatgaaggcagatttgacccaataacctccaactgcctccccttttccataaaattcttcctrgtagccaacacatttctcctcttagacttagaaatcgctctaatactacccctgccatgagctattcaaacaaattacctaacaacaataatcaccacagcccttatactagttatcattttaatcctaggcttaatttacaaaagaactcaaaaagggttagattgaattgaattggtaaatagtttaagtcaaaagaaatgatttcgattcattagattataataaaccatatttaccaaatgccctctatttacatcaacattatattaccatataccatatcactactggtaaaat

SEQ ID NO: 139985 - DNA, 601 bp, Human
caagaactgttagcctccttatccaataatcttatatgactagcatgtattatggcctttatagtaaaaataactctattcggacttcacctgtgactcccaaaagcccatgtagaagcccctattgccggctcaacagtacttgcagcggtactcctaaaactaggcggctgcggtataatacggcttacccttatcctcagccccctaacagaatatatagcctaccccttcctcacactatccctatgagggatagttatgacaagctccatttgtctacaaaccgatgtaaaatcasttattgcctactcctctgtaagccatataccacttgtcatcatagctctcctaatccaaaccccttgaagctttacaggtgccgtcacccttataattacccatggagtcacttcatccctgttattctgcctagcaaattccaactacgagtgagtccaaaacggaatcatatacttacctgaggccttcaaatactcctcccactgatatagcctcatgatgacttctagcaaatctcactaatcttgccttacccctaccattaatctagtaagggaactctctgtgatcatggctt

SEQ ID NO: 139986 - DNA, 601 bp, Human
aatatggctttctcaacttttaaaggattggagtcatccgttggccttaggaaccaaaaacattggtgcaactccaaagaaaagtaacaaatatgtatttttccactactataatagccctaatcgccttaatcacaccaattattacgttagtcaacccctgcaaaagaagattcatacccaaattacataaaaatagccatcacatgcgccttcaccattagcctcatcccaacgtttatatatacagaccaagaagtcattatctcaaactgacattgaatgacaatcccaactcttraactctcactaagctttagactacttctccataatatttattctagtagcactatttgttacctgtagaattctcaatatgatatataaactcagaccctaacattaatcaatttttcaaatattttcctcatcacagtattcttccaatattccaccaacaaactctttcaactctttatcggatgagaaggtataggaatcatgtctttcttactaactggctgacaatatggccgagcagatgctaatacagcagccctccaagcagtcctgcacaatcgcatcggcgacattggtt

SEQ ID NO: 139987 - DNA, 601 bp, Human
ataaacagtgcctgctcagaaaacaaacaaacaaacaaacaaacataaaaaccctagaggaaaacctaggcaataccattcaggacataggcatgggcaaggacttcatgactaaaacaccaaaagcaatggcaacaaaagccaaaatagacagatgggatctaattaaactaaacagctgcatagcaaaagaaactgatcagagtgaacaggctacctacagaatgggaaaaattttttgcaatctagccacctgacaaaaggctaatatcaagaatctacaaagaacttaaacaagttyacaagaaaaaaacaaccccatcaaaaagtgggtaaaggatatgaacagacacttctcaaaagaagacatttatgtggccaacaaacatatgaaaaaaagctcatcatcactggtcatcagagaaatgcaaatcaaaaccagagtgaggtaccatctcatgccagttagaatggcgatcattaaaaagtcaggcaacaacagatgctgaagaggatgtggaaaaacaggaatgcttttacattgttgatgggagtgtaaattagttcaaccattgtggaagacagtgtggcaattcctcca

SEQ ID NO: 139988 - DNA, 601 bp, Human
ggtatatacccaaaggattataaatcattctactataaagacacatgcacatgtatgtttattgtggcacttttcacaatagcaaagacttggaaccaacccaaatgcccatcaatgatagactggataaagaaaatgtgacacatatacaccatggaatactatgcagccataaacaaggatgagttcatgtcctttgcagggacaaagatgaagctagaaaccataattctcagcaaacacaggaacagaaaaccatacaccacttgttctcgctgataagtgggagttgaacaatgasaacatatggacacagggaggggaacatcacacaccagggcctgttgttgggtggagggctaggggagggatagctttaagagaaatacctaatgtagttgatgggttgatgggtgcagcaaaccaccatgacacgtgtatacctacgttaacaaacctgcaccttctgcacatgtatcccaaaacttaaagtataataaaatttaaaaaaaaaacagtgaacatttattgtaggcttacattgggctaaatgcattttatggataatctcatttaatcctcataacaacccttggagaac

SEQ ID NO: 139989 - DNA, 601 bp, Human
aaaaaacagtgaacatttattgtaggcttacattgggctaaatgcattttatggataatctcatttaatcctcataacaacccttggagaacatgtatgattattatctctattttaagcatggagaactgaatagcttacccaaggtggcatgactagtaaatcactggaccaggatttaaacccaaaaagtctgatcccagagttcatgcttataagccttcctaaccatgataatgctttaatctggcattaattgttctctaatttgggtaggtttgaaatttttcataataaataytaaaaatactttttgaggaaatgtcgtcatgataaacattagaactgcgttcatctaattacttttagggtatgagtgaaactaaaaagtaagactcatctaaaaataatcatctgttttggccatatccccagtgatacatgaatttaattgtttttattgttttcagaatgaaaaattaaagaggttaaataaaattagctggcaatcaaaaaatattagttatatgaagattcagagatttggttatacttaatgaatacaagctaataaatatttattaagactctactgtgctcc

SEQ ID NO: 139990 - DNA, 601 bp, Human
tggcattaattgttctctaatttgggtaggtttgaaatttttcataataaatattaaaaatactttttgaggaaatgtcgtcatgataaacattagaactgcgttcatctaattacttttagggtatgagtgaaactaaaaagtaagactcatctaaaaataatcatctgttttggccatatccccagtgatacatgaatttaattgtttttattgttttcagaatgaaaaattaaagaggttaaataaaattagctggcaatcaaaaaatattagttatatgaagattcagagatttggktatacttaatgaatacaagctaataaatatttattaagactctactgtgctccaaatactatacagggaggtagggatatgaagataggcttagcatcagaaaaggactgtcccttagtagaaaggctgaactaaaaggaaaagtttgacgtgataggcaaattcaactgacaggtccactacccatagtcccttcaagagctcataattaggaaaagtcatatgtataatatggcactttcaataattaagtgcaataagtgtaagtgcaataattaaggtactgggaaaacataacag

SEQ ID NO: 139991 - DNA, 601 bp, Human
agtaaggtatatggtacatggcatggtcattccttcagtaaatgtgttagggggaggtatgaagtgaattctgactttggggaataattagaagcaacttgtatgaaaatcagaaataacttatttttcctcatgatcaaaattttcatatgtacttaatgaacacaaaaaatatatactgctaaaagcaaatcaggcagttagcatatagttttatttttatatttgcaagtagaaaataaatattttatacaatgaaatgaagttcattaaattttatgtaaatattttagaatatgarttgataaaataagtttgagctaacttattgaataataaacactgtcttagtccctttatgctgctataacagaatacctgaaaatggataatttataaagaacagaaatttatttctcacacttctagaggttaggagtccatgaaaaaagtgctggcaggttcaggcgtctggtgagagctgctctcttctttccaagatggagccttgctgcttcctccttcagagaggaggaacaccatgtcctcacatggacaaaagtggaagggcgagaggggccaaatgctgcatgaagcctct

SEQ ID NO: 139992 - DNA, 601 bp, Human
tttatatttgcaagtagaaaataaatattttatacaatgaaatgaagttcattaaattttatgtaaatattttagaatatgaattgataaaataagtttgagctaacttattgaataataaacactgtcttagtccctttatgctgctataacagaatacctgaaaatggataatttataaagaacagaaatttatttctcacacttctagaggttaggagtccatgaaaaaagtgctggcaggttcaggcgtctggtgagagctgctctcttctttccaagatggagccttgctgcttcmtccttcagagaggaggaacaccatgtcctcacatggacaaaagtggaagggcgagaggggccaaatgctgcatgaagcctctcataagggccttaatcctattcatgagggagaagccctcatggcgtaatcatctcttaaaggccccacctgttaataccatcacattaacaacacctgaattttggaggagacacatagcaaacactaaatctgaagtctgaaagaactcaatttttattcacaggattttgcccatgatatcatttttttaaaaactcaatttcatttaaaagaaac

SEQ ID NO: 139993 - DNA, 601 bp, Human
aatttgtaaagactaaatgtaaaaagaatatagcattaggatgtttaattacgtagtatggactgccagtactataggaattcagtggcctgagggcaataagacctggagtaggcagggaaggatttgtggagattaggaaacttaaatgggattttgaaggagagattaaatctatgtaattcacatttttaatatcagtctaaaacacatctctgtagctgtctctataataaagataaacttagcaatggaaccatgatactcacagtccactaggccaaaacgttcccttggatastgttaatgcttgagtgaacaatgacaccattgctgtgactttttcctttctgtattccttagtcacccctcttctggttaacaggttctttcttttatagctttaagtcttgccttggaaccaatttttttctccagcatatttatatggattcatttaaagcttaacttgcaaagagcagcttattttcacttcttagaaggtactctgcagttaaccttggtgctgtctacagagacaaaaataaatttctttggattttagttatctttctatgtcagagattcccaagaccatccc

SEQ ID NO: 139994 - DNA, 601 bp, Human
aagttaaaataaaccttccaaagtaatttttctcttggtcatcatagaattttttttaatatggaaaagtatgaaaaaataaaaatcatctctaatgcaattactcagagaagaccacctcaatattgtggtatgttacctttcaggcttcattttgtgtataaaagtatatacaaagaagtatataaaacttttataacttttataaaagttcacttatataaatatatattattttataaaattaaggtcatactgtgcagtttgctctccttctgtttcatgaagtattacagcatgrgtaatttactgtattagaaaaatgtactgcaaatatgttttctaattgctgagtagcattccatcataaggctatatatgtctgaacaatcattttccattcttcagtcttttaagtaacacttcagtgaacatagtgaacatcctcatgcataaatatttatatttatctctgataattatcttagaataaaagtataagtaaaagttatgaactattttaaaatttttttaatttcaaaatgctttctagaaaagctgtgccaaattatatctcaacagcaatgcatagggatgtaca

SEQ ID NO: 139995 - DNA, 601 bp, Human
tgttacctttcaggcttcattttgtgtataaaagtatatacaaagaagtatataaaacttttataacttttataaaagttcacttatataaatatatattattttataaaattaaggtcatactgtgcagtttgctctccttctgtttcatgaagtattacagcatgggtaatttactgtattagaaaaatgtactgcaaatatgttttctaattgctgagtagcattccatcataaggctatatatgtctgaacaatcattttccattcttcagtcttttaagtaacacttcagtgaacrtagtgaacatcctcatgcataaatatttatatttatctctgataattatcttagaataaaagtataagtaaaagttatgaactattttaaaatttttttaatttcaaaatgctttctagaaaagctgtgccaaattatatctcaacagcaatgcatagggatgtacatttcatcatttgccactattggttattatatttttatgtacttttgccaagttgataggggagaagttatatatattttaatttccatttcttttcttaatgtggttgactatatatttgttgggtgtttagg

SEQ ID NO: 139996 - DNA, 601 bp, Human
tccattcttcagtcttttaagtaacacttcagtgaacatagtgaacatcctcatgcataaatatttatatttatctctgataattatcttagaataaaagtataagtaaaagttatgaactattttaaaatttttttaatttcaaaatgctttctagaaaagctgtgccaaattatatctcaacagcaatgcatagggatgtacatttcatcatttgccactattggttattatatttttatgtacttttgccaagttgataggggagaagttatatatattttaatttccatttcttttmttaatgtggttgactatatatttgttgggtgtttagggtgggtatgtatatatgtgaattatctcttctgtgctttgcctatctttatatttgtaattttttttcccaatttataagagctgtctatattgaaaataagtaaatgatgtttaagtattttcctagcttataattcagattttaattttataaactttgacatatgaaagttttctttgttgtatttatgcttattcattcattttttcttatattctcttttatattcaactttttatttcaattgaaatgtaatatgat

SEQ ID NO: 139997 - DNA, 601 bp, Human
aaagtttcatagcaaaccataagcttccctttaatgtctgggggtttccatagtcctcgggcacccggttctaagacttgcaaaaattcccaaggtggttgtttctggggctcccaggggcagtgctgactccaggaggtatagttagggacccgatctgccaccaggtttctgaaccctggaggaatacaggggctgagctcagagtcagggccagtgtctggaccaggcccagaggcaggaccaggatgagagccagagccatgaccaggaccagagccaggaccagagccaggaccaggaccagagccagagccagggacagagccacagccaggaccagagccagagccagagccatggccagcacctgagctggaaccaagaacaggcccagagctagagcctggaacagggccaggattagaactatggtcagttgtagtgcaagtgtcctgagcaatacaggaaacatagacgggctcaaagccaagactcccatgggctatattgtgggtaaagccgggtcccgcacagggctccccaagaaggctggggtcagaggacggctccatgaactcagaacagggcgctggggtct

SEQ ID NO: 139998 - DNA, 601 bp, Human
ggccccgcggcaaagtttcatagcaaaccataagcttccctttaatgtctgggggtttccatagtcctcgggcacccggttctaagacttgcaaaaattcccaaggtggttgtttctggggctcccaggggcagtgctgactccaggaggtatagttagggacccgatctgccaccaggtttctgaaccctggaggaatacaggggctgagctcagagtcagggccagtgtctggaccaggcccagaggcaggaccaggatgagagccagagccatgaccaggaccagagccaggaccagagccaggaccaggaccagagccagagccagggacagagccacagccaggaccagagccagagccagagccatggccagcacctgagctggaaccaagaacaggcccagagctagagcctggaacagggccaggattagaactatggtcagttgtagtgcaagtgtcctgagcaatacaggaaacatagacgggctcaaagccaagactcccatgggctatattgtgggtaaagccgggtcccgcacagggctccccaagaaggctggggtcagaggacggctccatgaactcagaacaggg

SEQ ID NO: 139999 - DNA, 601 bp, Human; identical to SEQ ID NO: 94895

SEQ ID NO: 140000 - DNA, 601 bp, Human
tggccaggctggtctcaaattcctgacctcaggtgatccacccacctcagccccccagagtgctgggattataggcatgtgccaccgtgcccggcccaactttcactttttaaatgtagcctgtgattaataacaaacctaatgtcagcaaaataaatgtcaatggtgacagtaatgtaactctctactttaccttgcagattagatttttaaaatcttgttccatatctactactttatatgctgttggcctataaaccagttttaaagattgccattacagctcacaaaacagtttacrtggaatcacattattatactcatacaatatgtatttataagtggcatttgtttgaatgtaacaactaataacaaacagtaatattatttatagctaccatttatcaatcatctactaagcggcatcattgtgatggatgctctatatcatgatctccattcctcacaataatttacaatataagttttcactacattatataatgaggaaactgaggctcagagatgctaagtgactactctaaggccacataaaaactaagcagcagaacaggaatttgaagctgggcccatatggcta

SEQ ID NO: 140001 - DNA, 601 bp, Human
ttggaacatagggcttatttacaaagatatactctaaggctacaactatgacttttgctttttaataatcatcataatcccttatattaataagtacttatggcttactgcttccaacattcataatctgagtattccaacaattctataagaaaagcattaaaaataaaaatgagccaggcgcggtggctcatgcctgtaatctcagcactttgggaggccgaggtgggcggattatgaggtcaggagtttgagaccagcctgaccaacatagtgaaaccccgtctctactaaaaatacaaaaaaaaattagccaggtgtggtggtgtgcgcctgtaaccccagctactcaggaggctgaggcaggagaatcgcttgaacccgggaagtggaggttgcagtgagccgagactgagccactgcactacaggctaggcaacagagtaagactccatctcaaaaaaaaaaaaaaaatgaccattttgccaatgtagtaaaaaatttcagaaaatcaggccaggcacggtggctcacgcttgtaatcccagcactttgggaggctgaggtgggcggatcacctgaggtcaggagttcgagacca

SEQ ID NO: 140002 - DNA, 601 bp, Human
ctctgattagcaaaagataatttctaggaagctagagcactgaacaataaaaattttggaacatagggcttatttacaaagatatactctaaggctacaactatgacttttgctttttaataatcatcataatcccttatattaataagtacttatggcttactgcttccaacattcataatctgagtattccaacaattctataagaaaagcattaaaaataaaaatgagccaggcgcggtggctcatgcctgtaatctcagcactttgggaggccgaggtgggcggattatgaggtcargagtttgagaccagcctgaccaacatagtgaaaccccgtctctactaaaaatacaaaaaaaaattagccaggtgtggtggtgtgcgcctgtaaccccagctactcaggaggctgaggcaggagaatcgcttgaacccgggaagtggaggttgcagtgagccgagactgagccactgcactacaggctaggcaacagagtaagactccatctcaaaaaaaaaaaaaaaatgaccattttgccaatgtagtaaaaaatttcagaaaatcaggccaggcacggtggctcacgcttgtaatccc

SEQ ID NO: 140003 - DNA, 601 bp, Human
gttcattaattttataattcaatagatctgcctcttagaaatgaaaggtcctaaatagattattagtcctaatttgtcccctaggtagtactcttactataaattaaccaactgacattctgtttgtaaacttggatttttttacctctgattagcaaaagataatttctaggaagctagagcactgaacaataaaaattttggaacatagggcttatttacaaagatatactctaaggctacaactatgacttttgctttttaataatcatcataatcccttatattaataagtacttayggcttactgcttccaacattcataatctgagtattccaacaattctataagaaaagcattaaaaataaaaatgagccaggcgcggtggctcatgcctgtaatctcagcactttgggaggccgaggtgggcggattatgaggtcaggagtttgagaccagcctgaccaacatagtgaaaccccgtctctactaaaaatacaaaaaaaaattagccaggtgtggtggtgtgcgcctgtaaccccagctactcaggaggctgaggcaggagaatcgcttgaacccgggaagtggaggttgcag

SEQ ID NO: 140004 - DNA, 601 bp, Human
catcttgctgcttgttattgacctgttcagggtatgtaattcttcctgatttaagctagtagggttgtatttttccaggaatttgtccatctcttctaggttttctagtttatgtgtgtcaaggtgttcatagtagccttgaatgatcttttgtatttcagtagtgtcagttgtaatatctcctgtttcatttcttagtgaggttatttggattttctcccttcttttcttggttaatcttgccaatggtctaacagttttatttatcttttcaaagaaccagctttttgtttcatttacttttttttttttttaagacagagtctcactctgtcgcccaggttggagtgcagtggcacgatcttggctcactacaacctccaccttgtgggttcaagcaattctcctgcctcagcctcctgagtagctgggactacaggcctatgccactacgcctagctaatctttgtattttttagtagagatggggtttcaccatgttggccaggatggtctctatctcctgaccttgtgatctgcccgcctcggcctcccaaagtgctgggattacaggcgcgagccactgtgcccagcaacagtt

SEQ ID NO: 140005 - DNA, 601 bp, Human
ttgaaatcaggtagtgtgatgcctccagatttgttctttttgcttactcttgctttggctatatgggctcttttttggttccacatgaattttagaattatttttttaattctgtgaagaataatggtggtattttgatggggattgcattgaatctgtagattgcttttggcagtatggtcattctcgcaatatcaactctacccatccatgagtatgggatgtgtttcgcagtatcagctctacccatccatgagcatgggatgtgtttccatttgttcatgttgtctatgatttcttkctttctatctttctttctttttctctcttttttttttctttttgatgtagtctcactcttgttgctcaggctgcagtgcaatggtgcgatctcggctcactgcaacttccgcctcccaggttcaagcgattctcctgcctcggcctcccaagtatctgggactacaggtgcacatcaccatgcccagctaatttttgtatttttagtagagtcagggtttcaccatgttggccaggctagtctcaaactcctgaactcaaatgatctgcccgccttggcctcccaaattgctgggattac

SEQ ID NO: 140006 - DNA, 601 bp, Human
tgtatcattcttaggcctttgcatcctcatagcttagcttccacatatcagtgagagcatacaatgtttggttttccattcctgagttacttcacttagaataatagtgtccagtctcatctaggtcactgcaaatgctgttaattcattcctttttatggctgcatagtattccatcatagatacagatatagatgtagatatatagatgtagatatatatagatacacacacacacatagatatatagatgtagatataaatagatatatatagatacacacacacacacacacacacttatatatacacaccaccgtttctttatccaatcattgattaatgggcatttggttggttccatgactttgcaattgtgaattgtgctgctataaacatgcgtgtgcaagtatctttttcaaataatgacttcttttcctctgggtagatacccagtagtggaattgctggatcaaatggtagttttccatagcggctgtactagtttacattcacaccagcagtgtagaagtgttcctgatcaccacatccacgccagcatctactgttttttgattttttgattatggccattcttaca

SEQ ID NO: 140007 - DNA, 601 bp, Human
ttgcatatcagggcattttgaggctgaacaagcattaaacatatttcctagaatgcacaggagctttcctgtactatcacctaccagattcaacaagtggcaagtgtttctaactctgttaaaggactaggagagtttcgctcatccctaggctgggatcccaaggacggttcctcagcaaaaatttaaaaggtaaaaagtttagattgacagtgctatgtcaaacaacgcaaggtatttaccaatagggcctatattatcccataaaactgaaagtgagctccacttacttttttttttaattaagtttatttatttttccataagttattggggtattaggtggtatttggttacatgagttagttctttggtggtgatttgtgagattttggtgcacccatcacctgagcagtatactctgtaccatatttgtagtcttctatccctcgccccctcctactcttccccccaagtccccaaagtccactgtatcattcttaggcctttgcatcctcatagcttagcttccacatatcagtgagagcatacaatgtttggttttccattcctgagttacttcacttagaataatagtgtc

SEQ ID NO: 140008 - DNA, 601 bp, Human
taaatggactcagggtctaattccctggagaaggcctggccacttctctctatatacagtcttgccagagcatcatctgtaattattgtacaggttgagcatcccttattcgacatggttgggaccagaaatattttgggtttcaagtttttttggattttgaaatatttgttattctgtaatacttaccagatcagcatccccaatctgaacatccaaaatccaactgctccaataaacgcttcctttgagcgtcatattggtgctcaaaaagtttgagattttggagcatttcagattycagattttttgattagggatactcaaactgtagtacatggcacaccagaaggcaccactactattccaagattcaggtttcgattcagttgaaagcccctctttggcttaaggcttcgataatccattttccggagggagtcctgtactggggaacagggcactaagccagataatgataaagtgatgccttgattcttattttcctattgttccctgtgtatagcttatcaaaaaccctgtggagggtagaggcaagtggcagccatgacttagatatacctgggaccctttactttca

SEQ ID NO: 140009 - DNA, 601 bp, Human
taaaaaccacttaggctgggcgcggtggctcacgcctgtaatcccagcactttgggaggccgaggtgggcggatcacgaggtcaggagattgagaccatcctggctaacaaagtgaaaccccgtctctactaaaaaatacaaaaaattagccgggcttggtggctgacgcctgtagtcccagctacttgggagcctgaggcaggagaatggcgtgaacctgggaggcggagcttgcagtgagccgagatcacgctactgcaccccagcctgggcgacagagcgagactccatctcaaaaamaaaaaagaaagaaccacttagtgctaattgatattacaaagacaataaaatgtaagtagagatctaaaatatttggtaatcactgtgtgctatttatcgactatagattttaggcttcaactggttattaacctcattcactcacttgttcacaaaatatatgctcagtactgatatatgcataccttataacaactcacgtatgtataaagcctagtcagttgaagtatgagcaaaggtaaatacctgtttctcttccaatctgacgtgttcccaggttgatcacaggtgttccaaaag

SEQ ID NO: 140010 - DNA, 601 bp, Human
tcttcccttctcattcccagcatatcactgcccaatcagaaatctaggcttccttgttgattcctttcacctccgcatccaagcatcagcaagtactataacaagacccaaatctaacttttttccatctctaatacttcatcaaagccactatcatctctcatctgagcaactgaatcagcccccttactggtctccctgcttttattcttgcccccccgccccccccaccgacattccattctgtatattagcaaccggagtgatctttccaaaatgcaactcttgtcatgtcattccytcccattacacttagaaaaaattccaaatgacttaccctggcttacatgcatctgtttccttctctaacatcacctgtatcactctgcctcttgctcactactctacagccacaatagcgcttccatttctcaaatacaccaagttcacctcccggccctcacactggctgttgccactgcctctccctgatcctcacatagctgactccttgtcattcagatttcagcttaggtgtcatctccttaaagaggccttcctttaaccaatctaatggagtccatcatataccttgtgttac

SEQ ID NO: 140011 - DNA, 601 bp, Human
aggagattagttctagctctgctctttctccaattcttcataattgccacctttctgttatatttacatcttcttcccttctcattcccagcatatcactgcccaatcagaaatctaggcttccttgttgattcctttcacctccgcatccaagcatcagcaagtactataacaagacccaaatctaacttttttccatctctaatacttcatcaaagccactatcatctctcatctgagcaactgaatcagcccccttactggtctccctgcttttattcttgcccccccgccccccccmccgacattccattctgtatattagcaaccggagtgatctttccaaaatgcaactcttgtcatgtcattccttcccattacacttagaaaaaattccaaatgacttaccctggcttacatgcatctgtttccttctctaacatcacctgtatcactctgcctcttgctcactactctacagccacaatagcgcttccatttctcaaatacaccaagttcacctcccggccctcacactggctgttgccactgcctctccctgatcctcacatagctgactccttgtcattcagatttcagc

SEQ ID NO: 140012 - DNA, 601 bp, Human
aaggagattagttctagctctgctctttctccaattcttcataattgccacctttctgttatatttacatcttcttcccttctcattcccagcatatcactgcccaatcagaaatctaggcttccttgttgattcctttcacctccgcatccaagcatcagcaagtactataacaagacccaaatctaacttttttccatctctaatacttcatcaaagccactatcatctctcatctgagcaactgaatcagcccccttactggtctccctgcttttattcttgcccccccgcccccccyaccgacattccattctgtatattagcaaccggagtgatctttccaaaatgcaactcttgtcatgtcattccttcccattacacttagaaaaaattccaaatgacttaccctggcttacatgcatctgtttccttctctaacatcacctgtatcactctgcctcttgctcactactctacagccacaatagcgcttccatttctcaaatacaccaagttcacctcccggccctcacactggctgttgccactgcctctccctgatcctcacatagctgactccttgtcattcagatttcag

SEQ ID NO: 140013 - DNA, 601 bp, Human
ctggactagaaccaaggagattagttctagctctgctctttctccaattcttcataattgccacctttctgttatatttacatcttcttcccttctcattcccagcatatcactgcccaatcagaaatctaggcttccttgttgattcctttcacctccgcatccaagcatcagcaagtactataacaagacccaaatctaacttttttccatctctaatacttcatcaaagccactatcatctctcatctgagcaactgaatcagcccccttactggtctccctgcttttattcttgccsccccgccccccccaccgacattccattctgtatattagcaaccggagtgatctttccaaaatgcaactcttgtcatgtcattccttcccattacacttagaaaaaattccaaatgacttaccctggcttacatgcatctgtttccttctctaacatcacctgtatcactctgcctcttgctcactactctacagccacaatagcgcttccatttctcaaatacaccaagttcacctcccggccctcacactggctgttgccactgcctctccctgatcctcacatagctgactccttgtc

SEQ ID NO: 140014 - DNA, 601 bp, Human
gggcacaatggctcacatccataattccaggactttgtgaggccaaggtaggaaggatcacttgagaccaggagtttaagacaagcctggacaacaaagcaagaccctgtctctacaaaacattttgtaaaaacattagccaggcatggctgaggaggctaaagtgagaggataacttgagcccaggaattcaaggttacgatgagctatgaatacaccactgcactccagcctgagcaacagaacagtatcatttcagacaaaaacaaaacaaacaaacaaacaaaaaagactatattcytcagcttgccttgcagccagatgtggccatgtgactaagttctgatggatgtgagaagaaagatttgcaactttcaggtcttgcctttaaagtgaaaggcatcttctcttttccttcttccaaaggctaaaacagagacttgcaagcaatagctagagcaaccactaagaaaatagatgggggctaagtctgatgattgtggagctgccatccactgagaaagaaagaacatttaacttatttcagccactattatttagggtctctgttatagcagccaaactgacaaccaattatgca

SEQ ID NO: 140015 - DNA, 601 bp, Human
agcaatcatcccaccttggcctcccaaagcactgggattataggtgttgagccaccacacctggcctgggttttaaatactatctatggctggtgccattatcttcaatatcttttcttcatactagaaacagaatttttagccaggcatctgatccccagccaaagattatattctggctggtgtttacaactaattgatcacaaccagttcctcctcccccagcactgcttcactaaaaaaaaaaaaaaaaaagaaagaaagagagagagagaaagagaaagaaagaaagacaaagaargaaggaaggaaggaaaagaaagaaggaaagaaaacaaacaaaacacagactgggcacaatggctcacatccataattccaggactttgtgaggccaaggtaggaaggatcacttgagaccaggagtttaagacaagcctggacaacaaagcaagaccctgtctctacaaaacattttgtaaaaacattagccaggcatggctgaggaggctaaagtgagaggataacttgagcccaggaattcaaggttacgatgagctatgaatacaccactgcactccagcctgagcaacagaacagt

SEQ ID NO: 140016 - DNA, 601 bp, Human
gcctcaagcaatcatcccaccttggcctcccaaagcactgggattataggtgttgagccaccacacctggcctgggttttaaatactatctatggctggtgccattatcttcaatatcttttcttcatactagaaacagaatttttagccaggcatctgatccccagccaaagattatattctggctggtgtttacaactaattgatcacaaccagttcctcctcccccagcactgcttcactaaaaaaaaaaaaaaaaaagaaagaaagagagagagagaaagagaaagaaagaaagacgaagaaagaaggaaggaaggaaaagaaagaaggaaagaaaacaaacaaaacacagactgggcacaatggctcacatccataattccaggactttgtgaggccaaggtaggaaggatcacttgagaccaggagtttaagacaagcctggacaacaaagcaagaccctgtctctacaaaacattttgtaaaaacattagccaggcatggctgaggaggctaaagtgagaggataacttgagcccaggaattcaaggttacgatgagctatgaatacaccactgcactccagcctgagcaacag

SEQ ID NO: 140017 - DNA, 601 bp, Human
cagcctcaagcaatcatcccaccttggcctcccaaagcactgggattataggtgttgagccaccacacctggcctgggttttaaatactatctatggctggtgccattatcttcaatatcttttcttcatactagaaacagaatttttagccaggcatctgatccccagccaaagattatattctggctggtgtttacaactaattgatcacaaccagttcctcctcccccagcactgcttcactaaaaaaaaaaaaaaaaaagaaagaaagagagagagagaaagagaaagaaagaaagmcaaagaaagaaggaaggaaggaaaagaaagaaggaaagaaaacaaacaaaacacagactgggcacaatggctcacatccataattccaggactttgtgaggccaaggtaggaaggatcacttgagaccaggagtttaagacaagcctggacaacaaagcaagaccctgtctctacaaaacattttgtaaaaacattagccaggcatggctgaggaggctaaagtgagaggataacttgagcccaggaattcaaggttacgatgagctatgaatacaccactgcactccagcctgagcaac

SEQ ID NO: 140018 - DNA, 601 bp, Human
gagcccaagagtttgagaccagcctgggcaacacagacatagcaactctatctctacaaaaagtaattttaaaaatcatgtttaaagaaataaataggctgggtgcagtggctcatacctgtaatcctagcactttgggaggtcgaggctggcggatcacctgaagtcaggagttcaagatcagcctggccaacacggtgaaaccccatctctactaaaaacacaaaaattagccaggcgttgtgggtgcctgtaatcccagctactcaggaggttgaggcaggagaactgcttgaacccsggaagcggaggttgcagtgagtcgagatcgcaccactgcactccagcctggatgacagagcaagactccgtctcaaaaaaaaaaaaaaaaaaacaaccaacaataacaaaaaagaaataaaataacatctccacaagatatacatacttcagaacatcatgttgtacacaataaatacatacaattttatctgtcaattaaaagttaaaaactataaatcataattatacagaactaaaaaaattttatataaaataatatctagatctcttcagcaacattgtaactaagtgcctgtat

SEQ ID NO: 140019 - DNA, 601 bp, Human
taatgctgcacaaaacatctttcttttcttcttgatttcaatgggaatgcctctagaatttcaccattgaaaaagatgttggcctttcatatggaataaatcatctttctgttaagaaactattcttctattagtttttgttttgttttttgagatggagtctcactctgttgcccaggctggagtgcagtggtgcgatcttggctcactgtaatctccacctcctgggttcaagcgattctcctgcctcagcctcccaagtagctgggattacaggtgcctgccaccatgcccagctaattttttttttttttttgtatttttagtagaaacagggtttcaccatgttgtccaagctggtctgaaactcctgaccttaagtgatctgcccacctggacttcccaaagtgctgggattacaggcgtaagccactgcatccagccttctattagtttttaaaagagtatttataagggaggcctcttggcttttcttgagaaaattatgttttgttttgctttccttatttgacctaatggtattaataaatttcctacaactttacatttaaaatctttgctatttctcatcgtctctgga

SEQ ID NO: 140020 - DNA, 601 bp, Human
taatttacaatcttacctactcccaaaattctgcagttcagttttacagcttctgctgcagcttccacacacatctgtaggattaaattaatcctctcttcataggttttaggattgaactgagtatacttcttaactatttcaccctaaaagagaaaacaacaagttccgtcttactggtcttagctaagcagcatattgtgagtgttgtgatctttttcatgacaaattagacactgctataggatggccccgcagtcttagatgactgcttggggaaggacccactgcctggtctggrccagccctggggtaagctcaagtagttcctgtaatctgtcctaatatggggctgttgaagcaatgacaactccacaggcagcaagatgggcccctctcttttttttttttttgagatggcctctcgctctgttgcccaggctggagcgctatggcgcgatctcagctcactgcaacctccacctcccaggttcaggcgattctccttcctcagcttcccaggtagctgggattacaggtgcctgccaccacgcccggctaatttttgtatttttagtagagatggggtttcaccatgctg

SEQ ID NO: 140021 - DNA, 601 bp, Human
gagcttgcagtgagccgagatcccgccactgcactccagcctgggcgacagagcgagactccgtctcaaaaaaaaaaaaaaaaacatttcaaggtaaaatgtattagtctgtgctgtctagggcaaaggataacagctggggcatccaacacactaaccaaaaagactgggaggaaaagctgggaaatgagaagctctgggaaataagagctttgaatagctctgacaagttcctggaatttagaaggccacaggcatgtctaaggctgggcacatgctcagaaaaggccacatgtggctsaccttcaggctctagtcatgcaggaagtgaaggctaaggcagagttgtaaccacctgaccatgttgaagacatgctccaatatacattctagctcctgaaccaacctccccctacccctcttacctgtgcctgtgataagtgtaacaaagttttccagtccctttccttggccaaatttcctttccgccagggcagcacagttgccatcattgtctacccacacagggagatgcaaagtgtcagaaaggggggtcctaaggtccacagagttccactcttggatcagtttggttgaatgc

SEQ ID NO: 140022 - DNA, 601 bp, Human
aaccccgtctctactaaaaaatacaaaaaattagccgggcgtagtggcgggcacctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaacatttcaaggtaaaatgtattagtctgtgctgtctagggcaaaggataacagctggggcatccaacacactaaccaaaaagactgggaggaaaagctgggaaatragaagctctgggaaataagagctttgaatagctctgacaagttcctggaatttagaaggccacaggcatgtctaaggctgggcacatgctcagaaaaggccacatgtggctcaccttcaggctctagtcatgcaggaagtgaaggctaaggcagagttgtaaccacctgaccatgttgaagacatgctccaatatacattctagctcctgaaccaacctccccctacccctcttacctgtgcctgtgataagtgtaacaaagttttccagtccctttccttggccaaatttcctttccgc

SEQ ID NO: 140023 - DNA, 601 bp, Human
ttttcaaaaaattgtggttgtttgttttgacctgcctgtcacctccctggaggaccacctcaaagggcctgctttcatcttaactaactaggaactatcctagtgctgagggggttacatgaaggatgtttatcaaaaacatttcggccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccgggcgtagtggcgggcrcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaacatttcaaggtaaaatgtattagtctgtgctgtctagggcaaaggataacagctggggcatccaacacactaaccaaaaagactgggaggaaaagctgggaaatgagaagctctgggaaataagagctttgaatagctctgacaagttcctggaatt

SEQ ID NO: 140024 - DNA, 601 bp, Human
tccagcttggtggtgaccttgaacaacagtccacactcccagtactggtgtacagaaacagtactggataccagtacctgacggggcaggacgaacttattttcaaaaaattgtggttgtttgttttgacctgcctgtcacctccctggaggaccacctcaaagggcctgctttcatcttaactaactaggaactatcctagtgctgagggggttacatgaaggatgtttatcaaaaacatttcggccgggcgcggtggctcacgcctgtaatcccagcactttgggaggccgaggcgggyggatcacgaggtcaggagatcgagaccatcccggctaaaacggtgaaaccccgtctctactaaaaaatacaaaaaattagccgggcgtagtggcgggcacctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaacatttcaaggtaaaatgtattagtctgtgctgtctagggcaaaggataacagctgggg

SEQ ID NO: 140025 - DNA, 601 bp, Human
ggaacggaatgagatcatggacataaagtatttagttaagtgctggccacagtaaatgctcagtaagcagcaggtatttctgtggttatctgtagtccttgtcttctgcccgtcaccaactcagatcaatctgcctcctactaatctgctagaatatctggaccctgaaggagaaaaatccccagctgtgcaaactgcaacctagacatcaactggtggtctcctgtctcccctgggccctcacagctctcacccattctctctgactgcgcttttctataccttcaccaccttcccagtycttctacccccactgccaacagacgagcatacttcttacctctctcatagggggcaccaccaggcagtgatcccctacctttttgcttcctgtcccatacacccatcatctcggctcgccatgccctctcgtggaccctctgcctggctttgcagctcatctcttcccacctcttcagaaccctactgtagggctctatacacttctctcctgcactctcggcctccactccccatctcttttccttcagcatatgctcacaaattggttttgggggccaaaaatctacactgtttttat

SEQ ID NO: 140026 - DNA, 601 bp, Human
tcacttctcacttccagtagcagacagtctttgaagtgttcttttctccaaattatcaccctcctcccacattcactccttccttactcatcccagacacaatgctgtgccatctgccagcgccacgcgttctatggcagcgaggcacagtggctgaggaacagacacaggcctggggtcagtgccagctctgccactcccagctgcatgaccccatgcctgtcacctcacctgtacacattcctccttcctagaagatgagaccagtagtgcctcccctggcagggttatttgaggaacrgaatgagatcatggacataaagtatttagttaagtgctggccacagtaaatgctcagtaagcagcaggtatttctgtggttatctgtagtccttgtcttctgcccgtcaccaactcagatcaatctgcctcctactaatctgctagaatatctggaccctgaaggagaaaaatccccagctgtgcaaactgcaacctagacatcaactggtggtctcctgtctcccctgggccctcacagctctcacccattctctctgactgcgcttttctataccttcaccaccttcccagtccttct

SEQ ID NO: 140027 - DNA, 601 bp, Human
gcacctgtccctagggaagcagggtctcttctggggccgggctgggccatatgatatctgaggccaccccctgcagcacagccacctgcagccacatgctcacctgttcttaggatgctctgggccttcgcattgccaagtttcgcagcttggatgagatggagcgcacccacagcctcatcttttggcactgacatcccttccaccaagagcaggtcctctgaacagagtgagaaggaaaagcagtcactaatgagctgtggggaggccaagctcaccactgggcctgtggaaagcaagsccctacatgggaagacggtgttttcttttcacaattgcaaagcttatcgttcacaaacatctctatacactgcccctaaagcctttgctaccctcttgctaattggttgtacataacccagaacctatcttcctggaaaaacctcaagtctgacgacagcctcctacccctctggctccctcacttctcacttccagtagcagacagtctttgaagtgttcttttctccaaattatcaccctcctcccacattcactccttccttactcatcccagacacaatgctgtgccatctgccag

SEQ ID NO: 140028 - DNA, 601 bp, Human
atgtggatatagtgactggccaggactccggagaggatcacaagggagggattcatggtatggaggatgttcacaaccccaagacccaaagctgttccagctatagggagacaaaaattaaaatgagtttctgagagaagccaaaatcaaaataccaaagaggaaggcagaaaagagccagcagcagaaatgttaaagaacatccacggcatgcagtgggaggcagtgttttaaaagcagttcacggttgattcttaatatgagaaaatgatcatgtgacagcctcaagtggaaaaagccrggtgtaccacatgatctccactaggcaaaaaaatgaatagaaagactcgaaggaaatgttaatagttgatacctccaaatgggaaaactaagtgatattttttcttacaactgtcctatatttctctaaatttcctgtaaaatgaaaggagcatttttatagttgtcaaaccaaaccaaccacctgctgaaaaaggcaatgctgccaaataccttgaatgcaattccctttttacctctgagtaattaggaaagaaacctctgaacagacactgcaaagcacctgtccctagggaagcag

SEQ ID NO: 140029 - DNA, 601 bp, Human
cagcctgggtgacagagtgagacccgtctcaaaaaaatagaacacctgtcactagaccaaatactatactggtaaaatttcacagcagagaggaatatttcattaaattcagctgatagggtcaaggatacattaagtcatttacaaatcagatattagtattaaagtttttggtggcctagagtgaattagaatatgttagcattttgaaagtgtttttgaaatgagaggttgtgtggctcagcagcaaaagcacagagggacctgggatcaaaccctctctctagccccatagcttaayagtcaaacacaccaagttctataaaataaaaattaaaacacctacctcatatgttgagataatttaggataatgtatatgaagcacctagttcagagcctggcacacagtaggcacttaataagtggtggcagttagtatttcttccaagttaacaattcatagccagaactttggcttttgtattttgacaccaatgaaaacacgaatcatgtagacagaatcctgattcatggctctgggctctaggtaaaactcaaaactttaatggacaccctagggtgttactcaacacagtatg

SEQ ID NO: 140030 - DNA, 601 bp, Human
tcacttgaacttggggggcagaggttgcattgagccactgcactccagcctgggtgacagagtgagacccgtctcaaaaaaatagaacacctgtcactagaccaaatactatactggtaaaatttcacagcagagaggaatatttcattaaattcagctgatagggtcaaggatacattaagtcatttacaaatcagatattagtattaaagtttttggtggcctagagtgaattagaatatgttagcattttgaaagtgtttttgaaatgagaggttgtgtggctcagcagcaaaagcasagagggacctgggatcaaaccctctctctagccccatagcttaacagtcaaacacaccaagttctataaaataaaaattaaaacacctacctcatatgttgagataatttaggataatgtatatgaagcacctagttcagagcctggcacacagtaggcacttaataagtggtggcagttagtatttcttccaagttaacaattcatagccagaactttggcttttgtattttgacaccaatgaaaacacgaatcatgtagacagaatcctgattcatggctctgggctctaggtaaaac

SEQ ID NO: 140031 - DNA, 601 bp, Human; identical to SEQ ID NO: 94880

SEQ ID NO: 140032 - DNA, 601 bp, Human; identical to SEQ ID NO: 94881

SEQ ID NO: 140033 - DNA, 601 bp, Human; identical to SEQ ID NO: 94882

SEQ ID NO: 140034 - DNA, 601 bp, Human; identical to SEQ ID NO: 94883

SEQ ID NO: 140035 - DNA, 601 bp, Human; identical to SEQ ID NO: 94884

SEQ ID NO: 140036 - DNA, 601 bp, Human; identical to SEQ ID NO: 94885

SEQ ID NO: 140037 - DNA, 601 bp, Human; identical to SEQ ID NO: 94886

SEQ ID NO: 140038 - DNA, 601 bp, Human; identical to SEQ ID NO: 94887

SEQ ID NO: 140039 - DNA, 601 bp, Human; identical to SEQ ID NO: 94888

SEQ ID NO: 140040 - DNA, 601 bp, Human; identical to SEQ ID NO: 94889

SEQ ID NO: 140041 - DNA, 601 bp, Human; identical to SEQ ID NO: 94890

SEQ ID NO: 140042 - DNA, 601 bp, Human; identical to SEQ ID NO: 94891

SEQ ID NO: 140043 - DNA, 601 bp, Human; identical to SEQ ID NO: 94892

SEQ ID NO: 140044 - DNA, 601 bp, Human; identical to SEQ ID NO: 94893

SEQ ID NO: 140045 - DNA, 601 bp, Human; identical to SEQ ID NO: 94894

SEQ ID NO: 140046 - DNA, 601 bp, Human; identical to SEQ ID NO: 94895

SEQ ID NO: 140047 - DNA, 601 bp, Human; identical to SEQ ID NO: 94880

SEQ ID NO: 140048 - DNA, 601 bp, Human; identical to SEQ ID NO: 94881

SEQ ID NO: 140049 - DNA, 601 bp, Human; identical to SEQ ID NO: 94882

SEQ ID NO: 140050 - DNA, 601 bp, Human; identical to SEQ ID NO: 94883

SEQ ID NO: 140051 - DNA, 601 bp, Human; identical to SEQ ID NO: 94884

SEQ ID NO: 140052 - DNA, 601 bp, Human; identical to SEQ ID NO: 94885

SEQ ID NO: 140053 - DNA, 601 bp, Human; identical to SEQ ID NO: 94886

SEQ ID NO: 140054 - DNA, 601 bp, Human; identical to SEQ ID NO: 94887

SEQ ID NO: 140055 - DNA, 601 bp, Human; identical to SEQ ID NO: 94888

SEQ ID NO: 140056 - DNA, 601 bp, Human; identical to SEQ ID NO: 94889

SEQ ID NO: 140057 - DNA, 601 bp, Human; identical to SEQ ID NO: 94890

SEQ ID NO: 140058 - DNA, 601 bp, Human; identical to SEQ ID NO: 94891

SEQ ID NO: 140059 - DNA, 601 bp, Human; identical to SEQ ID NO: 94892

SEQ ID NO: 140060 - DNA, 601 bp, Human; identical to SEQ ID NO: 94893

SEQ ID NO: 140061 - DNA, 601 bp, Human; identical to SEQ ID NO: 94894

SEQ ID NO: 140062 - DNA, 601 bp, Human; identical to SEQ ID NO: 94895

SEQ ID NO: 140063 - DNA, 601 bp, Human
gcactttgggaggtggaggcgggcggatcccttgagcccaggagttcgaggccatcctgcttaacatagtgaaaccccgtttctactaaaaatacaaaaattagccgggcatggtggtgtatgcctgttgttccagctacccgcgaggctgagatacgaggattgctcgagccccgggaagttgaggctgcagtgatatgccactgccctcggaagtgagaccctgtctcaaaaaaaaatcaaagtcagttccaacaggggtattaactatagctaggtttcaaatttagctgtaaactaycccaaagaataaaagagaaaatgctgtgtattcttggctaaatcagattactttcctgggccccatttttctccctgttaaattaaaagagattgaactgaaacacttacaaaattatgaaatactagttgtccattctcctcccacaaccagtcagttctgcaggaggtagtacagtggagtggttaagaacattgagcaaattacttagctttaatctttttgtgctcaaatagccacatttattataaatggtacctcacagattttattatgagaatcgaggtaatacatgtccag

SEQ ID NO: 140064 - DNA, 601 bp, Human
tgagtatgaagtttcttttgggagtaatgaaaatgttctaaaattagatagtggtgatggctacacaactctgtgaatatactaaaaacaactgaattgtacatattaaaagggttaatttcatggtatacaaattgtagctcaataaagttgttaaagaaagaaacttgtttgctcataaaattctttttttcttcataacacctaaagcgcacttcagaaaatgctgggttagttgatttctaaaggcccttctaagctctaaaagttcatgacaacatatagtttgcattgtttgataaaaaaaaaaattccaagtttgatctaaaagtgagacatgttccttatactaaattctaggaagcatgtattgcctggttccttactaaaggacattgagtaatataatggacaaaggcttccactgtgaattgtagaaagtatagaaaatgcttttcaatcctaaacagaattaagaacacaatataaaattgtatttcagtgaaggctttgcttgtattcctgctcagtcttccttcccttcttaaccgcatccaagattgggtacttctgtctgctctggtataaggctttgcaggtt

SEQ ID NO: 140065 - DNA, 601 bp, Human
ggtttcagtaagttgacatttaaggaattaggtaatagtaaacctagaatccagaagaagaaagtaatgaattttaagttagaaaaagcaaacgcctatctggagcaaagtaataagaagcagattctcttaccaaagaagtatcttggcccacactgtagaaagagctaggattggtgatagaccagatatgacagtttattctggtatgcagctgaaagtttctgtctggcatccataaatttaagcaatctttcattaataatacttttcactgtgtgccacttgtagaagaaaatgrgaagaggtcaaggaggttatttttatatattataaatgtggtttttaaaagaacaaaagagatattatgaggtttgtttatccaaaaaatactatatgagtacttattatacgtcaggcactgttctaggtgcagagctgctgctccaaggagcttacattctgagaggtgatagacaataaatagataaatatgtaacaaaatgatttctaggtatgataaggatgccatgaaggaactaaaccaaatggctaacacagagaattgtgtgagtagttctttgtgtaaaagaacttcaaa

SEQ ID NO: 140066 - DNA, 601 bp, Human
tgtttcataatgatcaatgtctaggttacagctcttttgactctaaggaacaaaacccaaaataagtcaggattagggggctggttatatagcatttaacaggaaatcacatggaaagccaagggtaggaaattcagcacatctctacctcagggactgctacaggaactagaaagttgacaggaaccaagactgacaggaaattagacttcccgtgtgttcttttagagacagtctttatctcacatggcttctctctgtgcatctcttccagtttcctctctccctcaatcagcttcctttttttttttttttttgcacatagtttccacaccctcataaaatgtcagcttcccagcctcagctcttcttgaccttatagctgcagagcccaccaccaactggctgcctgcctcttacctgagtatgatttagtccaatttatcttttgatttaaaaatcatatgatgttttctaaattataggtgagttaccatatgaaatatggtactgaaatagtattaatatagtgagagaaaattttttgtacttttttcctgttaaaaagacattgtataactataggatattactacttttt

SEQ ID NO: 140067 - DNA, 601 bp, Human
ttcctttttttttttttttttgcacatagtttccacaccctcataaaatgtcagcttcccagcctcagctcttcttgaccttatagctgcagagcccaccaccaactggctgcctgcctcttacctgagtatgatttagtccaatttatcttttgatttaaaaatcatatgatgttttctaaattataggtgagttaccatatgaaatatggtactgaaatagtattaatatagtgagagaaaattttttgtacttttttcctgttaaaaagacattgtataactataggatattactacttttttttttagtaggttttaggggaacaggtggtgtttggttacatgaataagttctttagtggtgatttctgagattttggtgcacccatcactacagtgtacccaatgtgcagtcttttatccctcatcccccgctcactcttcccctgctgccaccgagtccccaaagtccgttgtattgttcttatgcctttgtgtcctcatagcttagctgccacttgataaatgagaacatacaatgtttggtttttcattcctgggttacttcacttagaataatggtctccaactccataca

SEQ ID NO: 140068 - DNA, 601 bp, Human
tgtttttcaaaaatccctaggtccaaatcagactcctgtctgcctgattgtttactttttgctgagcctttttctgtttattgggaccatatgttatcttgaattacctttgcttacgaccagcaggattttctgccctcacatgaactttgtgttagaggctagtagtagaaagtgccaacttctagagctcttcaaaagagcacatcagtgtcactcaggagagccttttttcctgactatcctcccagtctaatgagggtagggacatagcagagtcttaggagatggatgtagtttsgtgtggcattgcagaggagttgttataagaaagcgtcggccaggtgtggtggctcatacctgtaatcccagcactttgggaggccagggtgggcggatcacttgaggccaggagttcaagaccagcctagacaatatggcaaaaccccatctctactaaaaatacaattagccgggcatggtggtgcatgcctgtaatcccagctattaatacttgggaggctgaagcacaagaatcacttgaaggtggaggttgtagtgagccaagactgcaccactccactccagcctgggtgacagc

SEQ ID NO: 140069 - DNA, 601 bp, Human
aattgtctgtattttcttgaattgtctcttgaactcactgcagtcaggcttttgccctttatttcacattgataacatttatttaaggtcatcatcaatatcttccacattgccaagtactgtgatcagtttgaaatccttattacttgatagcagtatctaacatggttaacatcttcttgaaacattttatttggctttttggacaccattctttctcttaattatcttcccatacattgaccgttctcacctgtctctgaaggagggaatgcattgctcagttctcagatcttgtccytccccagatgccatcatggctttaaatatcatctacatagtgtgtctcccaaattcccatctccagtttggagtcttcccgaactcatatattcaactccctactcagtatattattttagatatataataggcatctcaaaattatatctaaaactgaatttctgatcatctctctctctctgagatctcctcccttagtcttttccatttcagttaatggtatttctagatatttctgttttcccactttcttggaccaaaaaccttacagtcattcttaattctttttcttccatat

SEQ ID NO: 140070 - DNA, 601 bp, Human
taggcatctcaaaattatatctaaaactgaatttctgatcatctctctctctctgagatctcctcccttagtcttttccatttcagttaatggtatttctagatatttctgttttcccactttcttggaccaaaaaccttacagtcattcttaattctttttcttccatatttcacttccaatccattagcatatcctgtcagctttatattcataatatatccagattcggactacttaataccatctccactgctgccaccctagttgaagacactacagtctcttatcaagactactkcaatagcctattagtgtttcctcccttactcctgtgtattatatttttaacacaggaaccagagtggtctttttaaaatgttattctgattatgacatgctgctcaaaacccgtgggtggttttccatccttctcagagtaaaagccaaagttcttaccatggcctatagagacctgtatgatctggtccccctctctgatcgcattatgtcctactctacccttcagtcattcttttctagccacactctttgctcttctttgaatacaccagaaactttgcacttgctgtttctgcct

SEQ ID NO: 140071 - DNA, 601 bp, Human
ttgaagacactacagtctcttatcaagactactgcaatagcctattagtgtttcctcccttactcctgtgtattatatttttaacacaggaaccagagtggtctttttaaaatgttattctgattatgacatgctgctcaaaacccgtgggtggttttccatccttctcagagtaaaagccaaagttcttaccatggcctatagagacctgtatgatctggtccccctctctgatcgcattatgtcctactctacccttcagtcattcttttctagccacactctttgctcttctttgaayacaccagaaactttgcacttgctgtttctgccttttggaaaattcattgtggctcgttcccttactttatggtatctgcttgagtgacaccttttcagtgaagccttcctagcctgccctataaaatacccactcacttccacacacacatcctccttactctttaacttgttttattattgccataacatttaccaccatttcacattcgtattctctctctctgtctccatatatatatatgtatgtgtatatatacatatatagtttaatatctgctctttaagtttcaagagaaca

SEQ ID NO: 140072 - DNA, 601 bp, Human
ctgctaccaatgtcatatctttcgttttttcttcctctttctctttttcattctttcttatctttcattattgtctttttcaatcgatttttcttttctttcactcttccttttgtctttttataatagaaaattttaagtatatacaaaggtagagagaaaagtgtaataaacccccatattcagcttcaatattattaagtcatgaccagttgtgtttcatttaaatctccttttactttccccactatactgaggcaaatttatgtagcagcaaaatctcaattgtcatattatttgrtccatagcttcagtttggagctacaaatgatatgtcatttaaaaaaaaaataaccacaatactgttattacttctttgaaaatgtaatattcaaaaatctagttattcagatttcttaattatttaaaaggtttttttagtttggatcagaattcaagtgatatatatgtattgcagttggttatatgttttttaaatatcttttgatctgtaggtttctccttgcaatttatttgatgaattaatttgatcatttgtcctatagagtttcccatagtccaaactttgctattcacatcc

SEQ ID NO: 140073 - DNA, 601 bp, Human
tctttttcattctttcttatctttcattattgtctttttcaatcgatttttcttttctttcactcttccttttgtctttttataatagaaaattttaagtatatacaaaggtagagagaaaagtgtaataaacccccatattcagcttcaatattattaagtcatgaccagttgtgtttcatttaaatctccttttactttccccactatactgaggcaaatttatgtagcagcaaaatctcaattgtcatattatttggtccatagcttcagtttggagctacaaatgatatgtcatttaaaaaaaaaataaccacaatactgttattacttctttgaaaatgtaatattcaaaaatctagttattcagatttcttaattatttaaaaggtttttttagtttggatcagaattcaagtgatatatatgtattgcagttggttatatgttttttaaatatcttttgatctgtaggtttctccttgcaatttatttgatgaattaatttgatcatttgtcctatagagtttcccatagtccaaactttgctattcacatccccctggtgtcgtttaacattttcctttttcctctgtgtttc

SEQ ID NO: 140074 - DNA, 601 bp, Human
ctattcacatccccctggtgtcgtttaacattttcctttttcctctgtgtttcttagtaattggcagttagatttagagcagagctatccaatgacactttctacaatgatgaaaatattctagacctatatggtagccactagccacatgtgccaggtgaacacttgaaatgtgcttaaagagactgaggaactttaatttttaattttatttaattttacttgatttaagtttaaatacccacacatggctaacagctaccttagccagatccagagacttagttttgtttaagtcttcccccaaaaatgtctctttttgtgatgttaacagtcattgtgataattgtctaaatgcattaattcactaggcgttgcaaaatagtgatattctatctcttttcacttcttaattgtagttggtagttttggaggaaaatggctaataaataagctaactggagataaatcctttttcactgtccatagcattcatggattttaccgtctcagctatttgcaggtaatcatgaaggtctgtctgatatgtgtaatgatttattatttactgaaacaccaaattgtaattgcataacgtcct

SEQ ID NO: 140075 - DNA, 601 bp, Human
aattcactaggcgttgcaaaatagtgatattctatctcttttcacttcttaattgtagttggtagttttggaggaaaatggctaataaataagctaactggagataaatcctttttcactgtccatagcattcatggattttaccgtctcagctatttgcaggtaatcatgaaggtctgtctgatatgtgtaatgatttattatttactgaaacaccaaattgtaattgcataacgtcctatttggaagtgagccatttggcttggtgagtgaacctttgtcagctcatcagcatcaattaaaaaaaaaaaaaaaagctttgtttctatcttacagcattttatggagaatttatgtgccataatgctgtttatgaatttgatcttcaccagtatcacgggtttgatgacagtctatttttcattgttaccagttgactaaaagtaattaagaacagtttagaataaacttatcttttttttcttccttctctcgctctctaacccccagcctctaaacaggttggtagcctgggtttctccactttttttggtcaatagaaaagggtctagacttgctgtatttggacttttcttgctta

SEQ ID NO: 140076 - DNA, 601 bp, Human
gctgaggctggagaattgcttcagcctgggaagtggaggttacagtgagctgagatcacaccactacaccccagcctgggtgatagaatgggactctgtcttaaaaaaataaataaaataaaagaacatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggmtgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacactatgttttttgcggcattattcacaatagcaaagacttggaaccaacccagatgtccaacaatgacagactggattaagaaaatgtggcacatatacaccatggaatactatgcag

SEQ ID NO: 140077 - DNA, 601 bp, Human
attatagtattttatctggggtcgggcgtggtggctgatgcctgtaatcccagcactttgggagtctgaggcgggtggattacctgaggtcaggatttcgagaccagcctggccagcatagtgaaacccgtctctactaaaaatacaaaaattagccagacatggtggcacacgcctgtagtcccagctactccagaggctgaggcaggagaattgcttgaacccaggaggcggaggttgcagtgagctgagatagcatcactgcactccagtctgggcagcagagtaagactccgtctcaaaaaaaaaaaaaaattatctggaacttagaattttatttattattatagtttgactaattttatgaaaactataataactaaatctgtttattttgattttggaaaattgaatttgggataagggaaaatatatgacttattatcttccaattttctgacatactgtagatatattgcttacctatctgaatcatgtaactttaagaccttttaaaggtctctaatacttgggctgtcctcagtgtttgggatgctcatgtgccagaccaagaaagtgtgagtttgtttgcaagagcctc

SEQ ID NO: 140078 - DNA, 601 bp, Human
cgttaatgctctcagatgggaaaagaacaaggaatatttctgtatctcagctttgttccccccgaatagctgattgatgtgcctgtagttctagaacattgactgtgtagacatagccataatcaaattagctgttcataatttctgtagaaattaattgtcatatttaggaactggttatctacataaaagccttttgttgggtacacttttaggttgaaatttggaattgtatgaattcatctttgccaggtaagcaataaaagtgtaacatttagcacttaattttaaaaacttactrtgtgaatgtaaaattggtgtcattgtcctggaacctaatttatactctggagtttctatcctctccttcccttcaacacctaaattttttttttctaagacacagtcttactgtgttgcccaggctggtcttgaactcctggcctcaagtgatcatcctgccttggcctcccaaaatgctgagattacaggcatgacccaccatgtccagcccaaattttcaaatacataatttattctcattcactcaatccttaactttgttctcttgtctccacttctgccattctactgaaactag

SEQ ID NO: 140079 - DNA, 601 bp, Human
actggaaacccccaagttatattttactccttgttctttctagttccattgactctccccttgcaaaattacacctgtcctgtctatttctagttcaagtctttattcttacactcgtgggatagaatattataataaccttataactgatgtttcaacacattatatctttctttcctatcctcttcaaaaataatttatcaggggatattcactcccatcagaataaaacccaaactctctagcctgacactcatgatctcccaggattacagcctatttgccagccctggatagagcyaatttcttaaaaaaaaaagagtataccttatgtatctctgaattctagaggctatcgcactgtttaaagtttgtatttcaaactggttgcctttctgaaattgcccacctccttgcctgtctcctagttatgcttgtacccagcatccttagtatcctgtaattttctacacacacacacacacacacacacacacacacacacacacacacacacagttgctaacaaactgtaatctcccaaataggataaatcatatattttatttattccataatttcatagcccacataacaccta

SEQ ID NO: 140080 - DNA, 601 bp, Human
gcagaatgcttctatttgttgtgtgaagtcctagtttcatttggggaactatgttacttactgccttgaatccctgacattttttttcaaatataaataataatccaacttacttcagatatagatactcaaatttatgttttacatagaagcagcataaggcaattttaaaggagataaggaggaatttgcagcattcctgcaagcataaggcttttctcttttcataattatttcttgcatctcctacttttttttttttttttttgagatggagtttcactcttcttgcccaggctgkagtgcaatggcacaatctcagctcactgcaacctctgcttcccagtttcaagcaattctcctgcctcagccttccaagtagctgggattacaggcatgcaccaccacacctggctaattttgtatttttagtggagacgaggtttcactatgttggtcagcctgatcttgaactcctgacttcaagtgatccacccacctcggcctcacaaagtgctgggattacaggtgtaagccaccacacccagtcttttgttgttgttgttgttttggttttttgtttttttgagacagagtcttg

SEQ ID NO: 140081 - DNA, 601 bp, Human
attaaaagttgatcccacaaattcttcaatataagactcaatttgatttcttacatgttatttagaaacgaaaatagagataagagtactttaatgcaggaagggttctgcattataaacctcacataacagtcactgtcatgattgttgaagtctagtctagacataaaagctatttgttataaagtgaattgggtaaatttggtgtaatatagcctattttaagtggactggttgtttatcaacatcagaataatttatgaaccaggcttttagtatcttttccttaatactggaatgrtccctgggatgaacttgtagatgtatgagccatttctataggcttgcaattttaagggtagcatttaccctggagagtagttttatgtatagtttgatttgagtttcagagaatgagtaattacatttggaggagctaatgtttttcttttttggtaagctgttgtagagttccttttgaagggatttgctaagaaatttacttaaagttttaaaattttaatgccatttaagattttgtcttgttctagccaacctaagataaaccagtttaatataaagcattgttacatcagatttt

SEQ ID NO: 140082 - DNA, 601 bp, Human
aataaatcagagattcaaaggcagaatccatcagcaagattcgttatgatggattgaatatagatggtattcagggagataatctaatcttttaagcctagtttcctggcattcatttactattcttctatacttaaaggtactagttaaaacttctctttctggcaatagggcaggcttgctacctggaccagtcctccaggtgaaaataacttaaaatgctagatgaatttgctggaaagaaaatacggaatgctcaagccaaaaactaaatgaaggcaggaatccagagaagtaagarcagtaaagaaggcattagctttgagggcatttgctgaatcaatttttatagctttgtagcttcacgaggctcagaagtcaggagacaaatcctgggttctgattgaaggtggaaaatctaagtgaaatccccttcccttcccaccaataaatttgggattccaaagggactatacacttagtattagggtgaccaggaaatatgctcatctccctttccagggggatctgcaaggaaaactgcttctctccaacattagtcttattccattgaaaattcataaccctaagctggtcttcc

SEQ ID NO: 140083 - DNA, 601 bp, Human
tggggctgaaaaatagtttaggacacaggaaggatagagtgagaaaatcctctctaactggagtactagaagaaaaataaataggatgggcaggagcagtgtttaaagaagccctacaaatacccagcaggatcaaagggaaaaaaatccacatattatagacagacatcatagccaaagatcttaaaagtagtcagaaaaaaaggcattgccttcaaagaagaccaacgactgatttcccagtagcaacagaggaagccagaagacagtagaatgattcctaaatggttccgaaagaaartaactatcaatctagcattctatatccagcaaaaatgtatttcaagaaaggcaaaattaagctatttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaattt

SEQ ID NO: 140084 - DNA, 601 bp, Human
gagtgagaaaatcctctctaactggagtactagaagaaaaataaataggatgggcaggagcagtgtttaaagaagccctacaaatacccagcaggatcaaagggaaaaaaatccacatattatagacagacatcatagccaaagatcttaaaagtagtcagaaaaaaaggcattgccttcaaagaagaccaacgactgatttcccagtagcaacagaggaagccagaagacagtagaatgattcctaaatggttccgaaagaaaataactatcaatctagcattctatatccagcaaaaakgtatttcaagaaaggcaaaattaagctatttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaatttgaagaaattgaagcatatggtgtgttagggtcttta

SEQ ID NO: 140085 - DNA, 601 bp, Human
ctagaagaaaaataaataggatgggcaggagcagtgtttaaagaagccctacaaatacccagcaggatcaaagggaaaaaaatccacatattatagacagacatcatagccaaagatcttaaaagtagtcagaaaaaaaggcattgccttcaaagaagaccaacgactgatttcccagtagcaacagaggaagccagaagacagtagaatgattcctaaatggttccgaaagaaaataactatcaatctagcattctatatccagcaaaaatgtatttcaagaaaggcaaaattaagctakttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaatttgaagaaattgaagcatatggtgtgttagggtctttacattaaaagacccatatctcagaggtgat

SEQ ID NO: 140086 - DNA, 601 bp, Human
ctatatccagcaaaaatgtatttcaagaaaggcaaaattaagctatttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaatttgaagaaattgaagcatatgrtgtgttagggtctttacattaaaagacccatatctcagaggtgattaggaatccagactaaagatgaggagaattatcatgcccacagtcaaccttgaagtaacccttgaaccttggagtgaatgaaagctccatagaagagaaagtgtaaaaagaatagagagctgggttttgaaagagaatagaatcttttagaatctaatagaatctaaaataatccattcttttgaaaaaaaaaaaatagagagtagagagctgagtttctttagggaactagaaaagaaggagccagatactgat

SEQ ID NO: 140087 - DNA, 601 bp, Human
atttcaagaaaggcaaaattaagctatttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaatttgaagaaattgaagcatatggtgtgttagggtctttacaytaaaagacccatatctcagaggtgattaggaatccagactaaagatgaggagaattatcatgcccacagtcaaccttgaagtaacccttgaaccttggagtgaatgaaagctccatagaagagaaagtgtaaaaagaatagagagctgggttttgaaagagaatagaatcttttagaatctaatagaatctaaaataatccattcttttgaaaaaaaaaaaatagagagtagagagctgagtttctttagggaactagaaaagaaggagccagatactgatctgaaattgatcaaaatgg

SEQ ID NO: 140088 - DNA, 601 bp, Human
gaacactattggatacatgtacttttgatgttcccttggaacaacaaacaatcaaaccaaaattgattgattttaaatcaaccaaattgattattactttctctaccttttctgcctccccttccctcccttccacccctaaacagcaacacacagacacacacagacacacacagacacacacacacacacacacacacacacacacacacatccatcccaaaacaaaacttatgatttttcttgcatttcttgtttggttgtaccaatatgatccttccaggcacatcaacttaaatgmctgagaggtattgtctactctttcctctttctcatcacctcctgcaaattactgtctctcaagcctaaagagttgccttctaaatgtaccttaaatcagtctccctttcagatcctcaggtattgccttagcttaggtctttctgccacttttctggatacctataatagctgccaaactagttttcctgtgtctaatttctcctcttatctactatatccacttctagattaatctctttaaagaccaaatttgatccatgtcactaccttccttaaacccttcagttgcttccctgta

SEQ ID NO: 140089 - DNA, 601 bp, Human
aataccagctccctaccagctagggagtactgcttgttaaatattcagggattttgcaagccagcttgtaacttaaaatcagccatgggtggaggtatttgcagcgtgaacatcagcaaatactgcaaatccagattttctccacaaccaccccccacaaaaaaagctggttccagaacatcattacctctattgaactagagtaacctttgccttaaatcctggtttaaatggtaccactttaaagcctttcctgcccattcatcttctctccacacacataaaattgatcactacttcyaagccctttgcatgctttattatagcatttgtcgctctatagcataactatgtttacatgtctctttttaaactaatccctgagttcctgggacagagttcatataattatctttgtctctgtcattcattcacttaacattcattgaactgatacacactgaaccaatatatttaatatgtatcaggcattgttctcagggtacaaaaatgaaaggatttagtctgcaagaagctcatagtccatgggaagagagaaatccaaatagtccattacaatacagtgagacaagtacattgc

SEQ ID NO: 140090 - DNA, 601 bp, Human
gataaagtgctccaggagttcagagaaagaagggatcatattctgcaggggtacttagaggtggcttcatggagttggtagctgatcccgggcatgaaggatgggtaagatgtgaacagtggagaatgaaggaaatggagattggaggaagggcttacaggtgaagggaacagtgagagcagacagacatgggaaaacacatgtaaggaacaaagagttctttagctcagcaggaaagtatattgaaggataataagaaacatttgctgtctgtaatttatcttctatcctttctaactgrggcttagttcaagattttccaggtagtctcaggcatgtaatcttatgtcctcccacactggtgaaaaagccagctgaatggaggaatcagaagataggcatcttgtcctgttcctatgtgtctgttcttatatgtcctcaccattccccaccaccacccccaatgtatcctcactgaggtttacagtgataaatgcagccattaatcattgttctttggccaggcgctgtggctcatgcctgtaaccccagcactttgcgaggcagagacaggtggatcacttgaggtcaggagtttgag

SEQ ID NO: 140091 - DNA, 601 bp, Human
cacaggcacatgccactgcacccagctaatttttgtattttaggtatagatggggtttcaacattttgcccaggctggtctcaaactcctggacttccaaagtactgggattatagatgtgagccacagcacccgacccccctgctttctcttaacctcttcctcccatacctctacctctcccttcagcctcccacagactcccttagattcctgtgaggggttcttgttcttctcctttacagatcccacatctgcacccccagctactcatctagctctcccaaaataccttaaatgrcagcccattgattttttaaataaataaatccagagtaatatttatttcaaatgagttttcttttcagtgttgaagcaggacatatcaattgtgagatgaagtctatctcaatttaggcaaactcttacagatagatgttcaaactgtacagaacttttgggattttgtttcaagatatacagttatataaatgtcaaatttattaaatgatccttacatcacttagtttttactggccctgttttataaatgtgagggatttggggttttgttttattttggtttggtttggttttgctt

SEQ ID NO: 140092 - DNA, 601 bp, Human
agatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactgatatcttgtcagagttcgckactgtactatttatgttacaacttagattaattagcataagatatataaaagctttatgtggtcctggaatgtaatgaaatattgtgtctggaattggttccttccggtgggttcttggtctcgctgacttcaagagtgaagccacagaccttcgcgtgagtgttacagctcttaaaggtggcatccagagttgtttgttcctcccagtgggttcgtggtctcgctgacttcaggagtgaagccgcagaccttcgcagtgagtgttacagctcatgaaggtagtgccgacccaaagagtg

SEQ ID NO: 140093 - DNA, 601 bp, Human
cacagtgaagactccgtctcaaaataaattaattaattaattaaagacatgaaaaagagcgagactctgtctccaaataaataaatgaaagacgtgaaaaatctccaaagaaaattaacaaaaaggcttaaagggaaattaaattaggcttgtaattaaggaaattagattgcttgtagaagttaataaatatatttatgggaaggatgctgagtgtttctttgaatgcccacaaaaaagtttacacctacgtagagtcactagaggttggaatggccgtgttgtcccaaaagagcttcartaaggaaggcttttccttctctctaaccttgatacagggttttatggtttgctgaaggcttgcattttcatcagatttcatcttcataaaaccttaggagataattggagaaatttatgtaatttttcttttacacttaataaactaactatgagatgttaaataacctgtccaaggcaaatacagattgaccacccttaatccaaaaatctgaaatccaaaatgctccaaaatcagaaacgttttgagtgctgacatgacaccacaagtggaaaattccacacctgacctcatgtgatg

SEQ ID NO: 140094 - DNA, 601 bp, Human
ctcacacaaaatagacactcaataaacattggtggggtgaatgaacaaatgtaaaagtaaagatatctttgtcataggggtaaatatgacagtcaaaatataaggtgaatgaaaatttttacttataattttgtatatttcaataatatgaaaattttattgtaaacatgtattttataaataaaatgaatatcatgtgtgagagcactttagaaatggtataaatgttttagctatatacacatacttaagttgctttgtaatcattgagtactaaaaataagaagattgtgtattacartagtacatagaggctttggaatatcttagggaatagaaatggctttagtatagtttttcagggagaaactaatgtaccctaagtctatcatgcttcttaaaagaagtcagaggaccatgtcctagttttaccgtctgtgactgaacataaatataagggaatatatctttgcagaggcaaaaccatgtactttaagtaaaagtaaaaaagaaatcagaaagatatagggggaaataattgtgccaggaactaaggatgcacaaatactgtaattgaacattaaatttggcactgagattt

SEQ ID NO: 140095 - DNA, 601 bp, Human
tttataaataaaatgaatatcatgtgtgagagcactttagaaatggtataaatgttttagctatatacacatacttaagttgctttgtaatcattgagtactaaaaataagaagattgtgtattacaatagtacatagaggctttggaatatcttagggaatagaaatggctttagtatagtttttcagggagaaactaatgtaccctaagtctatcatgcttcttaaaagaagtcagaggaccatgtcctagttttaccgtctgtgactgaacataaatataagggaatatatctttgcrgaggcaaaaccatgtactttaagtaaaagtaaaaaagaaatcagaaagatatagggggaaataattgtgccaggaactaaggatgcacaaatactgtaattgaacattaaatttggcactgagatttctagcaaccttgacaaaaagagaaaaggtaggtgataaaagaagcctgttttccatggaaaacaatcaactttttctggctctagtttctaggaaatagtcatttggtttttttactttttttctcacatacgttccaaagtatatagttcatagagttttagttttatgcaa

SEQ ID NO: 140096 - DNA, 601 bp, Human
gttttagctatatacacatacttaagttgctttgtaatcattgagtactaaaaataagaagattgtgtattacaatagtacatagaggctttggaatatcttagggaatagaaatggctttagtatagtttttcagggagaaactaatgtaccctaagtctatcatgcttcttaaaagaagtcagaggaccatgtcctagttttaccgtctgtgactgaacataaatataagggaatatatctttgcagaggcaaaaccatgtactttaagtaaaagtaaaaaagaaatcagaaagatatagggggaaataattgtgccaggaactaaggatgcacaaatactgtaattgaacattaaatttggcactgagatttctagcaaccttgacaaaaagagaaaaggtaggtgataaaagaagcctgttttccatggaaaacaatcaactttttctggctctagtttctaggaaatagtcatttggtttttttactttttttctcacatacgttccaaagtatatagttcatagagttttagttttatgcaaatcaaatatttacttggttggctcatgtcagcttctgcatttgtgctcttgtt

SEQ ID NO: 140097 - DNA, 601 bp, Human
taaaaaagaaatcagaaagatatagggggaaataattgtgccaggaactaaggatgcacaaatactgtaattgaacattaaatttggcactgagatttctagcaaccttgacaaaaagagaaaaggtaggtgataaaagaagcctgttttccatggaaaacaatcaactttttctggctctagtttctaggaaatagtcatttggtttttttactttttttctcacatacgttccaaagtatatagttcatagagttttagttttatgcaaatcaaatatttacttggttggctcatgtcrgcttctgcatttgtgctcttgtttcagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggtaagacaaattattatacatggaatggaaatattttatcattaattataaataagtgaaataccactttattctgattttattcctgttggg

SEQ ID NO: 140098 - DNA, 601 bp, Human
tgagtcccctgtttcatacaaaaatatttctttacaaaagcaattcaaatagatgttttcccagggtatcaagtatcattagaaaaataaggaggcaagaactgagccttggagcatatcaacagttaatggttgaagaaaccaaagaaaacagaagagggcaccggaagcacgaaatgagagaactccatacagaagcaagagagagagagttactaaagaagaggtggctgatttataagttacaacccagaaataaagagggcaaaagggaagagaatcattcaattgggccagaagraagttctagatatttttgtcagatggtgtttacttcaagctaacacacatcttattttttttaaagtactcagagtattacttaagagtgagaaaattgagatatctttaaaactggtgatagagtattagccagtaaagacctgatttagagattgagtacatctgaaatgtttgaaagttagactttggcacatagttctggtctggcttctggtaattgtggagtagcttgtatgagaataacagtcctaccaataccaattatgaactccgcacaaaatataaaagaacaattgtt

SEQ ID NO: 140099 - DNA, 601 bp, Human
gccagtaaagacctgatttagagattgagtacatctgaaatgtttgaaagttagactttggcacatagttctggtctggcttctggtaattgtggagtagcttgtatgagaataacagtcctaccaataccaattatgaactccgcacaaaatataaaagaacaattgttttgaaggtattggagactgatcaaaagcaggagggtctacatcttttttttttattatttttgagacagaatctcactctgtcacccaggctggagtatagtggcatgatctcggctcactgcaacctccrcctcctggattcaagcaattaattctcctgcctcagcctcccaagtagctgggattacaggcgcctgccaccacacccagctaatttttttttttttttttttttgtatttttagtagagacggggcttcaccatcttggccaggctggtttcgaacccctgatctcaagtgatctgcctgcctcagcctcccaaagtgctaggattacaggcgtgagccaccacgagtggccaacgtctcttgaaagatagaaaccacactgagcgaaagccacatttgtgcacttcttcctcataggc

SEQ ID NO: 140100 - DNA, 601 bp, Human
gtaattgtggagtagcttgtatgagaataacagtcctaccaataccaattatgaactccgcacaaaatataaaagaacaattgttttgaaggtattggagactgatcaaaagcaggagggtctacatcttttttttttattatttttgagacagaatctcactctgtcacccaggctggagtatagtggcatgatctcggctcactgcaacctccgcctcctggattcaagcaattaattctcctgcctcagcctcccaagtagctgggattacaggcgcctgccaccacacccagctaatttttttttttttttttttttgtatttttagtagagacggggcttcaccatcttggccaggctggtttcgaacccctgatctcaagtgatctgcctgcctcagcctcccaaagtgctaggattacaggcgtgagccaccacgagtggccaacgtctcttgaaagatagaaaccacactgagcgaaagccacatttgtgcacttcttcctcataggcactttcagtttcttttcatggggagtagagttcaagcagaaagcagcagtcttggcctaaggagtgagacatcagagtttggtcc

SEQ ID NO: 140101 - DNA, 601 bp, Human
cactttgggaggctgaggtgggtggatcacctgaggtcaggagttcgagaccagcctggccaacatggtgaaaccccgtctttactaaaaatacaaaaaaaaaaattagccaggcatggtggcgggcacctgtaaacttgggaggctgaggcaggagaatctcttgaacctgggaggcggaggttgcagcgagctgagatcacatcattgcactccagcctgggcaacaagaatgaaactccatctcaaaaaaaaaaaaaaaaaaatttgctgggtgtagtggtgtgcatctgtagtcccrgctgctcaggaggctgaggtgggaggatggcttgagcctgggaggtggaggttgcagtgagccaagatcatgccattgcactccaacctgggtgacagagtgagaccctatctcaaaaaaaaaattttaaaaggctgggcatggtggctcacgcctgtaatcctagcactttgggaggccgaggtgggtggattacctgacgtcaagagttcaagaccagcctggccaacatggtgaaacctcgtctctactaaaaatacaaaaactagccggacatggtgtcgggcacctgtaatccca

SEQ ID NO: 140102 - DNA, 601 bp, Human
gataaagatcagaatatcctttcctctgctggaatcagggattgactagagggggcacaagggtactttatagggtgatgaaaatgttctagcccaggcatgatggctcacacctataatcccaacactttgagaggccaaggtgagcagatcgcttgggcccaggagtttgagaccagcctgggcaacatggcaaaaccttgtctctaaagaaaatacaaaaattaaccaggtgtggtggtgggtgcctgtagtcccagctacttgggaggctgaggtgggaggatcacctgagcccacraggtcgaggctgcagtgagctgtgatcatgccactgcactccagcctgggtgacagagtgagaacctgtctcaacaacaacaacaacaacaacaacaacaacaacaacaacaacaacagtggagctttccagtggctataaaacatgtgatacaacaacagattgaatgcagaagcagatatgaaaatccacctgagttctattaagccagacattacagagatttgcaaaactgtaaaacagtcctatccttctcgctaatgtttactttggaaaatagttatttttcataaaaatact

SEQ ID NO: 140103 - DNA, 601 bp, Human
gggcttaagcaatcctcctgccacacctcctgagtagctggaactagaggcgtgccacaatttttttgtttgtttgtttttgtttttttttagtagagatgaaatcttgctatgttgcccagactggtctcaaactcctgagctcaagctatcttcctgccttggcctcccaaagtgctaggattgcaggtgtgagccactgcacccagcctagaacaggcgaaattaatctatggtgatataagtataaatagttatggcctctgagttgcagtcagtagggaggcattaactcaacagyggcacaagggaactggctgaaatgttggatgggttccttaattgatttagatgtgcttatggatgtacatatttgtcaaagcacaccaagctgtacccataaaattggtgcattttgcttttgtaaattatgttgccattttaaaaagttggcctcataatatttattttatgaaatgaaatgggatagtctggggataatagtcctgtttggagaattgtgaagttttaaactgccccacaagaatctgttaaaaagaaaacatgcaatcagagtttaatgctagtgtctacactgaat

SEQ ID NO: 140104 - DNA, 601 bp, Human
taaggagcttattttgcttaggaaatcaaggatcaagtaaagataggagctgctatagtgggtgaaaccaaaagcatttaacacatagtaatctgcccattgttcttcacatatctttttttccaaaagttttccaaaaccaagttaatatccagcccctaagctgttggtatgtggctcagtgctgctggataccttaataatttcaaccttaaacagagtccagtctattctctgacatggcttcgggataacctgatggggaaatactgaggtataacaattaggtgacaagcaagargcaacaagaggggaatatgtagactcttagcacagaaaacttgtaggagtcaaatccctattgaagaccaagaacattttaaagtagtggactttctagttgttataggccagatgctaatgttgataactaaaaagagacttagataaggaagggaaggcaaaagaggcaagcaagcaaacaagccagcataaggtcctagaagtgaggatatatgatttttgcagagagtaaatcagactagcttcatttaatttcctttcaaagatactgaaaagccacattgctggtagtaacagt

SEQ ID NO: 140105 - DNA, 601 bp, Human
gtgaaaccaaaagcatttaacacatagtaatctgcccattgttcttcacatatctttttttccaaaagttttccaaaaccaagttaatatccagcccctaagctgttggtatgtggctcagtgctgctggataccttaataatttcaaccttaaacagagtccagtctattctctgacatggcttcgggataacctgatggggaaatactgaggtataacaattaggtgacaagcaagaggcaacaagaggggaatatgtagactcttagcacagaaaacttgtaggagtcaaatccctaytgaagaccaagaacattttaaagtagtggactttctagttgttataggccagatgctaatgttgataactaaaaagagacttagataaggaagggaaggcaaaagaggcaagcaagcaaacaagccagcataaggtcctagaagtgaggatatatgatttttgcagagagtaaatcagactagcttcatttaatttcctttcaaagatactgaaaagccacattgctggtagtaacagtacgaagaagtgtacaatttgagtaagggctttggtctcagacaacagaaagttaggggtgc

SEQ ID NO: 140106 - DNA, 601 bp, Human
ataaaaaaatgatagtctaggccaggcgtggtgactcaagcctgtaatcccagcactctgagaagctgaggcaggcggatcacgaggtcaggggatcgagaccatcctggctgacatggtgagaccccgtctctactaaaaatacaaaaaaatcagccaggcgtggtggcgggcgcctgtagtcccagctactccggaggccgaggcaggagaatggcgtgaacctgggaggcagagcttgcagtgagccaagattacaccaatgtactccaggctgggcaacagagcaagactctgtctaaaaaaaaaaaaaaaaattatagtctagcttaatatgtaaaaatggaacttatctcactgcttcagtttttctctgccaaatactcccgccaaaagctagaagagcgtgttgctatctcattgagggatcctggagctggagctcagcttcttggcagtgagacccatacatggtggaaaccaggggatgacaagtagaactcctacacacccagtagttaagggaagtgttcaggctgccaccagggggcatctgtgccatgatctggctacaaaggtagacagtgaagtcagcctttgt

SEQ ID NO: 140107 - DNA, 601 bp, Human
tcccagctactccggaggccgaggcaggagaatggcgtgaacctgggaggcagagcttgcagtgagccaagattacaccaatgtactccaggctgggcaacagagcaagactctgtctaaaaaaaaaaaaaaaaattatagtctagcttaatatgtaaaaatggaacttatctcactgcttcagtttttctctgccaaatactcccgccaaaagctagaagagcgtgttgctatctcattgagggatcctggagctggagctcagcttcttggcagtgagacccatacatggtggaaaccrggggatgacaagtagaactcctacacacccagtagttaagggaagtgttcaggctgccaccagggggcatctgtgccatgatctggctacaaaggtagacagtgaagtcagcctttgttttcctgtgttaggtaggattaacaaaaaacagaacaaatagaagtaaagaaagcccagaaacaaatagtctagggcttcatcatcaggaatccaggctccttttatctttccccaccatccttagcatttagcttcagtcatcaagattacttaatgtactttgtcatcacaacatggcta

SEQ ID NO: 140108 - DNA, 601 bp, Human
tgaaattcatcatttcacaaatgaaagaatctcggtgttttaatagcttggtagaatcaggccttactttacactcatgagctcttcatttattccagccataattaattcagataatttacagttttctcttactcttttaggttggttaaactaatctgttttggttttttcagggccaagtactttaggtaacattgtagaagaagtgactcatccctgtaacccaaatccttgccctgccaatgagctctgtgaagtaaaccgaaaaggatgtccatctggagatccctgtcttccrtacttttgtgttcaaggtaagaggtaggtgggtgtgagaagaggatggataggtgctgctagtgtttctttataggagctatctttctttttttcaatcctgctccttctgtaatataggggttatcttcggagtgagattatgagggacttcatgttctatattatgtttttctataatgttttgagattttctcattaaacatgtattattgatgtaagcaggaaaagacagacacttgtaatcctccattgttatttaaattgtaaactaataataacagtctaaaacttgactctc

SEQ ID NO: 140109 - DNA, 601 bp, Human
aaaaaatactctacattgttcatgttttttctttcctttcctttagtatatagagaaatagcatattcaatagaatgtatagctatctccataaagattaatgttatgttgaaatatatataactttaagggtgaaggatttttatcccatagaattatgatagtctttatctttctgtcaatccctttagaatatagttgttgcaacattttgcttctttttatctatttcccaattgagaatgtttctttatcatgttagaatcaagattttaaaaaaggccaggcgcagtggctcackcctgtaatcgcagcactttgggaggccaaggcgggcggatcacgaggtcaggagatcgaaaccatcctggctaacatggtgaaaccttgtctctactgaaaatacaaaatattagccgggcacggtgggcgcctgtagtcccagctactcgggaggctgaggcaggagaatggcgtgaacccgggaggcggagcttgcagtgagccaagatcgcgccactgcactccagcctgccggacagagccagactccgtctcaaaaaaaaaaaaaaaagattaaaaaaaaacgtttttttttttg

SEQ ID NO: 140110 - DNA, 601 bp, Human
tcacgcctgtaatcccagcactttgggaggctgaggtaagtggatcacgaggtcaggagtttgagaccagcctggccaatatggtgtaaccccatctctactaaaaatacaaaaattagccgggtacaaaaattagctgggtgtggtggcacacgcctgtagtcccagctacttggaaggctgaggcagaagaatcacttgaacccgagaggcagaagttgcactgagccaagatcgtgccactacactccagcctgggcaacagagcaagactccgtctcaaaaaaaaaaaaaaaaaaawactgttagtttccctattctattttttaaaatatctgtgattttaaaatattttttactagcccctacaaataaaaagttacatatcttacagcactgttatactgaatgataggtcactttggggtacagatctgtaatcaccaccatcctccagaatgtggaattttaatttgagaggtatgtttttggccaatgaaccaaagcaattccttaatttggtgaaagttctattacataatctttaatagtgatttagtacctataagacttttatcaagtgtatatctaatgttataaa

SEQ ID NO: 140111 - DNA, 601 bp, Human
atgagtcaaaaagaacagagccagtgattggaatgggtttaattaaattgaacttttctacctggtagaataccccatttacccctactgctatgatctaaaatgtccatgcatgttctcagtttgtttctcagcaccttcttcctcagcctaccttagcttacttcttcatctagactcccacaaacaataatatcccagaatattactttcttgactttcctatgctttgctgctcttattattcttacaccaacataaataagtgaaaaggctagtgagatgggatgctttcctctcrtgaagctattattgccaatagcaacagcacagtctgctggtatatcttggtatctgctttttcctagatctaaaatacctttggttgtgggtaaaaagttactaggtagctgcccttgcccccatttcacactgctgcagtggcaacttgattcttctttccccagaattagtattacatgtggagaggggtgggggccgggtggaggagaagtggaggagaggagagtaaggatttaccaaccttgtacctccagcccattggaaataaaaaggggatcagaaataagaagtgaatggc

SEQ ID NO: 140112 - DNA, 601 bp, Human
gtgatctcggctcaccacaaactccgcctcctgggatcaagcaattctcctgcctcagcctcccaagtagctaggaacgacaggcatgcgccaccatgccattctaattttgtatttttagtagagatggggtttctccatgttggtcaggctggtctcgaactcccgacctcaggtgatccgcccacctcagcctctcaaagtgctgggattacaggcgtgagccactgtgcccagcccactctttcttatgcttggtattagcctttaacattcaagaaatccccacaccagacttcaracatctaaattctagattttatatgccaaatcaggagaaacagtctttactttccctacctatagccttgttaataggggtctctacctgggatcaaagtctagggggccctcaactagttggcaataaaaaggacaaaggaaagccatcttgcagatgagctattcagagcattgctgcctttaaaaaccctgtcagaatacaaaaaaaaaaaaaaattagctgggcgtggtggcatgcgcctgtagtcccagctactccggaggctgaggcaggagaatggcgtgaacctgggaggca

SEQ ID NO: 140113 - DNA, 601 bp, Human
aaagtttctatggaaagaagacaggacgcaatgcataagaaataagctgaaagaataatacaggttgtgttgggaggtagaattgaggattgtcttaatattttttcatttgttttatccattggctagcctttctgaatgaggttgtcttgcttttataataaaacaataaaaataaatgtcaaagtgggaaggccttcttgagtatatacaagattgaaaaattcagctacatgaacctcaaaattttctgcatggtaacagacaaatgacacactggaaggaatatcacagagaaagygctgatgtccttgtaatataaagagcccctgcaaatccatctgagaaagatcaacctaatatcaaaatggacagagatcaataacctaatagaaaaatggaccaaggacataaacataaaaaaagaaatccaaatggttcttaaacatttgaaaaggtacttttatttgttagggtaagtaattccagctactgtatacaaattccaaaatatcaataatttcacagagtagataattacatagagcccatttgtttcttcagcaggcggctttccatgtggtcattcagagacgtggga

SEQ ID NO: 140114 - DNA, 601 bp, Human
taaaatatatctgtagggataaataagaaagtggtagctcacacgtgtattcccagcaccttgggaagccgaggcaggcagatcgcttgagctcaggagttcgagactagcctgggcaacatggtgaaaccctttctctaccaaaaattagccagacatggtggcttccacctgtagtcccagctactcgggaggctgaggcaggagaattgcttgaacccgggagacagaggctgcagtaagccgagatggtgccactgcactccagcctgggggacagaacaagactccatctaaaaaaaaaacaaaacaaaacaaaaaacactaaaagaaagaaattggtaatagtggtgcctctagggaagggaactaggtgtctaggacacaagagtagaagggaggcctatttttcactgtataccatgttgtactttttcagtttcaccatgggcttgtattatgtgttcaaaaaataattaattgtggccgggcacggtggctcatacctgtaatcccagcactttgggaggcagaggtgggtgaatcacttgaggccagaagttcaagaccagcctggccaacatggtgaaatcccatctct

SEQ ID NO: 140115 - DNA, 601 bp, Human
caagctttttctctcaaagttaccaaatttctcctgatattcctgtttctcatccctggcatgttagtaagtaatgaagttctaaatattattttccattatttctcttcaaatattttaaatttccataaaaccataactaagtgcattgtaatttcaaaccatttcatgcatagtgacggtggtagtgattttggtgcaggttagccctaaaaagagtataaatcatttcctttgaaattaaaataacactagctactatatgcttcctcttttattttataaactaaaatttatataycttagtacttaaaatacccagtgaaagctaaacattttcatgggtcttatcttcttatagaaagttatgtaaaccctttataaaaattaggaaagcagaaaaaagcctaaagaagaaaagaatcatcatccctagcccctctgaaggagctcaggaattgagaatgaagcaaggtcctcatcttactaggaaagaccagcttcatggtggcattctctcagtcatttgcaaccagctggtatcagatcctcggtcttgtaggcacaaaaacctgaattattttaggacaaagagtgaggc

SEQ ID NO: 140116 - DNA, 601 bp, Human
atctagtgctttgctagccccaccacagtccctccctacattggctcatggtgctgcattcgtctttttcaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccaggtacagtgctttggctgacaaaacaaagtacactasggataaaattggtttatgatattttacagatgaatcaacagtaagaccagccgagggtcttctgtgaatcctgtcaaatctatagcacccagtcctccactaaaaaggaagactggctccttctcctaactctggaagctatcttgctagtgtgtgtacctttgcacatctggtgtacaagcaagaacagagagtggcttcttgcagtccactcctaggaaaagaacttaaaagtttcacaaccctggcatggtcaacatcattcttacttctcatagttctctgggccctcactaagaa

SEQ ID NO: 140117 - DNA, 601 bp, Human
acccgggaggcggaagttgcagtgagccgagatcatgccattgcactccagcctgggtgacagagcaagactccatctaaaaaaaaagaaaaaaccaaggacaattccttttgaggcttctcacatgcaccactgattttatgcttgcccctctccctggggccgtgctttgggcctagcatccgctgcccacaaccagctaacacttaaaatgattgcttcacattctctggtcttcatggttagaaaaattccatcatgatgtctccctgaaacatgcttgttttctctcagagccccygtgccatttgcattgatcccatctaccctgaattctgtcttcccctacttgttcccttctcctggctgtgatttttctctgatctattcctgacctacctgttggctccagagtctgtctaccccactgctcccccaactcctccctctccttatcccatacccagcatgaaatgataagacctctgcatttgcatgaagattgatctggtcatcttaaagaggcgcttctgggatactaacagaagtctgagcagagcagagagaggtagcaggaaagaagatttttatctcttatcag

SEQ ID NO: 140118 - DNA, 601 bp, Human
aacatgcttgttttctctcagagcccctgtgccatttgcattgatcccatctaccctgaattctgtcttcccctacttgttcccttctcctggctgtgatttttctctgatctattcctgacctacctgttggctccagagtctgtctaccccactgctcccccaactcctccctctccttatcccatacccagcatgaaatgataagacctctgcatttgcatgaagattgatctggtcatcttaaagaggcgcttctgggatactaacagaagtctgagcagagcagagagaggtagcrggaaagaagatttttatctcttatcagttcacatggaataagcacccagatcccagagaggctgagaaaagtaatctttcagctcatctggagacacccatattgctgcccacgccaccaccacccccagcatttagcccacctcaggaacttaagaggtcctcataatttatacctgtgtcttttttccttcctgaaaatagggaggcatgctgtgtactcttggttgggaaaggtacaacatagacatttccaggctaaatgtgatttgtttgccctcagcccttttgcagagcaacc

SEQ ID NO: 140119 - DNA, 601 bp, Human
atgcaaacccatcatcccaccgggtaggctggcagtatcggggtggacaggggaggactgagaagatttgcttatccacctccagagagtgagtcattgagaagagagctcatttacgtttttcagaaagtcttgaagagattcttatgctgatcatactcactactttgggttgaccttaaaaaactagggcttgccttcgatatcatctggtgtcctgctattttaaaacaatacagcagccttttctcaagctaaatcttacaccagacaccaatatataaacagataaagcagtatkcaattatgaaaattagggttattaaatgcataatgtttacttattacgaagttaacaaataacgaattactaattaatgaataattaaagtagttttgatgaacacaaacttttgaaattgagagaaatagaagatagttgttgtcttagattggccttaacatctaatttaattgttttagttgcatataatcagaaaagttttgtttcatacagactgtttttagcaataacagttttttaaaacagcttaccttacaatctcacactcttagtcaaacagaagtagcagaagagact

SEQ ID NO: 140120 - DNA, 601 bp, Human
agatttgcttatccacctccagagagtgagtcattgagaagagagctcatttacgtttttcagaaagtcttgaagagattcttatgctgatcatactcactactttgggttgaccttaaaaaactagggcttgccttcgatatcatctggtgtcctgctattttaaaacaatacagcagccttttctcaagctaaatcttacaccagacaccaatatataaacagataaagcagtattcaattatgaaaattagggttattaaatgcataatgtttacttattacgaagttaacaaataaygaattactaattaatgaataattaaagtagttttgatgaacacaaacttttgaaattgagagaaatagaagatagttgttgtcttagattggccttaacatctaatttaattgttttagttgcatataatcagaaaagttttgtttcatacagactgtttttagcaataacagttttttaaaacagcttaccttacaatctcacactcttagtcaaacagaagtagcagaagagactttattccaagtctgcacagaacaggttaatctggatctaacaggttcattcctccatccgtta

SEQ ID NO: 140121 - DNA, 601 bp, Human
gtcataggaattcttctttttttcaggtaatacatgttttctctttccaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcaggtgagttcagcacatgttgtgaagccatcttgtcactttcaagtttggtgcacctaggagggagtgggcacaaactaggaccgaggaaggatccrtgggtgagggagtggaggcatttgggaagttcagcgggacaggagggagaaaagcaaggcaatctctaaaggactgagcactttgccagtggctgagacctggtgcacatttgacagtgggatgcagaggcaccagggcaggggagggattaagatactgtgactgggagtgtgcacagctggaaggggtccgagaaatcactgtctctaatccacccattgtacagacgaggcagctgatgcccaagccggggaaggaactggtgcaggtcatgcagtgataaagccagaaaagactcc

SEQ ID NO: 140122 - DNA, 601 bp, Human
cttcagcattgaatcagaaattgtgatcctgatcattcccgtcgatcactatccaaaagctctgcaggtgagttcagcacatgttgtgaagccatcttgtcactttcaagtttggtgcacctaggagggagtgggcacaaactaggaccgaggaaggatccgtgggtgagggagtggaggcatttgggaagttcagcgggacaggagggagaaaagcaaggcaatctctaaaggactgagcactttgccagtggctgagacctggtgcacatttgacagtgggatgcagaggcaccagggsaggggagggattaagatactgtgactgggagtgtgcacagctggaaggggtccgagaaatcactgtctctaatccacccattgtacagacgaggcagctgatgcccaagccggggaaggaactggtgcaggtcatgcagtgataaagccagaaaagactccagtctcctgagagctgtgtgcccactgtggaggaagatcccatcagagctggtcatgtgggctctagtgtttctttgtcagtctggagacatgtagaaccccactcacgtagacccaagtttcaacatcaaaggcagtg

SEQ ID NO: 140123 - DNA, 601 bp, Human
acgtccagacagtgtaagtttcaagggtccccgcccacacccaggcctcttcttggaccatccaaccccggcgtcttgaccggccaaggtgtcagtcatctaccacacaccaccagtgagtttgagactttgccgcctccaaaaaacatgtccttccctttctttttttttttttagacagggacttgctctgtcacccaggctggagctcagtggcatgatctcagctcactgcaacctccacctcccaggctcaagcgattctcgtgcctcagcctcctaagtagctgggactacaggsgcgcaccaccatgcctggctaatttttgtatttttagtagagacagggtttcaccatgttggccaggctagtttcgaactcctgacctcaagtgatccacctgcctcagcctcccaaagtgctgggattacaggcatgagccaccacacctggcctgactttgattttgacaacaattttgagcagacaagacaagcccaatagaaacatcttgcaagcagttggggttttgttattacatctcagggttggggaagcattggcaatgtgccaaatctatgggagcagattctggagaga

SEQ ID NO: 140124 - DNA, 601 bp, Human
agctattctgtcagcactggcttcttgggaatagcagggagcctaggaatggggtgttcattttcgtcagttctccttgagggctttatggtgagaaacaaggggcctaactgtagaatttagtgcagaaatctaggatggaattgaaaggaaaccctgtgggtgctttctacctctgggcaaacctgggtggccagaatataagttgagctctctttttcttttttttttgagacggagtcttgctctgtcacccaggctggagtgcagtggcgtgatctcggctcactgcaacctccasctcccaggttcaatcgattcttctgcctcagcctgccatgtagctgggaccacaggtccatatcaccacacccggctaatttttgtattttcagtagagacagagtttcaacatgtgggtcaggctggtctcgaactcctgacctcaggtgatccacctaccttggcctcccaaagtcctattataggcatgagccaccatgcctggcctgatctctttttttttcttttcttttaactttttattttgaagtaatttttgtaatttgtaaaaataccctttagctttcaaaaacttttt

SEQ ID NO: 140125 - DNA, 601 bp, Human
attatttttattttttattttattattattatttttttgagagtttcactctttcgcccaggctggagtgcagtggtgcgatcatggctcactgcaacctttgcctcctgggtgcaagcaatcctcctgcctcagcctcccaagtagctgggaccataggtgcatgccaccatgcctggctaatttttaaatttttttgtagagacaggggtctcactttgttgcccaggttggtcttgaatgcctaggctcaagcagtcctccagccttggcctcctccctaagtgctgagattacaaaygtcagccatcatgcctggcctaaaaaagttattttcatggtggctcatgcctgtaatcttgaactgtgcgtgtgtatgtgtgtgtgtttctatttagagctataactgaagatcatgcccttagaaatgactgtgatccaggcctggagcattggctcacgcctgtaatcccagcactttgggaggccgaggtgggtggatcacaaggtcaggagattgagaccatcctggctaacacggtgaaaccccgtctgtactaaaaatacaaaacattagctgggcatggtggcgggcacctgt

SEQ ID NO: 140126 - DNA, 601 bp, Human
agtgagccaagatcgcaccactgcactccagcctgggcgacagagcaagactgtctcaaaaaaagaaagaaagaaagaaatgactgtgatccaataagacatatggataacgtctcttttactgactctttctactgaggatattggccatttgttatttggtattttatagatattccttaccttataaactgttataagtttaaaatattgtaagttgaaatgggtattttgtagacataggatgcaaatacacaaaacactatatccaaaaattgctcacagcagaacagtgtaaagyatctgttgtttcctctggtgattgtgtggctgactgggagctgcggctcattgtcactgcccagcatcaggagtgggtttggtaccacatattgctagcctgggaaaagatcaaatttcaaagcatagtttccactgaatgcctgttgcttttgcaccatcataaagttgaaaaattttaagttgaaccatcataagtcagggaccatcatctgtacataaagatccctaagactgatttttcttttttttttttcttttcttttctttttttctgagatggagtctcgctctgtcgctc

SEQ ID NO: 140127 - DNA, 601 bp, Human
attgtcactgcccagcatcaggagtgggtttggtaccacatattgctagcctgggaaaagatcaaatttcaaagcatagtttccactgaatgcctgttgcttttgcaccatcataaagttgaaaaattttaagttgaaccatcataagtcagggaccatcatctgtacataaagatccctaagactgatttttcttttttttttttcttttcttttctttttttctgagatggagtctcgctctgtcgctcaggctggagtgcagtggcgcgatctcggctcactgcaagctccgcctccygggttcatgccattctcctgcctcagcctcctgagtagctgggactatagtcacccgccaccatgcccagctaatttttttttgtatatttagtagagagggggtttcaccgtgttagccaggaaggtctcgatctcctgacctggtgatccacccacctcggcctcccaaagtgctgagattacaggtgtgagccaccgcgcctggcccaagactgatttttcttaaagatcagtgtctagaacaagtttctgatgagctgccatttccttttgacaatgagagtaacccagccactga

SEQ ID NO: 140128 - DNA, 601 bp, Human
ttaggtggacgtgacaggctgttaccgcctgcaggaggcgctgaggtcctgagcaaagacagtggcagtggggaggcaggaaggcagctgtcaaggggacttagtcacttaaaacagaagcgaaggatgtagagacagaggatggctgggttctccagctaggctagccaagacagaatgtagaaggaacaggtttgggggaagtgggtttgtggttggacaggttgggttttgaggtacctgttaagatatccaggatcagagcccatcagacagctgctaaagcacactggagctaaayagggattcttctccctattttacagagaaactgaggctcagtgaagagagacatactatttgcccaatgtcacactgctgattagtaaaagaaattcagggcttgaagtctctttcactttcctttacataattctgcttccttccaaggaaggagctgagaggggcttcccacatcctgggaatcatcccttacttcaggcatgtcttggggccagagctgggaatcttgagcctagaaaaaagagagttaagggaccagaccaaatcagagccagaggctgtggtttgaaggggttcc

SEQ ID NO: 140129 - DNA, 601 bp, Human
aagtgggtttgtggttggacaggttgggttttgaggtacctgttaagatatccaggatcagagcccatcagacagctgctaaagcacactggagctaaatagggattcttctccctattttacagagaaactgaggctcagtgaagagagacatactatttgcccaatgtcacactgctgattagtaaaagaaattcagggcttgaagtctctttcactttcctttacataattctgcttccttccaaggaaggagctgagaggggcttcccacatcctgggaatcatcccttacttcagkcatgtcttggggccagagctgggaatcttgagcctagaaaaaagagagttaagggaccagaccaaatcagagccagaggctgtggtttgaaggggttccactctgttggcaggatccggatcacctgtttgaaaccatctcccaagccatgctgaatgctgtggaccgggatgcagtgtcaggcatgggagtcattgtccacatcatgtgagtatgggctgggagaagtctagaagctctgcagacaccctgcctctctcccttctccacgagcatacaccccattttcccagccccctg

SEQ ID NO: 140130 - DNA, 601 bp, Human
aggaaaaagcccatgcaattgctgaatcacaatcacagtgctacccagccctcaaatggatattaatggtgaacaaaaaacaatttctaacccaaaggctaaaaatctactggacagcatcgtggggtggatacaggaataggagtaactgtaatacagggctgacaaatcaacatcacatttgtaaatcaagggatggccaggaactctttagaagagcaagacatcccagggtagagacagattaggcaggcacaggaaaaaagtgcaagcgctgaagttaaaatgcaccaaacaccacaagttctaaagccagacaggacacaagctgcaagtattttgaggcctccccctttaaatcatacacctgacaggaaaaattttgagtggggagcctgagattaagtaatgagcaattagccgggtgtggtggtgcacacctatgatcccagctactcgggaggctgaggcaggacaatctcttgagcccgggaggtggaggttgcagtgaacagatatgtgccactgcactccagcctgggcaacaagtgagactccatctcaaaaacaaataataaaataagcaacgggcagcttgttt

SEQ ID NO: 140131 - DNA, 601 bp, Human; identical to SEQ ID NO: 34017

SEQ ID NO: 140132 - DNA, 601 bp, Human; identical to SEQ ID NO: 34018

SEQ ID NO: 140133 - DNA, 601 bp, Human; identical to SEQ ID NO: 34019

SEQ ID NO: 140134 - DNA, 601 bp, Human; identical to SEQ ID NO: 34020

SEQ ID NO: 140135 - DNA, 601 bp, Human; identical to SEQ ID NO: 34021

SEQ ID NO: 140136 - DNA, 601 bp, Human; identical to SEQ ID NO: 34022

SEQ ID NO: 140137 - DNA, 601 bp, Human; identical to SEQ ID NO: 34023

SEQ ID NO: 140138 - DNA, 601 bp, Human; identical to SEQ ID NO: 34024

SEQ ID NO: 140139 - DNA, 601 bp, Human; identical to SEQ ID NO: 34025

SEQ ID NO: 140140 - DNA, 601 bp, Human; identical to SEQ ID NO: 34026

SEQ ID NO: 140141 - DNA, 601 bp, Human; identical to SEQ ID NO: 34027

SEQ ID NO: 140142 - DNA, 601 bp, Human; identical to SEQ ID NO: 34028

SEQ ID NO: 140143 - DNA, 601 bp, Human; identical to SEQ ID NO: 34029

SEQ ID NO: 140144 - DNA, 601 bp, Human; identical to SEQ ID NO: 34030

SEQ ID NO: 140145 - DNA, 601 bp, Human
aggtgacattggcgaacacttccatcccctacttgaacatcacagtttgtcctcacaacagctgaatgaagcaagcactttttatccccatttaaagtgcttttatcccccatttaaagtgcatttaaagtacagatgaggaaactggggcttagggaagggaagagactctcaaggtgggatggctagggcaagacaggctctaacccaatttcgggcagtaaggcgagcacgtttctttccactgtcccctgctacaaaagagggggctttcctcgtggtctttcaagaatgagtgacstgtctgttgtatttggggttgaggactttgttctgtttaccttcccttatttctctcctcaaaatcgacagtttccttctctcacctgggtacttctaggctttgggggctccttcctccagtggttccttcaagaaaactctctggaagcctcatgccagcccttttggtgttcattttttgagaatgggcaggggtgcataaagggtgttgcctgggccagatagatctcttccctgcctggtgagggaggctgtggagactgtttcttttgagtatagtcatcttgagtatagtgca

SEQ ID NO: 140146 - DNA, 601 bp, Human
ggggtgcataaagggtgttgcctgggccagatagatctcttccctgcctggtgagggaggctgtggagactgtttcttttgagtatagtcatcttgagtatagtgcagctctgttccttctgcactgggacctgcagcagctgacggtagggagggagtatagaggtggggtcccccatcccagagcctggaggaatacctcccctcccatcccatcccatcccatcccatgcaatcccagaaagtacagcaattttccatcttccaattgaccttgtgagtagcaagtacaaactcagtrttggggcctcacagccgcctccacctgcgaggtggaggctttggaaggtcaagtcacttataagtaatgatgtaatgataatttctttttcttttaatttgcttttttttttttttttgagtcagaggactcatcacccaggttggagtgcagtggcgcgatcttggctcactgcaacctccgcctcttggattcaagcgattcttgtacctaagcctcctgagtagctgggattacagatgcatgctaccatgcccagctaatttttgtattttttagtagagaccggggtttcaccgt

SEQ ID NO: 140147 - DNA, 601 bp, Human
cccaggttggagtgcagtggcgcgatcttggctcactgcaacctccgcctcttggattcaagcgattcttgtacctaagcctcctgagtagctgggattacagatgcatgctaccatgcccagctaatttttgtattttttagtagagaccggggtttcaccgtgttggccaggctggtctcgaactcctgacctcaagtgatgcaccgcctcagcctcccaaagtgctgggattacaggtataagccacctcgcccagccttaattcgattttttttttaattttaacttttttttttttaacttcaaccaactcaagtaatggtaatttcagtgttcacatgaatttaggatctgacttgagtccagttttttttttttttctcttaattctcagtcaggaggctctttgcagctgaagttcacccagggaaaaaaaaatttgggacttgtctaaaaagggggcttaaacctccagccttacccctaaccttaccccaaaccttccttgcttccttaccccctcccgttccctggctaagaccactctttcatctttttaggggctcgctcattcagcagacatttattgcctgcctgc

SEQ ID NO: 140148 - DNA, 601 bp, Human
ggaaaaaaaaatttgggacttgtctaaaaagggggcttaaacctccagccttacccctaaccttaccccaaaccttccttgcttccttaccccctcccgttccctggctaagaccactctttcatctttttaggggctcgctcattcagcagacatttattgcctgcctgctgctataatacatactaacctgcaccaggtgctgggaaaacagattcctgataaaaatctcaagcccaagaagcaacatgaagttgtcccttctggaagaaggagggcactgggcaggttatctgggtaraggaagggttgcagctctgtcctggcccctccttcagctgccccttctcttctattaatttctactgttcctcttccccctaccaacccctcccacccccacaagggaaatgggacattcttcgaattcttaagggctcacacaagccctggttctctgccacttcctccctccattgggtagtggggtggggttcagagaagccagggcagttaacccctccgttgctggaccacctcaggctagattctgagcctccgccccagcacgcagaagtctgaccgagccttggagcccagt

SEQ ID NO: 140149 - DNA, 601 bp, Human
ttgcagctctgtcctggcccctccttcagctgccccttctcttctattaatttctactgttcctcttccccctaccaacccctcccacccccacaagggaaatgggacattcttcgaattcttaagggctcacacaagccctggttctctgccacttcctccctccattgggtagtggggtggggttcagagaagccagggcagttaacccctccgttgctggaccacctcaggctagattctgagcctccgccccagcacgcagaagtctgaccgagccttggagcccagtgactcaagyagcctagaattcagtgagcactgggagctggagaaaaatcagaggcttgtccttgttttctctgcgttttatcagcctcatccaaagttccagcttactgtttttactgtcttcttgggaagctgccacaaggttgggtggagggctcctgcagggactgggggagccagaagaggcagatcaaggtttcttctctgggtgatgcttccaacttgcagaggcagaggttcccctgtctccctcctggcctccagccaaaagaagcaggttggcctctccatgtttcctccagcttttgta

SEQ ID NO: 140150 - DNA, 601 bp, Human
tccccctaccaacccctcccacccccacaagggaaatgggacattcttcgaattcttaagggctcacacaagccctggttctctgccacttcctccctccattgggtagtggggtggggttcagagaagccagggcagttaacccctccgttgctggaccacctcaggctagattctgagcctccgccccagcacgcagaagtctgaccgagccttggagcccagtgactcaagtagcctagaattcagtgagcactgggagctggagaaaaatcagaggcttgtccttgttttctctgcrttttatcagcctcatccaaagttccagcttactgtttttactgtcttcttgggaagctgccacaaggttgggtggagggctcctgcagggactgggggagccagaagaggcagatcaaggtttcttctctgggtgatgcttccaacttgcagaggcagaggttcccctgtctccctcctggcctccagccaaaagaagcaggttggcctctccatgtttcctccagcttttgtagccctagcctctgccatgcctcattgacctttggcccagttgggatgtttcctgggaaggagccta

SEQ ID NO: 140151 - DNA, 601 bp, Human
accaaagaggatttattgagctcttgctatgtgccagacgctaggccgagtgtttgctgtcattccctcctgctttcttactttttttgtttttattttgctttggttttttggagacaaggtctccaaaaaaacttcgtcctgctcagtcacccaggctggagtgcagtggagtgatcatggctcactgcagcctccacctcctgggtttaagtgatcctcctgcctcagcctccctagtagctgggaccacaggcatgtggcgccatgctaatttttaagttttttgtagagaggaggkcttgtcatactcttggcctcaggtgatctacctgctttagcccagcctcctcctgttttcttcctgcctctggtcttatccttgagtgacattcaggttcctgaatcctgggtttaccagggtacagctttctgccatttctgttctggtcttgctttgtggaccacaggcctggcttccttctctgaagcatcacgtgctccatgctgggccaagcccagtgcaggacccgtaggggcacgtggtttcttctggcactttgccagggagttgggcccacccagtgagtgtgtgagtttg

SEQ ID NO: 140152 - DNA, 601 bp, Human
ctggcttccttctctgaagcatcacgtgctccatgctgggccaagcccagtgcaggacccgtaggggcacgtggtttcttctggcactttgccagggagttgggcccacccagtgagtgtgtgagtttggtgtgcagggaggcctctatgttctgcctgtctctggctagtctctgaggggagctaggatcttgcagggggctggtcaagaaagaagaaagctatctttccctgtggtttctcaagattcagatttaagctctagaaagtgactgtaaagtaggcagtgaaaaggcctctyctgtttctgtccttgcatcagacttgtttgggggagaggcaggggagagaacataggccagagctcactgccagcccacctggtgtggcggacccccacatgcgtgcagttacacacatgcctggtgtgtaggcagacacccacgccggtgctggggcgggggaggaggacttgggagctggactgaatgggctgtgtttgtgtttccaccttcaggactgcagccatgcagccaatgctgtggcaaggttgagggtgcactcccggcttctgcacaatagccagtggtggaggaagaac

SEQ ID NO: 140153 - DNA, 601 bp, Human
ttcttctggcactttgccagggagttgggcccacccagtgagtgtgtgagtttggtgtgcagggaggcctctatgttctgcctgtctctggctagtctctgaggggagctaggatcttgcagggggctggtcaagaaagaagaaagctatctttccctgtggtttctcaagattcagatttaagctctagaaagtgactgtaaagtaggcagtgaaaaggcctcttctgtttctgtccttgcatcagacttgtttgggggagaggcaggggagagaacataggccagagctcactgccagsccacctggtgtggcggacccccacatgcgtgcagttacacacatgcctggtgtgtaggcagacacccacgccggtgctggggcgggggaggaggacttgggagctggactgaatgggctgtgtttgtgtttccaccttcaggactgcagccatgcagccaatgctgtggcaaggttgagggtgcactcccggcttctgcacaatagccagtggtggaggaagaactgctaatagaattctttttgtttgttttttttgagacggagtctctgtcgctcaggctggagtgcagtggtgcga

SEQ ID NO: 140154 - DNA, 601 bp, Human
agggtgtggtctgtgtcagacaaggctgggtgcttaagtgtctctggattctagcaaactgtctttaatcccagctgcttttaaaaggtggggcagggttgggtgcagtggtttatgcctgtaatcccagcactttgggagactgaggagggtggatcgcttgaggccaggagttcaagaccagcctcatctctacaaaaaatgaaataaattagccgagtgtggtggtgtgggcctgtggtcccagttacttgggaggctgaggcaggaggattacttgagtctgggaggttgaggctgyagtgagccctgattgcaccacagcactccagcctggcaacagagggacactctgtctctaaaaaatgtaaaaatgaaaataaaaataggtggagcaggagtaggcaaaccccgcactggggcccagggctttccctccttcccaaaattgtctgcctctaactggaaaaatggggactagggatgacagtgtgggggagggcaagtgcaaatggccagcccaagtagccaaatgtggcctccaggtagccctcccacctcacttacccccaaatccctgtccttcaggcctcctggagcc

SEQ ID NO: 140155 - DNA, 601 bp, Human
tcccagcactttgggagactgaggagggtggatcgcttgaggccaggagttcaagaccagcctcatctctacaaaaaatgaaataaattagccgagtgtggtggtgtgggcctgtggtcccagttacttgggaggctgaggcaggaggattacttgagtctgggaggttgaggctgtagtgagccctgattgcaccacagcactccagcctggcaacagagggacactctgtctctaaaaaatgtaaaaatgaaaataaaaataggtggagcaggagtaggcaaaccccgcactggggccyagggctttccctccttcccaaaattgtctgcctctaactggaaaaatggggactagggatgacagtgtgggggagggcaagtgcaaatggccagcccaagtagccaaatgtggcctccaggtagccctcccacctcacttacccccaaatccctgtccttcaggcctcctggagcctgagggatcactttgcttcctaacacctacgttttacagatgaggaaacaggcccgcgtttccatgccttactcaacttgcagaattgtttctcttctatattaccgacaggggcaggcttttt

SEQ ID NO: 140156 - DNA, 601 bp, Human
ccttcccaaaattgtctgcctctaactggaaaaatggggactagggatgacagtgtgggggagggcaagtgcaaatggccagcccaagtagccaaatgtggcctccaggtagccctcccacctcacttacccccaaatccctgtccttcaggcctcctggagcctgagggatcactttgcttcctaacacctacgttttacagatgaggaaacaggcccgcgtttccatgccttactcaacttgcagaattgtttctcttctatattaccgacaggggcaggcttttttttttttttttttcttttcattttgtgtgcaatctgatggctggtaagttcttcctcaagtctagccttgatctttttgactgctcttttttttcctctgattgaacaatgcctccttgttgcttcctatcgccaccacttcagccccttaggcctgaggggatggacgggtgagaaactgggttagcagggagccctcccttcccgcctgtgggcagccttcccagtaggggcttttggaatccgcagctctttctagaggcaggatgtgggggctgttttttttttttccttttggtaaaaccaaaagctc

SEQ ID NO: 140157 - DNA, 601 bp, Human
cacctcacttacccccaaatccctgtccttcaggcctcctggagcctgagggatcactttgcttcctaacacctacgttttacagatgaggaaacaggcccgcgtttccatgccttactcaacttgcagaattgtttctcttctatattaccgacaggggcaggcttttttttttttttttttcttttcattttgtgtgcaatctgatggctggtaagttcttcctcaagtctagccttgatctttttgactgctcttttttttcctctgattgaacaatgcctccttgttgcttcctatygccaccacttcagccccttaggcctgaggggatggacgggtgagaaactgggttagcagggagccctcccttcccgcctgtgggcagccttcccagtaggggcttttggaatccgcagctctttctagaggcaggatgtgggggctgttttttttttttccttttggtaaaaccaaaagctccttgttgcttttgttgatgtctttttgttcctccttgaacacaaagctgtggtttttgaagagatccaagcctggaacgggcgaggctctgtgtagaaagggcgctgggctttcgggt

SEQ ID NO: 140158 - DNA, 601 bp, Human
cacccagaggtcctcacagataacccctctcctgggacacagggcctcttcagtatcatatccttttttttttttttttttaatttttattttttgagacagagtttcgctcttgttgcccaggctggagtgcaatggcgcaatcttggctcactgcaacctctgcctcctgggttcaagcggttctcccgcctcagcctcccaagtagcggggattacaggaggccgctaccatgcctggctaatttttttgtatttttagtagagacggtgtttcaccatgttgtccaggctggtgtcraactcctgacctcaagtgatccgcccacctcagcctcctaaagtgctaggattacagcgtgagccaccacgtccggctttttttttttttttttttttgagatggggtctctctctgtctcccaggtggaagtgcagaggtgtgatctcggctcactacaacctccgcttcccgggttcaagggattttcctgcctcagcctcctgggtagctgggactacaggcgtgtgtcaccacgcccggctaatttttgtatttttagtagagacagggttttgccacgttggccagactggtctt

SEQ ID NO: 140159 - DNA, 601 bp, Human
ccacgcccggctaatttttgtatttttagtagagacagggttttgccacgttggccagactggtcttgaactcctgacctcagatgatccgcccgcttcggcctcccaaagtgctggcatttcgtgcccgacctgtatcatatacctttgaaaagttcagagggataggcagctcctaagcaggtgtggctgagaggccccagaatatctctcataatggccgagcttggaaacgagttgggtttgaaggatgaagtgctttgttttgcacccaacctgccaagcacatctttccccagarctgagtgctggaggtggctggggtccatctggcctccccttcgctgtctgggcagctgtggtgtagaggagaatgccttgggcaaggtctctgtccttgacactggacctcagtttcttcatctgtaaaacggcacaatgagaatgccagcctaaagctgtgtggtgggttttgagagagaatgtgcacaggactcagtgtgccaagatgttgctttgtgtctctgtaaattgtcctgaagcccgaggctgctgccaatagctgcctgtttgccctgccctatccctgtccagtccctgt

SEQ ID NO: 140160 - DNA, 601 bp, Human
gccaagatgttgctttgtgtctctgtaaattgtcctgaagcccgaggctgctgccaatagctgcctgtttgccctgccctatccctgtccagtccctgttcctgccccgcttcttcctgtcctacatgcctctccctgcaaactccccagagcagctgatagcagggaggaagggtgggtggggcacctgcagagagcccaccacccacttggaatgattaacaaggggccagtacaggctggcctatgggacaaaggacagctgtgctctggactctgccctgcacccagctgatcaccctgtccctcattcctcgccatggcccagtctgtcatggggttgggttccagcggagtcaccagctgggacgggtggcccctggtctgtcttagcacccatgttggcatgcacacatttccagccatccctgctgggatctaggggtaatggatgggatgggcaggaagggaaaaggtagaattcccaaaaattgtttctggagggaggtcaaatcagttggagctttctttgaagcccggcatgctggtggggggaggggtgcagcactgatgttctcatgcctttgcttctagaaacaaa

SEQ ID NO: 140161 - DNA, 601 bp, Human
ttgcctctagccctccccatcaaatgctaaccagcctcatcttctcagaattgagtcttcgagtgctgggccagagctgcccggaggtctcctctcccccaccctgcttttgccacatgtgcctctacttccatgtgcttgcctcaccacagcccctgcccatacagtctgcagaatggctctgatgttgggaggagggtcgtctcgtctctgaagcgctccctcttagggcctcagggcctgccagccctgctagagatcttccctttctggtctctaggaacagactcgtggttgatcrtcccttggcctggaattgtacaggaactttgaagggagctcctcagctgtgggtggccctggctgcacggggacgaccccagacttggccacgtattcatcacaggccacgtctgttgccagctgcggacacctgtgtttgcctttcctcatcttcccttcctctgctggaggaactgcgagtctgggctgacctgggtggccaggacccaggtgagggctgggggacgggcaccgctaggatcatctggatccgggacagtgaaactggcccaagggaaaaaggatttgccaaggtcac

SEQ ID NO: 140162 - DNA, 601 bp, Human
cctggctgcacggggacgaccccagacttggccacgtattcatcacaggccacgtctgttgccagctgcggacacctgtgtttgcctttcctcatcttcccttcctctgctggaggaactgcgagtctgggctgacctgggtggccaggacccaggtgagggctgggggacgggcaccgctaggatcatctggatccgggacagtgaaactggcccaagggaaaaaggatttgccaaggtcacccagtaagtcagtggcagggccagagccctgcactgggccctgtcaagttatgctccyttgattgaggtctccaaatcctgagccctgcccttcacaagtggtggcctcaggggaagtcgcctgtttacaggtagctctgatgcacggccatgtgggcggcaggagaacatgccgagcagaggggcagctcgttcttagctctcgagtgtgtcagttttgggtggaacgtgcctaggaagaggtcccaggaggccatctatggcttacctgggtgcagcctgtgagtcagggatctgcaggggtcatagctgtggtgggctgtggtcacccagggctaaaaatggcctgacgggctcc

SEQ ID NO: 140163 - DNA, 601 bp, Human
tttgtttattcaacaaatatttactgagcatcgcctactattctaggaacttgagataaatcaatgaacaaaagagaccccaaaatccctcccttcatagagaagtagtggagagagaagacaatacattgatgtgataaataagttaattatgaagactgctaagggagaagtgcctggtgccagcacaccgtttcctcctctgaaatgagggagttggaccagagtcttctggaggtctctgcaggctctgagggttgccgtggcttcggctgcctccaagccaggccctcttcctgggaccaggctgtgctgggcctggaaattggcggctaagttcagcatgaactgaagaaatcgtctgggcgcaaatctggatccctgtgtgtcttggccatgttgtttaacctctctggcctcagttctcccatctgtcaaaggggtacgctgaataccagtcacacaggtggctgtgagaattcggtgaactagggcacataagcccttagcacagggagaacattcactgtttgtttttttttgttttgttttgttttttctttttgagacgtagtctggctctgtcacataggctggagtg

SEQ ID NO: 140164 - DNA, 601 bp, Human
gtcttgaactcctgacctcgtgatctgcccgcctcggcctcccaaagtgctgggattacaggcatgagccactgcgcccggcctaattcactgttgttactatagattgagcagccctaatccaaaaatccagagtctgaagagctccaagatgcaaagctttgagtgccgacgtgatgccacaagggaaaattccacacctggcctcatgtgataggtcataggtcaaaaagcagtcaataattttgtttcatgcataaaattatttaaaatattgtataaaattaccttcaggccatgygtatgaggtatataggaaatggtcccatccccaagatgtctcagtatggatattcaaatattctaaaatctgagaaaaaatccaaaatctgaaacacgtctggtcctgagcatttccaataagggatactcaacctgtattttacctgtcaccctcaggtgacctccttttttgtcctcaagctggccttcccacctaccctccagttaggttggaccttgttaaccgtttgaaataccactttaaccgtgtgttttctctctcaccacttcctccaggaagtccccctggatatgtgtg

SEQ ID NO: 140165 - DNA, 601 bp, Human; identical to SEQ ID NO: 34031

SEQ ID NO: 140166 - DNA, 601 bp, Human; identical to SEQ ID NO: 34032

SEQ ID NO: 140167 - DNA, 601 bp, Human; identical to SEQ ID NO: 34033

SEQ ID NO: 140168 - DNA, 601 bp, Human; identical to SEQ ID NO: 34034

SEQ ID NO: 140169 - DNA, 601 bp, Human; identical to SEQ ID NO: 34035

SEQ ID NO: 140170 - DNA, 601 bp, Human; identical to SEQ ID NO: 34036

SEQ ID NO: 140171 - DNA, 601 bp, Human; identical to SEQ ID NO: 34037

SEQ ID NO: 140172 - DNA, 601 bp, Human; identical to SEQ ID NO: 34038

SEQ ID NO: 140173 - DNA, 601 bp, Human; identical to SEQ ID NO: 34039

SEQ ID NO: 140174 - DNA, 601 bp, Human; identical to SEQ ID NO: 34040

SEQ ID NO: 140175 - DNA, 601 bp, Human; identical to SEQ ID NO: 34041

SEQ ID NO: 140176 - DNA, 601 bp, Human; identical to SEQ ID NO: 34042

SEQ ID NO: 140177 - DNA, 601 bp, Human; identical to SEQ ID NO: 34043

SEQ ID NO: 140178 - DNA, 601 bp, Human; identical to SEQ ID NO: 34044

SEQ ID NO: 140179 - DNA, 601 bp, Human; identical to SEQ ID NO: 34045

SEQ ID NO: 140180 - DNA, 601 bp, Human; identical to SEQ ID NO: 34046

SEQ ID NO: 140181 - DNA, 601 bp, Human
ggtagtggcttattattacgagtctaacaccttttggctgaggcctctgctttgagttggggacttctgatcagggtctttctgctgactccctgtccctgtctcctgactggttgctgcctcagaggggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccaggaccagatcagtaaygtgagctcttgccctgccctgcggcatccctgctgccctctgtttggtccccttcctgccagcctggcagacgcaagcctggcagatgtgaatgaggccagtgcctccactgcccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtat

SEQ ID NO: 140182 - DNA, 601 bp, Human
gttgctgcctcagaggggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccaggaccagatcagtaacgtgagctcttgccctgccctgcggcatccctgctgccctctgtttggtccccttcctgccagcctggcagacgcaagcctggcagatgtgaatgaggccagtgcctccactrcccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactggggggcggggagcacctggcctcccctggtctgcgcctgggtgctgacattgcagtcatttccgccct

SEQ ID NO: 140183 - DNA, 601 bp, Human
caaaaagatgctggttgcagacttactgtgaatgggttttgcaactggactgttgacctgcagtttgaagttggtggcctgaggaaatggcatgcttccctttggctagcaggggatgcctagggcgggcactctaatcctccttcccctccaacttccagaggcctgtcacagttgactctttatatgctagggcctggcctcacgccctggagcttccctttggctcagaccctgcaaagggtaagacccttaggtctgtgtttcagagctctcggcttggaaagtgggggagggggargatggtcttagattatggggaaaacccggaatggttcacagaactggaatgtcggctcttcagcctctgcggcttttcatgtagaggctctagtcttttatcagtgacacttgctcccaatgtgcaaccccagctccctggctgttcactcattgcttcaccctgtgggttttggaggaggggagacaagcccagtcatccctgcttccctttctggaaggcttccagaacactccacactcagcctaagccacctcctcttcttccctcccccagttagaggtgttaatatcctagtga

SEQ ID NO: 140184 - DNA, 601 bp, Human
gagacggagccttggtttatcacccaggctggagtgcagtggcgcaatctcggctcactgcaacctccgcctcccgggttcacgccattctgctgcctcagcctcgtgagtagctgggactacaggcgcccgccaccacgcccggctaatagtttttgtatttttagtagagatggggtttcgccgtgttagccaggatgatcttgatctcctgaccttgtgatccacccgcctcggcctcccaaagtgctgggattacaggcgtgagacaccgagcccagcctatttttatttttgagasagggtttcgctccgtcatccgggctggagtgcggtggtgtgttcacggctcagtgcagcctgaatcttctgggatcaagccattctcccacctcagactccgagtagctgggaccacaggtgtgcaccaccatgcccagctaatttttcttttttttgcagagacactatcttgctatgttgcccaggctggtctcaaactcctggattcaagttatcctcccgcctcagcctcctaaagtgctgggattataggggtgagccacctcacctggcctcccaggggagctttttttttttt

SEQ ID NO: 140185 - DNA, 601 bp, Human
tgaggtaggaagagatggtaagggcccagatcctagcttctgtcattctggggccaggcagggctctttgagcctcagtttcctcatttgtaaaaatgggacagtaggccctactttgacaggtggttgcaaggaacatgccaagtgcttggcatgggataaatgatatcactcttattatcatcattattatttttgagacaagattgcccaggctggagtacagtggcacgatcataggtcactgcagcctcgaactcttgggcacaagtggtcctctcccgtcaacctcctgagtagytggtactacaggcatatagcaccatgcccagctaattgttattttttttgtagagagagggtcttgctatgctgcccaggctggagtgtagtcacgtgatcacagctcactgcagccttgaactcctgggtttaagtgaaccctggcctaagactcccaggttgctgggattacaggcacacgccatcacacccagttatgttgtcaatgttatcaatactttaaaggcacacttgtctgctttctacactgttgccggagaagggtcataaagtgaagtttggcagaaaagtttggcca

SEQ ID NO: 140186 - DNA, 601 bp, Human
agtcacgtgatcacagctcactgcagccttgaactcctgggtttaagtgaaccctggcctaagactcccaggttgctgggattacaggcacacgccatcacacccagttatgttgtcaatgttatcaatactttaaaggcacacttgtctgctttctacactgttgccggagaagggtcataaagtgaagtttggcagaaaagtttggccattgtctagtactgagaatgtgtggaagtgaggaaaggggccagtatattacacatctatggtgagtagttgtgtcatcattaaaggcatytgaagagttgccttttgatgggtccatgctatgggataaaggttacatgttaggaatcctggccttttgtcatgagctctagcagtgttcaagtatggaaaactttagtcactttactggagcctcttcttttatttacttacatattgattttctgtatacaattttgtgtccttaaaactttttttatgtgtgaaatatgacacatagtaacatatacaataaacacctgtttcaccaggcaggtataccatacattgtattactgtatgcctgtcaagagcccagtgttcacagtgt

SEQ ID NO: 140187 - DNA, 601 bp, Human
ttaagtgaaccctggcctaagactcccaggttgctgggattacaggcacacgccatcacacccagttatgttgtcaatgttatcaatactttaaaggcacacttgtctgctttctacactgttgccggagaagggtcataaagtgaagtttggcagaaaagtttggccattgtctagtactgagaatgtgtggaagtgaggaaaggggccagtatattacacatctatggtgagtagttgtgtcatcattaaaggcatctgaagagttgccttttgatgggtccatgctatgggataaagsttacatgttaggaatcctggccttttgtcatgagctctagcagtgttcaagtatggaaaactttagtcactttactggagcctcttcttttatttacttacatattgattttctgtatacaattttgtgtccttaaaactttttttatgtgtgaaatatgacacatagtaacatatacaataaacacctgtttcaccaggcaggtataccatacattgtattactgtatgcctgtcaagagcccagtgttcacagtgttaaaaatataactcccatgtagtaagtacttatcatatcttt

SEQ ID NO: 140188 - DNA, 601 bp, Human
ttgtgtccttaaaactttttttatgtgtgaaatatgacacatagtaacatatacaataaacacctgtttcaccaggcaggtataccatacattgtattactgtatgcctgtcaagagcccagtgttcacagtgttaaaaatataactcccatgtagtaagtacttatcatatctttatttaattatgagggaaccagctagagattaaaactggggaatatgagaggcagaggtaaatgctagtctgtgaaagaaagtgctggggccgggcgaggtggctcatatctgtaaccccagcackttgggaggccgaagcgggcagatcacctgaggtctggagttcaagaccagcctggccagcatggtgaaaccctgtctctactaaaaatacaaaaattagccaggtgtggtggtgcacacctgtagtcccagttacttgggaagctgaggcaggacaattgcttgaacccgggaagtggaggttgcagtgagctgagactacaccactgcactccagcctgggcaacagagcaagactccgtctcaaaaataaaaaaaaaaaaaggaaaaaagagagtactggatacatttagctacagaa

SEQ ID NO: 140189 - DNA, 601 bp, Human
atgctagtctgtgaaagaaagtgctggggccgggcgaggtggctcatatctgtaaccccagcactttgggaggccgaagcgggcagatcacctgaggtctggagttcaagaccagcctggccagcatggtgaaaccctgtctctactaaaaatacaaaaattagccaggtgtggtggtgcacacctgtagtcccagttacttgggaagctgaggcaggacaattgcttgaacccgggaagtggaggttgcagtgagctgagactacaccactgcactccagcctgggcaacagagcaagaytccgtctcaaaaataaaaaaaaaaaaaggaaaaaagagagtactggatacatttagctacagaaatggttaagggcctaccattagttacacattggctattgtcctacaggaaaataaaaccataaactttgaagatatctttgctgcaggcagaaatgctttgcatctcagttggccagaaataatgagcattttatattctgtaatgagcttcagtctttagagtctgggcctaatcaatagtaaatagtcaaacaaagttttgtccccagagtaaaatactctgaaggcaggtttg

SEQ ID NO: 140190 - DNA, 601 bp, Human
ggccgggcgaggtggctcatatctgtaaccccagcactttgggaggccgaagcgggcagatcacctgaggtctggagttcaagaccagcctggccagcatggtgaaaccctgtctctactaaaaatacaaaaattagccaggtgtggtggtgcacacctgtagtcccagttacttgggaagctgaggcaggacaattgcttgaacccgggaagtggaggttgcagtgagctgagactacaccactgcactccagcctgggcaacagagcaagactccgtctcaaaaataaaaaaaaaaaaaggaaaaaagagagtactggatacatttagctacagaaatggttaagggcctaccattagttacacattggctattgtcctacaggaaaataaaaccataaactttgaagatatctttgctgcaggcagaaatgctttgcatctcagttggccagaaataatgagcattttatattctgtaatgagcttcagtctttagagtctgggcctaatcaatagtaaatagtcaaacaaagttttgtccccagagtaaaatactctgaaggcaggtttgttggacaatcctctagtttgattttga

SEQ ID NO: 140191 - DNA, 601 bp, Human
tgggaagctgaggcaggacaattgcttgaacccgggaagtggaggttgcagtgagctgagactacaccactgcactccagcctgggcaacagagcaagactccgtctcaaaaataaaaaaaaaaaaaggaaaaaagagagtactggatacatttagctacagaaatggttaagggcctaccattagttacacattggctattgtcctacaggaaaataaaaccataaactttgaagatatctttgctgcaggcagaaatgctttgcatctcagttggccagaaataatgagcattttataytctgtaatgagcttcagtctttagagtctgggcctaatcaatagtaaatagtcaaacaaagttttgtccccagagtaaaatactctgaaggcaggtttgttggacaatcctctagtttgattttgaaagcatgtatttttcattataattttagtatgtaattatgtattcttaaacactatagttttgcttttcctgattttgaacacagagtaattttgtgtatcttgcttctcttacacaccattgggtttaaagattcatccatatgtttgtgtgtagcggtagtacatccttttt

SEQ ID NO: 140192 - DNA, 601 bp, Human
acgcctgtatcctaacagtttgggaggctgtggtgggaggattgcttgaggccaggagtttaagacttgcctgggcaacatagcaagataccatctctacaaaaaaaagaaagaaaattagccgtgcatggtggcatccacctgtagtcccagctactcgagcggctgaggtggtaagattgcttgagcccaggagtttgaggctgcagtgagccatgatcacgccaccgcactccagccttggtgacagagcgagaccctgtctctaaaaaataaataaataaaatattgtgagtctctratggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggt

SEQ ID NO: 140193 - DNA, 601 bp, Human
agccttggtgacagagcgagaccctgtctctaaaaaataaataaataaaatattgtgagtctctaatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagaycagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcactccatcctgggcgacagagcaagactgtctcaaaataaataaataaataaataaataaagttaaaaaagaaaaggaaatgagtaatgcatgtaagggcacccaaaaaaagaccctagctggtgagctgatgattc

SEQ ID NO: 140194 - DNA, 601 bp, Human
cctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcacyccatcctgggcgacagagcaagactgtctcaaaataaataaataaataaataaataaagttaaaaaagaaaaggaaatgagtaatgcatgtaagggcacccaaaaaaagaccctagctggtgagctgatgattccacccagagcctgctgttccctcgttcactgtgatgtataatcatgtgaggagcaccgtatggagagtcagacttttattttccaccacagttgggagagcaggggggtcagaaaacagaacatcagctagcagagctttgtcatggaccctaacttgtcatcctg

SEQ ID NO: 140195 - DNA, 601 bp, Human
cccagggcaggcccctgtccattccgtgtctgcacttccctccctggtcacaggttctcaggggcaggctcttttccttagcagaaaggaaacaagggaagctgacctttcccacctcagaacaaaagttggaagggcaggtgcctcgtgagcctggaggcctcaggaggggtgtccccttcccttgtgccctccccgccaccaacaccagtggacaggggtcactaagagagtggggctcgggagactcaccttctgcgctgggtctgtgagaacatcacctggagtgcccctcccagcrgatgctggggtcggttggattttcagcctggccagggttggctgcctcacctcaggaacaggcttagcctgtgctgccacgtgggtgccggtccttgctctggcctgaagggagggggccgggaaaggagggactgatcctgacccaaacccctaagtaaactgccctctgcgtccagactggactcctcccagactctgtccaggcccttaccactgccctccctgtgcccccagcccgggctgcaggaactactggctgttcagccagcaggagcagcaaccatgcaggtgtttccag

SEQ ID NO: 140196 - DNA, 601 bp, Human
accaccatgcctgattaagttttgtattttcagtagagacagggtttcactgtgttggccaggctagtcttgaactcctgacttcaagcaatctgccaacctcgacctcccaaagtgctgggattaaaggtgtgagccaccgcacctggccatctcatactttcacaattcattctttggtgcaagttttacaatatacattctatatttgtcaagtgataacttccatgtaacttataaaatacacataattcaggaagattgtgctaaaatacatttaaccaataggagtatgccgtcrgaatattttggcaaacaagggtcactaagttttttctgtaaagggccaggtaggaggtatctcaggctttgtggccatatggcctctgtggcagcagctcagttctgcagttctgccatgaaagcagccacagataagaggtaattgagtgggtgtggctgtgttccaataaaactttatttctggaggctgaaatttgaatttcagagaaatttcatgtgtcatgaaatattattcctcttttggttcttcttccccccctccaccgccccctgccaagcattaaagaatgtggaaccc

SEQ ID NO: 140197 - DNA, 601 bp, Human
gccatatggcctctgtggcagcagctcagttctgcagttctgccatgaaagcagccacagataagaggtaattgagtgggtgtggctgtgttccaataaaactttatttctggaggctgaaatttgaatttcagagaaatttcatgtgtcatgaaatattattcctcttttggttcttcttccccccctccaccgccccctgccaagcattaaagaatgtggaacccgttcttagcagccggctgtgggctggatttggtccatggaccatagattcccagcttctgctctagaccacccrttctcagacttgaagcctgcttcagacttacctggagagcttttttccaaaatgcatattccagaaccccagccctgattttgtagattttctggaaggccccagaacccgcattctaacaaggagcccagttgagtcagacacaggtagtctggagtccacttttttttttttttttttttttaaacagagtctcagtctgttgcccaggatgcagtgcaatggcgtgatcttggctcactgcgacctctgcctccaaggttcaagcaattctcgtgcctcagccttccgagtagctgg

SEQ ID NO: 140198 - DNA, 601 bp, Human
catattccagaaccccagccctgattttgtagattttctggaaggccccagaacccgcattctaacaaggagcccagttgagtcagacacaggtagtctggagtccacttttttttttttttttttttttaaacagagtctcagtctgttgcccaggatgcagtgcaatggcgtgatcttggctcactgcgacctctgcctccaaggttcaagcaattctcgtgcctcagccttccgagtagctgggatcacaggtgcctgccatcatgcccagctaatttttgtattttcagtagagacrgggtttcaccatgttggccaggctggtctcaaactcctgacctcaggtgatccaccagcctcagcctcccaaagtgctgggattacaggcgtgagccaccgcgcccggccaggagaccacatgttaagaagcaaagctcaagggtctccaggatcctggtctgttctcttcagccagtcctgaggcctggggtgtgtagtgctgtgggagacccctgcatcagaataactggctccttcactaccttccaggagcttccatccagtgggggtgggggacaccacccgccaacagcacagc

SEQ ID NO: 140199 - DNA, 601 bp, Human
tattccagaaccccagccctgattttgtagattttctggaaggccccagaacccgcattctaacaaggagcccagttgagtcagacacaggtagtctggagtccacttttttttttttttttttttttaaacagagtctcagtctgttgcccaggatgcagtgcaatggcgtgatcttggctcactgcgacctctgcctccaaggttcaagcaattctcgtgcctcagccttccgagtagctgggatcacaggtgcctgccatcatgcccagctaatttttgtattttcagtagagacagsgtttcaccatgttggccaggctggtctcaaactcctgacctcaggtgatccaccagcctcagcctcccaaagtgctgggattacaggcgtgagccaccgcgcccggccaggagaccacatgttaagaagcaaagctcaagggtctccaggatcctggtctgttctcttcagccagtcctgaggcctggggtgtgtagtgctgtgggagacccctgcatcagaataactggctccttcactaccttccaggagcttccatccagtgggggtgggggacaccacccgccaacagcacagccc

SEQ ID NO: 140200 - DNA, 601 bp, Human
attccagaaccccagccctgattttgtagattttctggaaggccccagaacccgcattctaacaaggagcccagttgagtcagacacaggtagtctggagtccacttttttttttttttttttttttaaacagagtctcagtctgttgcccaggatgcagtgcaatggcgtgatcttggctcactgcgacctctgcctccaaggttcaagcaattctcgtgcctcagccttccgagtagctgggatcacaggtgcctgccatcatgcccagctaatttttgtattttcagtagagacaggrtttcaccatgttggccaggctggtctcaaactcctgacctcaggtgatccaccagcctcagcctcccaaagtgctgggattacaggcgtgagccaccgcgcccggccaggagaccacatgttaagaagcaaagctcaagggtctccaggatcctggtctgttctcttcagccagtcctgaggcctggggtgtgtagtgctgtgggagacccctgcatcagaataactggctccttcactaccttccaggagcttccatccagtgggggtgggggacaccacccgccaacagcacagccca

SEQ ID NO: 140201 - DNA, 601 bp, Human
ggccaggctggtctcaaactcctgacctcaggtgatccaccagcctcagcctcccaaagtgctgggattacaggcgtgagccaccgcgcccggccaggagaccacatgttaagaagcaaagctcaagggtctccaggatcctggtctgttctcttcagccagtcctgaggcctggggtgtgtagtgctgtgggagacccctgcatcagaataactggctccttcactaccttccaggagcttccatccagtgggggtgggggacaccacccgccaacagcacagcccagtcccaggtgctwtggaagccctgggttcagcctggagccagggccagcgtcccgaggatgaggtgccgagatggaccttgaaggatgagagaagcctggactgcccttgagtggcgagggtgggctgcctccaggttgaccttaatcccttccctccctaccaccatgtgtccagatgaccttgggcaggtcccttagcctctctggatatcgggatatgacattgacttacctcagagacttgtggggaggattcggcgagctgatatgcatgaagtgtatcaactagggctgctggctggtatctccttc

SEQ ID NO: 140202 - DNA, 601 bp, Human
atggaccttgaaggatgagagaagcctggactgcccttgagtggcgagggtgggctgcctccaggttgaccttaatcccttccctccctaccaccatgtgtccagatgaccttgggcaggtcccttagcctctctggatatcgggatatgacattgacttacctcagagacttgtggggaggattcggcgagctgatatgcatgaagtgtatcaactagggctgctggctggtatctccttcccttgtcttcccccaccaccccagccaggggacagggtgctgctgagggagtgggctgrgagagtcacttctggccttgtcttagggatctgagaacagggcatgggccccgtgtctgggagtgccctggtgcccttcctagtggggttgggcgtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaacctctgcctccc

SEQ ID NO: 140203 - DNA, 601 bp, Human
caggttgaccttaatcccttccctccctaccaccatgtgtccagatgaccttgggcaggtcccttagcctctctggatatcgggatatgacattgacttacctcagagacttgtggggaggattcggcgagctgatatgcatgaagtgtatcaactagggctgctggctggtatctccttcccttgtcttcccccaccaccccagccaggggacagggtgctgctgagggagtgggctgggagagtcacttctggccttgtcttagggatctgagaacagggcatgggccccgtgtctggsagtgccctggtgcccttcctagtggggttgggcgtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaacctctgcctcccaggttcaagctatccttttgcctcagcctcccgcgtagctgggattataggcgcccgtcac

SEQ ID NO: 140204 - DNA, 601 bp, Human
atgtgtccagatgaccttgggcaggtcccttagcctctctggatatcgggatatgacattgacttacctcagagacttgtggggaggattcggcgagctgatatgcatgaagtgtatcaactagggctgctggctggtatctccttcccttgtcttcccccaccaccccagccaggggacagggtgctgctgagggagtgggctgggagagtcacttctggccttgtcttagggatctgagaacagggcatgggccccgtgtctgggagtgccctggtgcccttcctagtggggttgggcrtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaacctctgcctcccaggttcaagctatccttttgcctcagcctcccgcgtagctgggattataggcgcccgtcaccacacccagctaatttttgtagttttagtagaga

SEQ ID NO: 140205 - DNA, 601 bp, Human
ggagtgggctgggagagtcacttctggccttgtcttagggatctgagaacagggcatgggccccgtgtctgggagtgccctggtgcccttcctagtggggttgggcgtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaayctctgcctcccaggttcaagctatccttttgcctcagcctcccgcgtagctgggattataggcgcccgtcaccacacccagctaatttttgtagttttagtagagacagggtttcaccaagttggccaggctggtctcgaactcctgacctcaagtgacccacccaccttggcctcccaaagttctgggattacaggcgtgatccaccgtgctcggcctcaccacccacctttcttgtggtgtagttcttgctgcctcaagaactacatatatcaggcctcaaaacccacctgatatatg

SEQ ID NO: 140206 - DNA, 601 bp, Human
cctcagcctcccgcgtagctgggattataggcgcccgtcaccacacccagctaatttttgtagttttagtagagacagggtttcaccaagttggccaggctggtctcgaactcctgacctcaagtgacccacccaccttggcctcccaaagttctgggattacaggcgtgatccaccgtgctcggcctcaccacccacctttcttgtggtgtagttcttgctgcctcaagaactacatatatcaggcctcaaaacccacctgatatatgcgtgcctgggaatagggaccttgacttttccsctgtcccatatgggcccaggggccggttctgggctggcccaggtggggctagagcagctggatccaggcacatgagatgtgaaagtgtgggccttacgccgcatggagcggctggaggaaggagagagggagcaagggtgccgcagggtcagattgccacagggccagggtgccacagggtcagggtagggccagggtgccatagggtcagagtagggccagggtgccacagggtcagggtagggccagggtgccgctgggccagggtgccgcaggatctggttgccacagggtcagggt

SEQ ID NO: 140207 - DNA, 601 bp, Human
aactcctgacctcaagtgacccacccaccttggcctcccaaagttctgggattacaggcgtgatccaccgtgctcggcctcaccacccacctttcttgtggtgtagttcttgctgcctcaagaactacatatatcaggcctcaaaacccacctgatatatgcgtgcctgggaatagggaccttgacttttcccctgtcccatatgggcccaggggccggttctgggctggcccaggtggggctagagcagctggatccaggcacatgagatgtgaaagtgtgggccttacgccgcatggagcggctggaggaaggagagagggagcaagggtgccgcagggtcagattgccacagggccagggtgccacagggtcagggtagggccagggtgccatagggtcagagtagggccagggtgccacagggtcagggtagggccagggtgccgctgggccagggtgccgcaggatctggttgccacagggtcagggtgccgcaagcacaaggagtcacccgtgattctccagggtctggctcttgggctgagatccaggagaccttggcaggcctgtctttgggagtctggcacagccccagaag

SEQ ID NO: 140208 - DNA, 601 bp, Human
acagggtcagggtagggccagggtgccatagggtcagagtagggccagggtgccacagggtcagggtagggccagggtgccgctgggccagggtgccgcaggatctggttgccacagggtcagggtgccgcaagcacaaggagtcacccgtgattctccagggtctggctcttgggctgagatccaggagaccttggcaggcctgtctttgggagtctggcacagccccagaaggccatctggacagttttcagacctgagaggaggaaagggcttgtgtctggagaaggtgccatggggkatgggaggtggaggaagcctggggccaatcaggatctggatctagcagggaacaccgaggccggtgttctcgtcccaccatgggactcagcctgaagaagacaaggtgaatgaacgaccatttctctctaactcagttggctaagaggactgagctggcgccgaggctctggacacaaatgggccagttgaccctgaggtttctttctggtagtggaggtggggcttcctctggctgaccctgcttaggtctctgatggaggtagcaggggctctggttcccccaaactggccaagtcct

SEQ ID NO: 140209 - DNA, 601 bp, Human
cgccgaggctctggacacaaatgggccagttgaccctgaggtttctttctggtagtggaggtggggcttcctctggctgaccctgcttaggtctctgatggaggtagcaggggctctggttcccccaaactggccaagtcctccaccatagcacccaaggggtctgggcagagtgcagcttccctcccctccccagcttggcttggtgggcacctgcctcccctgccctcctgaccttgatggctaatgcagccagccccaggcaggcacagtcacagccctcaaacaacatgaggcccarctcaagactcctgggtggtggtggtcaaggtgggggactctgtagccagtagagcactgtgggggcaagagactgacttgaaggcttggagcctcacatgcccgcctagtggggtggtcctgagggatatgacttctttgggcctctctgctcatttttggaacctgacccgagaaggagcccatccaagacaatgtcccgccctcagggagggtctggcagtttttatccctaaaggctgggattctcagcggagcatcctaggctgtagtacccacgacatcttgcacacaagaggtg

SEQ ID NO: 140210 - DNA, 601 bp, Human
aggcacagtcacagccctcaaacaacatgaggcccaactcaagactcctgggtggtggtggtcaaggtgggggactctgtagccagtagagcactgtgggggcaagagactgacttgaaggcttggagcctcacatgcccgcctagtggggtggtcctgagggatatgacttctttgggcctctctgctcatttttggaacctgacccgagaaggagcccatccaagacaatgtcccgccctcagggagggtctggcagtttttatccctaaaggctgggattctcagcggagcatcctargctgtagtacccacgacatcttgcacacaagaggtggaatcgcctgttgatgaagagcaaggctctggaatctgtgatcttgggccactcacttcacttatcaatcccttcgcttccttcttgcctgttacatggggtctgcaatctacccctcaggggcgctgacgagctcacatgagcctgtgacataaaacacctagcacggccctggcgcagtaagagctcaggaaacgggctgctgctgtggttactgtggacccaggcggaaacagagcagccccgcccctgccgcaggcatat

SEQ ID NO: 140211 - DNA, 601 bp, Human
ggccactcacttcacttatcaatcccttcgcttccttcttgcctgttacatggggtctgcaatctacccctcaggggcgctgacgagctcacatgagcctgtgacataaaacacctagcacggccctggcgcagtaagagctcaggaaacgggctgctgctgtggttactgtggacccaggcggaaacagagcagccccgcccctgccgcaggcatataaaagtgaccacttggccggtcacggtggctcacgcctgtaatcccagcactttgggaggccgaggcgggtggatcacctgargtcaggagtttgagaccagcctggtcaacatgatgaaaccctgtctctactaaaaatacaaaaaattagctgggcgtagtggcaggcgcctgtaatcccagccgcccaggaggctgaggcaggagaatcacttgaaccctggaggtggaggttgcggtgagctgagatcgtaccattgcactccagcctgggcgacagagccaaactccgtctcgaaaaaaaaaaaaaaagaaaagggaccactcactttggtctgattcttcagttctcatggtccttttacatcggtcatttcattgc

SEQ ID NO: 140212 - DNA, 601 bp, Human; identical to SEQ ID NO: 34047

SEQ ID NO: 140213 - DNA, 601 bp, Human; identical to SEQ ID NO: 34048

SEQ ID NO: 140214 - DNA, 601 bp, Human; identical to SEQ ID NO: 34049

SEQ ID NO: 140215 - DNA, 601 bp, Human; identical to SEQ ID NO: 34050

SEQ ID NO: 140216 - DNA, 601 bp, Human; identical to SEQ ID NO: 34051

SEQ ID NO: 140217 - DNA, 601 bp, Human; identical to SEQ ID NO: 34052

SEQ ID NO: 140218 - DNA, 601 bp, Human; identical to SEQ ID NO: 34053

SEQ ID NO: 140219 - DNA, 601 bp, Human; identical to SEQ ID NO: 34054

SEQ ID NO: 140220 - DNA, 601 bp, Human; identical to SEQ ID NO: 34055

SEQ ID NO: 140221 - DNA, 601 bp, Human; identical to SEQ ID NO: 34056

SEQ ID NO: 140222 - DNA, 601 bp, Human; identical to SEQ ID NO: 34057

SEQ ID NO: 140223 - DNA, 601 bp, Human; identical to SEQ ID NO: 34058

SEQ ID NO: 140224 - DNA, 601 bp, Human; identical to SEQ ID NO: 34059

SEQ ID NO: 140225 - DNA, 601 bp, Human; identical to SEQ ID NO: 20080

SEQ ID NO: 140226 - DNA, 601 bp, Human; identical to SEQ ID NO: 20081

SEQ ID NO: 140227 - DNA, 601 bp, Human; identical to SEQ ID NO: 20082

SEQ ID NO: 140228 - DNA, 601 bp, Human; identical to SEQ ID NO: 20083

SEQ ID NO: 140229 - DNA, 601 bp, Human; identical to SEQ ID NO: 20084

SEQ ID NO: 140230 - DNA, 601 bp, Human; identical to SEQ ID NO: 20085

SEQ ID NO: 140231 - DNA, 601 bp, Human; identical to SEQ ID NO: 20086

SEQ ID NO: 140232 - DNA, 601 bp, Human; identical to SEQ ID NO: 20087

SEQ ID NO: 140233 - DNA, 601 bp, Human; identical to SEQ ID NO: 20088

SEQ ID NO: 140234 - DNA, 601 bp, Human; identical to SEQ ID NO: 20089

SEQ ID NO: 140235 - DNA, 601 bp, Human; identical to SEQ ID NO: 20090

SEQ ID NO: 140236 - DNA, 601 bp, Human; identical to SEQ ID NO: 20091

SEQ ID NO: 140237 - DNA, 601 bp, Human; identical to SEQ ID NO: 20092

SEQ ID NO: 140238 - DNA, 601 bp, Human; identical to SEQ ID NO: 20093

SEQ ID NO: 140239 - DNA, 601 bp, Human; identical to SEQ ID NO: 20094

SEQ ID NO: 140240 - DNA, 601 bp, Human; identical to SEQ ID NO: 20095

SEQ ID NO: 140241 - DNA, 601 bp, Human; identical to SEQ ID NO: 20096

SEQ ID NO: 140242 - DNA, 601 bp, Human; identical to SEQ ID NO: 20097

SEQ ID NO: 140243 - DNA, 601 bp, Human; identical to SEQ ID NO: 20098

SEQ ID NO: 140244 - DNA, 601 bp, Human
tttcaggcctatatggaggctatgagtgagtttagtgtggcagaagatgaaagaaccggacaggaatacggacgaaattggagcagggtttgggctctccccttcgcagataatgggaggagccgggcccgagcgagctctttcctttcgctgctgcggccgcagccatgaggtgagggcgagctggtctccatcaggcgctgacgcgtgtcgacaagggactgtcggtcttgggaccgcagctggggttgggggagatgaaatggaggccgccctaaagcggccggtcccggggtttggrgtaggccggagcactttcgtcccgggcctccggagtgagggggggcggggagcgtcgcagcaactgagaccaggaaaagtctgccccggctggtgccgcaccgcacacgtgtccggtcgacccacgcgagcagagcaaacggagcgaacaagaccaagccgtgggccctttcttgcttggcacacccggagcggagccgatctctgctttcacgtgatgtagggcaagcctagtgtaggccccaggcctccgactgccgagagaggtgatctctaactcttgactccattcactcctttg

SEQ ID NO: 140245 - DNA, 601 bp, Human
gggctctccccttcgcagataatgggaggagccgggcccgagcgagctctttcctttcgctgctgcggccgcagccatgaggtgagggcgagctggtctccatcaggcgctgacgcgtgtcgacaagggactgtcggtcttgggaccgcagctggggttgggggagatgaaatggaggccgccctaaagcggccggtcccggggtttggggtaggccggagcactttcgtcccgggcctccggagtgagggggggcggggagcgtcgcagcaactgagaccaggaaaagtctgccccggckggtgccgcaccgcacacgtgtccggtcgacccacgcgagcagagcaaacggagcgaacaagaccaagccgtgggccctttcttgcttggcacacccggagcggagccgatctctgctttcacgtgatgtagggcaagcctagtgtaggccccaggcctccgactgccgagagaggtgatctctaactcttgactccattcactcctttggcctctcataaaggaaatctctgcgaatagccgaacgaggcttgttactgtgataaaacagggaaataagcccagaaaacagagtaacttg

SEQ ID NO: 140246 - DNA, 601 bp, Human
gcagtggcacgatcttggttcactgcaatctgctttcgaggttcaagcacttcacctgcctcaccgtctcaagtacctgggattacaggcatgtactaccacgcctggctaatttttgtatttttagtagagatgtggtttcaccgttggccaggctggtctcgaactcctggcctcaagtgatccgcccgcctcagcctctcaaagtgctcagattacaggcctgagccaccacgcccagccatgggtagggagcctttctaagaaagtttttctattctggtctttctttttttccctrtatgtcatcaggatagcccaacagtttatttgccaggcaagttctatctaggaactgcacacaaaaaagtcatggtttaggaagtaattcatgcagcaataggagaaaagaaaggaagctacaagcttagtgaccttgggtggaggaacagctcacaaggcagcctctgatccatcaccaaccagcatctcttcactccgtgtaccctgcaggtatcacagcctgtacctgaaggtgaaggggaatgtgttcaaaaacaagcggattctcatggaacacatccacaagctgaaggcagac

SEQ ID NO: 140247 - DNA, 601 bp, Human; identical to SEQ ID NO: 59775

SEQ ID NO: 140248 - DNA, 601 bp, Human; identical to SEQ ID NO: 59776

SEQ ID NO: 140249 - DNA, 601 bp, Human; identical to SEQ ID NO: 59777

SEQ ID NO: 140250 - DNA, 601 bp, Human; identical to SEQ ID NO: 59778

SEQ ID NO: 140251 - DNA, 601 bp, Human; identical to SEQ ID NO: 59775

SEQ ID NO: 140252 - DNA, 601 bp, Human; identical to SEQ ID NO: 59776

SEQ ID NO: 140253 - DNA, 601 bp, Human; identical to SEQ ID NO: 59777

SEQ ID NO: 140254 - DNA, 601 bp, Human; identical to SEQ ID NO: 59778

SEQ ID NO: 140255 - DNA, 601 bp, Human; identical to SEQ ID NO: 34424

SEQ ID NO: 140256 - DNA, 601 bp, Human; identical to SEQ ID NO: 34425

SEQ ID NO: 140257 - DNA, 601 bp, Human; identical to SEQ ID NO: 34426

SEQ ID NO: 140258 - DNA, 601 bp, Human; identical to SEQ ID NO: 34427

SEQ ID NO: 140259 - DNA, 601 bp, Human; identical to SEQ ID NO: 34428

SEQ ID NO: 140260 - DNA, 601 bp, Human; identical to SEQ ID NO: 34429

SEQ ID NO: 140261 - DNA, 601 bp, Human; identical to SEQ ID NO: 34430

SEQ ID NO: 140262 - DNA, 601 bp, Human; identical to SEQ ID NO: 34431

SEQ ID NO: 140263 - DNA, 601 bp, Human; identical to SEQ ID NO: 34432

SEQ ID NO: 140264 - DNA, 601 bp, Human; identical to SEQ ID NO: 34433

SEQ ID NO: 140265 - DNA, 601 bp, Human; identical to SEQ ID NO: 34434

SEQ ID NO: 140266 - DNA, 601 bp, Human; identical to SEQ ID NO: 34435

SEQ ID NO: 140267 - DNA, 601 bp, Human; identical to SEQ ID NO: 34436

SEQ ID NO: 140268 - DNA, 601 bp, Human; identical to SEQ ID NO: 34437

SEQ ID NO: 140269 - DNA, 601 bp, Human; identical to SEQ ID NO: 34438

SEQ ID NO: 140270 - DNA, 601 bp, Human; identical to SEQ ID NO: 34439

SEQ ID NO: 140271 - DNA, 601 bp, Human; identical to SEQ ID NO: 34440

SEQ ID NO: 140272 - DNA, 601 bp, Human; identical to SEQ ID NO: 27442

SEQ ID NO: 140273 - DNA, 601 bp, Human; identical to SEQ ID NO: 27443

SEQ ID NO: 140274 - DNA, 601 bp, Human; identical to SEQ ID NO: 27444

SEQ ID NO: 140275 - DNA, 601 bp, Human; identical to SEQ ID NO: 27445

SEQ ID NO: 140276 - DNA, 601 bp, Human; identical to SEQ ID NO: 27446

SEQ ID NO: 140277 - DNA, 601 bp, Human; identical to SEQ ID NO: 27447

SEQ ID NO: 140278 - DNA, 601 bp, Human; identical to SEQ ID NO: 27448

SEQ ID NO: 140279 - DNA, 601 bp, Human; identical to SEQ ID NO: 27449

SEQ ID NO: 140280 - DNA, 601 bp, Human; identical to SEQ ID NO: 27450

SEQ ID NO: 140281 - DNA, 601 bp, Human; identical to SEQ ID NO: 27451

SEQ ID NO: 140282 - DNA, 601 bp, Human; identical to SEQ ID NO: 34441

SEQ ID NO: 140283 - DNA, 601 bp, Human; identical to SEQ ID NO: 34442

SEQ ID NO: 140284 - DNA, 601 bp, Human; identical to SEQ ID NO: 34443

SEQ ID NO: 140285 - DNA, 601 bp, Human; identical to SEQ ID NO: 34444

SEQ ID NO: 140286 - DNA, 601 bp, Human; identical to SEQ ID NO: 34445

SEQ ID NO: 140287 - DNA, 601 bp, Human; identical to SEQ ID NO: 34446

SEQ ID NO: 140288 - DNA, 601 bp, Human; identical to SEQ ID NO: 34447

SEQ ID NO: 140289 - DNA, 601 bp, Human; identical to SEQ ID NO: 34448

SEQ ID NO: 140290 - DNA, 601 bp, Human; identical to SEQ ID NO: 34449

SEQ ID NO: 140291 - DNA, 601 bp, Human; identical to SEQ ID NO: 34450

SEQ ID NO: 140292 - DNA, 601 bp, Human; identical to SEQ ID NO: 34451

SEQ ID NO: 140293 - DNA, 601 bp, Human; identical to SEQ ID NO: 34452

SEQ ID NO: 140294 - DNA, 601 bp, Human; identical to SEQ ID NO: 34453

SEQ ID NO: 140295 - DNA, 601 bp, Human
gcctggatccccaggcgccagcacggacggctggaacagcccttttagtcctgagactcttctccggggccgggcttggggttgcggcgtttagatcagggcaggatcgagcgcggccgagtgtaggcagccccctcgcgctccgctgtcctcgccggccggcctcccctccctcgggccgccgggagccccctccccccggcctgggccccttccaccgggcgctttgcttgacagtttgggggcgtgacttccgccaggagccatctcgggcgactattggttccttctgtctctcttkccttcggtgattggcgcaccgccatgtcatctttgccgccgatccgcagcttgctgactaggccgccgggagcgggcgggaggcgagtccgttctgggtgtcttggctctatggctcgcctctgccagctcctccgctgccaggcggcgcacgctcgggaacctgtgcgcctattttggtcctacagaatgctgcggaagctctcgctcgtaggactccatttcttcttctttgtttttttttagccgaggctggagtgcagtggcgcgatctcggctcactgcaacctcagcctcccgg

SEQ ID NO: 140296 - DNA, 601 bp, Human
ccagcacggacggctggaacagcccttttagtcctgagactcttctccggggccgggcttggggttgcggcgtttagatcagggcaggatcgagcgcggccgagtgtaggcagccccctcgcgctccgctgtcctcgccggccggcctcccctccctcgggccgccgggagccccctccccccggcctgggccccttccaccgggcgctttgcttgacagtttgggggcgtgacttccgccaggagccatctcgggcgactattggttccttctgtctctcttgccttcggtgattggcgsaccgccatgtcatctttgccgccgatccgcagcttgctgactaggccgccgggagcgggcgggaggcgagtccgttctgggtgtcttggctctatggctcgcctctgccagctcctccgctgccaggcggcgcacgctcgggaacctgtgcgcctattttggtcctacagaatgctgcggaagctctcgctcgtaggactccatttcttcttctttgtttttttttagccgaggctggagtgcagtggcgcgatctcggctcactgcaacctcagcctcccggcttcaagcgattctcct

SEQ ID NO: 140297 - DNA, 601 bp, Human
cggggccgggcttggggttgcggcgtttagatcagggcaggatcgagcgcggccgagtgtaggcagccccctcgcgctccgctgtcctcgccggccggcctcccctccctcgggccgccgggagccccctccccccggcctgggccccttccaccgggcgctttgcttgacagtttgggggcgtgacttccgccaggagccatctcgggcgactattggttccttctgtctctcttgccttcggtgattggcgcaccgccatgtcatctttgccgccgatccgcagcttgctgactaggcmgccgggagcgggcgggaggcgagtccgttctgggtgtcttggctctatggctcgcctctgccagctcctccgctgccaggcggcgcacgctcgggaacctgtgcgcctattttggtcctacagaatgctgcggaagctctcgctcgtaggactccatttcttcttctttgtttttttttagccgaggctggagtgcagtggcgcgatctcggctcactgcaacctcagcctcccggcttcaagcgattctcctgtctcagcctcccgagtagctgagattacaggcgcccgccagctcac

SEQ ID NO: 140298 - DNA, 601 bp, Human
cagagagctgttaatagtaacatgtgcatttctggcttgggagactagaaaacagaatagagaaaaaggtgaaacattcagggtcagagagaagtgggaggtccagtgtaatctctaattcgttttgagaccacggacaggttgtttcactcctctggtccttctggatcctcatccgaagtgaaggagattaagaatcaattttgggaacttcaggctctgaagtacaaagttgtggttagagttccatcagtttggttagtgctgtagctgaaatgcaatagtgttgttcctgttttcyagggcaaatgacacagctttgtgaactgatcaacaagagtggggaactccttgcgaagaacttatcccatctggacactgtgctcggggctctggatgtacaagaacactccttgggcgtccttgctgttttgtaaggagcatcttcttttatagttctgtgcttgttaaaatggaacactgtgcacttcctggctttatttttatttatttatttatattttttgagatggagtttcgctctgtcacccaggctggagtgcagtggcacattcttggcacactgcaagctccgcctccc

SEQ ID NO: 140299 - DNA, 601 bp, Human
gaaggagattaagaatcaattttgggaacttcaggctctgaagtacaaagttgtggttagagttccatcagtttggttagtgctgtagctgaaatgcaatagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtaaggagcatcttcttttatagttctgtgcttgttaaaatggaacactstgcacttcctggctttatttttatttatttatttatattttttgagatggagtttcgctctgtcacccaggctggagtgcagtggcacattcttggcacactgcaagctccgcctcccgggttcactccattctcttgcctcagcctcttgagtagctgggactacaggcactcgccacccgccccagctaatttttgtatttttagtagagacagggtttcaccatgttagccaggatgatctcgatctcctgacctcttggtccgcccaccttggcctcccaaaatgctgggattaca

SEQ ID NO: 140300 - DNA, 601 bp, Human
gaaatgcaatagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtaaggagcatcttcttttatagttctgtgcttgttaaaatggaacactgtgcacttcctggctttatttttatttatttatttatattttttgagatggagtttcgctctgtcacccaggctggagtgcagtggcacawtcttggcacactgcaagctccgcctcccgggttcactccattctcttgcctcagcctcttgagtagctgggactacaggcactcgccacccgccccagctaatttttgtatttttagtagagacagggtttcaccatgttagccaggatgatctcgatctcctgacctcttggtccgcccaccttggcctcccaaaatgctgggattacaggcgtgagccaccacgcccagccctggctttatttttatttatttatttattttttggtgtagaaagtaaaccattgtaaataacattga

SEQ ID NO: 140301 - DNA, 601 bp, Human
agagtgagagctatgggctggctggaggtgggcagcagcttaagttaaagatgctgccaccagctgtgtggtctatctgagaataacactgacagaacaactgataggcaggacaagaggagtagagtggtgagaagagggaggactcaggtgatccttcccaagtaactcagactgccatgagaaacactccaaggaggcactggtgataggttttaggggagaaatcatgtaaacttagcactattaaggcattggttgtaagtaaatttcaaattctttaaaaaaaaaaaaaagcacrattgaaatgtaatttcaagaaaaattaggccagacacagtggcttacatctgtaatcccggcactttgggaggccaaggcgggtggatcacaagttcaggagttcaagaccagcctggccaacatagtgagaccctgtctctactaaaaatacaaaaattagccgggtgtggtggcatgcacctgtagtcccagctactcgggaggctgaggcaggagaatggcttgaacctgggaggcggaggttgcagtgagctgagacaacgccactgcactccagtctgggtgacagagtgtgaga

SEQ ID NO: 140302 - DNA, 601 bp, Human
ttaaatagctgcatatggctagtggccaccatactgcagagcataactctagatccttccattctgacaaagcttcttctctaaactctgctccggacacatacctttgtctcaggaatcccagcgtaagtgaagccagactctcactttaagtcaatttcttctcagtttatttatatcatttcaaatgtcatgacaaccacaatatcccaatttataatactataacatcaagagaaaaagaattctactgtcaagtacacggttacaaggaaccccaattaaaataaggtctatttartttggtcttaaatagcttaaatttgtttgaagggaattctaagcaatgttgctttggatctttgatactttttctttttttgagaaaaggtctcactttgtcatgtaggctggagtgcaatggcttaattgtagcttactgaagccttgaacttctgggctcaagcaatcctcccacctcagcatcttgagaagctaggactataggcatgtaccactacacccagctaatatttttattctttgcagagatagggccatattatgttgcctaggctggtctcaaactcctggcctcaaa

SEQ ID NO: 140303 - DNA, 601 bp, Human
cttttataatacataatttataatgtggatttttaaaaaatttatttagttatttatttttttgaaatggagtctcattctgttgcctaggctggagtgcagtggtgtgatctcagctcactgcaacctccaccttccagcttcaggggattctcgtgcctcagcctcctgagtagctgggactacaggcgcatgtcacctttcccagctgatttttgttttgttttgttttttgagacagagtctcgctctgtcacccaggctggagtgcaatggcgcaatctcggctcactgcaacttscgcctcctgggttcaagcagttcttctgcctcagcctcccaagtagctgggattacaggtgcctgacaccatgcccggctaatttttgtatttttagtagagacagggtttcaccatgtttgccaggctggtgtcaaactcctgaccacaggcgatccgcctgcctcggcctcccagtgatttttgtatttttaatagaggtgaggttttgccatgttggccaggctagcctctagaactcctgacctctggtgatccgcctgcttcagcctcccaaagagctgagattacaggtgtgag

SEQ ID NO: 140304 - DNA, 601 bp, Human
gactacaggcgcatgtcacctttcccagctgatttttgttttgttttgttttttgagacagagtctcgctctgtcacccaggctggagtgcaatggcgcaatctcggctcactgcaacttccgcctcctgggttcaagcagttcttctgcctcagcctcccaagtagctgggattacaggtgcctgacaccatgcccggctaatttttgtatttttagtagagacagggtttcaccatgtttgccaggctggtgtcaaactcctgaccacaggcgatccgcctgcctcggcctcccagtgrtttttgtatttttaatagaggtgaggttttgccatgttggccaggctagcctctagaactcctgacctctggtgatccgcctgcttcagcctcccaaagagctgagattacaggtgtgagccacttcacccagccaggtgtttctttttaatttgaaagtaaatttaagattagtggtttgaaagaggctgaaaatagaaccagttgttattttgtagtactaagtaaccatgtttgaaagagatggttaagaaaaatcatgagtttttgaaaaagctgtaagttattgagctattttta

SEQ ID NO: 140305 - DNA, 601 bp, Human
atctcggctcactgcaacttccgcctcctgggttcaagcagttcttctgcctcagcctcccaagtagctgggattacaggtgcctgacaccatgcccggctaatttttgtatttttagtagagacagggtttcaccatgtttgccaggctggtgtcaaactcctgaccacaggcgatccgcctgcctcggcctcccagtgatttttgtatttttaatagaggtgaggttttgccatgttggccaggctagcctctagaactcctgacctctggtgatccgcctgcttcagcctcccaaagrgctgagattacaggtgtgagccacttcacccagccaggtgtttctttttaatttgaaagtaaatttaagattagtggtttgaaagaggctgaaaatagaaccagttgttattttgtagtactaagtaaccatgtttgaaagagatggttaagaaaaatcatgagtttttgaaaaagctgtaagttattgagctatttttagtctcttcacatatatatatatatttttttgttgttgttgttgttgttgtttttttgagatggggtcttgctctgttgcccaggctggagtgcagtggtg

SEQ ID NO: 140306 - DNA, 601 bp, Human
tttaatagaggtgaggttttgccatgttggccaggctagcctctagaactcctgacctctggtgatccgcctgcttcagcctcccaaagagctgagattacaggtgtgagccacttcacccagccaggtgtttctttttaatttgaaagtaaatttaagattagtggtttgaaagaggctgaaaatagaaccagttgttattttgtagtactaagtaaccatgtttgaaagagatggttaagaaaaatcatgagtttttgaaaaagctgtaagttattgagctatttttagtctcttcacttatatatatatatttttttgttgttgttgttgttgttgtttttttgagatggggtcttgctctgttgcccaggctggagtgcagtggtgcgatctcagctcactgcaacctccgcctcccgggttcaagcgattctcctgcctcagcctcctgagtagctgggaccacaggcacatcccaccatgcccggctaatttttgtatttttagtagacatggggttttgccatgttggccaggataatcttgatctcctgacctcatgatccacccatcttggcctcccaaaatgctgggatta

SEQ ID NO: 140307 - DNA, 601 bp, Human
ggttttgccatgttggccaggctagcctctagaactcctgacctctggtgatccgcctgcttcagcctcccaaagagctgagattacaggtgtgagccacttcacccagccaggtgtttctttttaatttgaaagtaaatttaagattagtggtttgaaagaggctgaaaatagaaccagttgttattttgtagtactaagtaaccatgtttgaaagagatggttaagaaaaatcatgagtttttgaaaaagctgtaagttattgagctatttttagtctcttcacatatatatatatatatttttgttgttgttgttgttgttgtttttttgagatggggtcttgctctgttgcccaggctggagtgcagtggtgcgatctcagctcactgcaacctccgcctcccgggttcaagcgattctcctgcctcagcctcctgagtagctgggaccacaggcacatcccaccatgcccggctaatttttgtatttttagtagacatggggttttgccatgttggccaggataatcttgatctcctgacctcatgatccacccatcttggcctcccaaaatgctgggattacaggtgtgagccac

SEQ ID NO: 140308 - DNA, 601 bp, Human
cgatgttcaaagtccagaaggcaaaagggcaggtatataatgaagtctccttcccattctgtttgctagccatctatttcttctctacaaaggaaactatgttagttatttctcgtgtatccttccaaaaactttttatggacataaaagcaaatacgaatatatattttctcattttttacacaaattgtaataatctatgcatactcttatgtagcttgctttttgtatttaacatatcttggagatgattctgtagcagtactctacaggtacggagtattctataatatgagtatgygatggttttagaagtctgcatgggatatttacattgtttccttcaagaataacatggtatgtggattatttcaaacacatgttctagtttcatatgaagatgtgctttttaatgttttaaaaaaattgtgattgaggtacaacatacagacagtaaaatactaaagtgtatagctcagtgagtttgtacgcatgtctacactgcgtctccattagctagataactgttctaagggcttgctttcttgagttgcacaattccctgtatttacctaaaggattaattaaaggaaccacttct

SEQ ID NO: 140309 - DNA, 601 bp, Human
aagcaaatacgaatatatattttctcattttttacacaaattgtaataatctatgcatactcttatgtagcttgctttttgtatttaacatatcttggagatgattctgtagcagtactctacaggtacggagtattctataatatgagtatgcgatggttttagaagtctgcatgggatatttacattgtttccttcaagaataacatggtatgtggattatttcaaacacatgttctagtttcatatgaagatgtgctttttaatgttttaaaaaaattgtgattgaggtacaacatayagacagtaaaatactaaagtgtatagctcagtgagtttgtacgcatgtctacactgcgtctccattagctagataactgttctaagggcttgctttcttgagttgcacaattccctgtatttacctaaaggattaattaaaggaaccacttctacttgtatcacaccatgctggtctctttctattccactagttcagtaaagaaagaggacacactctttttccctctaatcagatgggtagggataggttaagagataagtgagtcttgtctgtagagttctctattctcaatcatct

SEQ ID NO: 140310 - DNA, 601 bp, Human
tgaaaccctgtctctactaaaaatacaaaaattagctgggtgtggtggtgcacgcctgtaatcccagctactcgggaggctaatgcaggagaatcacttgaacccgggaggtggaggttgcagtgagctgagatgacgccactgcactccagcctgtgtgacagagtgagactccatttcaaaaaaaaaaaaaaaggtaatgctgtttttttctgaatggctaagaaaatggagtacaggttgactattcctaatctgaaaatttgaaacccaatccgaaaatttgaaacccaaaatgctycaaaatctgaaatctttagaatgccaacttggcactcaaagtgctcattggagcaattggatttcaggttttcagattagggatgcttaactggtatgtattctgcaaatattccaaaatttgaaacacttgtggtcctaagcatttcagatagcagatacatgaaatgtgttgacatttagataattttagtcaataaaatgtaaaacacaattacattatttggaaatttctggaatcaatgaattttctccttctgctaatacctgcctaagtaaaattaaagtgatgatttaatat

SEQ ID NO: 140311 - DNA, 601 bp, Human
gtaatcccagctactcgggaggctaatgcaggagaatcacttgaacccgggaggtggaggttgcagtgagctgagatgacgccactgcactccagcctgtgtgacagagtgagactccatttcaaaaaaaaaaaaaaaggtaatgctgtttttttctgaatggctaagaaaatggagtacaggttgactattcctaatctgaaaatttgaaacccaatccgaaaatttgaaacccaaaatgcttcaaaatctgaaatctttagaatgccaacttggcactcaaagtgctcattggagcaaytggatttcaggttttcagattagggatgcttaactggtatgtattctgcaaatattccaaaatttgaaacacttgtggtcctaagcatttcagatagcagatacatgaaatgtgttgacatttagataattttagtcaataaaatgtaaaacacaattacattatttggaaatttctggaatcaatgaattttctccttctgctaatacctgcctaagtaaaattaaagtgatgatttaatatcaatttgttcacagctttgtttgctagcaaaatgctttaagcctgcccttccatatc

SEQ ID NO: 140312 - DNA, 601 bp, Human
ttcttctcttgcctaggctataactactcctgccatggcggtcagtcatatcatgttggaatcatataaaaagtatattttagtgtctttgatattacttggcaaagtacaacagctaccaaaatatacatctcaaattgtgggtagattcattaaggtaagttttttacataaaactgatttcttacgtgagcatgttgagtatataaagaaattgcaatgatacagttctgtaacttcgttttatactgatttagctctcctagcagcttcaggtgagcagacatttattgaatgtctkctacacattctcattacctgattggaatggaatatttctcaggaacccgttttcaaacttgtgctctagatacttacagctatagatgtttaagctcctataacagttgatttttttttttttccctagagacagagtctcgctatgttggccaggttggtgttgaactcctggcctcaagcagtccttctgcgtctgcctcccagagtgctgggattacaggtgtgtgccactgagcctggcctttattttgttttgttatatttttcattttatttatttatttatttatttatttag

SEQ ID NO: 140313 - DNA, 601 bp, Human
gaatccttccaaatactctagaaagactagccatagcttctagaatagaaggaaatcagtagtgaatttgtaaaaagttaatttttatgagagaaaaatgaagaacgtgaaagagaaatcaagtcaaagatcaaaaccagtgtaacttgtgagccagaaaaaccagcttgacctacaggtttaaaagaccaggatctaagagacttaaataacaagcagcctaattctctccataaaattttctttttggcccaagtgccaacagaaccattctaagtaaatttctgtcttttgccatcargaggtagccattaaaaaacagctgccattaaaaacacaaactctgtttgtgactagtaattgaggtttagataaaagaacccaaatgctaacaaacataaaagatagtacatgttacaaaagatgttaaattgcaaaatagcaaatgaaaattaaataacggtttcaaaaattagctgggcgtggtggcacatacctgtaatcccagctacttggaaggctgaggcaggagaatcatttgaacccaggagatagaggttgcagtgagccgagattgcaccactgcactccagtctggggg

SEQ ID NO: 140314 - DNA, 601 bp, Human
ttgtttaaaaatgttaactttgaattttgaatgatgaatgttattttttcaattatatttaatagattatacatttataatacaaaattcaaaagatgaaaatcttcataatgatgtgcataccttggattccttttcagtttacatatatatataaaattatttttcattactcctctaggaaattgacaaaccactgggttcatcagtttttatttttttatttttttttgtgacagagtcttgctcagttgcccaggctggagtgcagtggcgtgatcttggctcacaacaagctccrcctcctgggttcacgccattctcctgcctcagcctcccaagtagctgggactacaagtgcccaccaccacgcccggctaattttttttttttttttgtatttttagtagagacagggtttcaccacgttagccaggatggtctcgatgtcctgacctcgtgatccactcgcctgggcctcccaaagtgctgagattacaggcatgagccaccgtgcccagcctatcagttatttatttatttatttatttatttatttatttatttatttatttattttgagatggagtctcactctgtt

SEQ ID NO: 140315 - DNA, 601 bp, Human
tctcctgcctcagcctcccaagtagctgggactacaagtgcccaccaccacgcccggctaattttttttttttttttgtatttttagtagagacagggtttcaccacgttagccaggatggtctcgatgtcctgacctcgtgatccactcgcctgggcctcccaaagtgctgagattacaggcatgagccaccgtgcccagcctatcagttatttatttatttatttatttatttatttatttatttatttatttattttgagatggagtctcactctgttgcccaggctggagtgaatcmcgcgatctcggcttgctgcaacctccacctcccaagtttaagtgattatcctgcctcagcctcctgagcagctgggattacaggtgcctgccaccatgcctggcaaatttttgcgtttttagtagaggtggagtttcatcatattggccaggctggtctggaactcttgacctcaattgatccacccacctcggcctcccaaagtggtgggattacaggtgtgagccaccacccctcgcccatcagttttaagtcatctacacaaatctattctgtacatcaatgggaagagctctgtac

SEQ ID NO: 140316 - DNA, 601 bp, Human
accaccacgcccggctaattttttttttttttttgtatttttagtagagacagggtttcaccacgttagccaggatggtctcgatgtcctgacctcgtgatccactcgcctgggcctcccaaagtgctgagattacaggcatgagccaccgtgcccagcctatcagttatttatttatttatttatttatttatttatttatttatttatttattttgagatggagtctcactctgttgcccaggctggagtgaatcccgcgatctcggcttgctgcaacctccacctcccaagtttaagygattatcctgcctcagcctcctgagcagctgggattacaggtgcctgccaccatgcctggcaaatttttgcgtttttagtagaggtggagtttcatcatattggccaggctggtctggaactcttgacctcaattgatccacccacctcggcctcccaaagtggtgggattacaggtgtgagccaccacccctcgcccatcagttttaagtcatctacacaaatctattctgtacatcaatgggaagagctctgtacactttttttttttttttttttgaaatagagtcttgctctgtcg

SEQ ID NO: 140317 - DNA, 601 bp, Human
tccactcgcctgggcctcccaaagtgctgagattacaggcatgagccaccgtgcccagcctatcagttatttatttatttatttatttatttatttatttatttatttatttattttgagatggagtctcactctgttgcccaggctggagtgaatcccgcgatctcggcttgctgcaacctccacctcccaagtttaagtgattatcctgcctcagcctcctgagcagctgggattacaggtgcctgccaccatgcctggcaaatttttgcgtttttagtagaggtggagtttcatcatrttggccaggctggtctggaactcttgacctcaattgatccacccacctcggcctcccaaagtggtgggattacaggtgtgagccaccacccctcgcccatcagttttaagtcatctacacaaatctattctgtacatcaatgggaagagctctgtacactttttttttttttttttttgaaatagagtcttgctctgtcgtccaggctggagagcagtggcgcagtctcagctcactgcaacctccacctcctgggttcaagcaattctctgattctcttgtcgcagcctcccaagtagc

SEQ ID NO: 140318 - DNA, 601 bp, Human
cgatctcggcttgctgcaacctccacctcccaagtttaagtgattatcctgcctcagcctcctgagcagctgggattacaggtgcctgccaccatgcctggcaaatttttgcgtttttagtagaggtggagtttcatcatattggccaggctggtctggaactcttgacctcaattgatccacccacctcggcctcccaaagtggtgggattacaggtgtgagccaccacccctcgcccatcagttttaagtcatctacacaaatctattctgtacatcaatgggaagagctctgtacactttttttttttttttttttgaaatagagtcttgctctgtcgtccaggctggagagcagtggcgcagtctcagctcactgcaacctccacctcctgggttcaagcaattctctgattctcttgtcgcagcctcccaagtagctgggactacagacgcatgccaccacgcctggctaattctttttttgttttttgttttttgttttgagacagagtctcactttgtcacccaggctggagttcagtggctcagtctccactcactgcaacctccgcctcctgggttcaagcgattctcctgt

SEQ ID NO: 140319 - DNA, 601 bp, Human
cttggctcactgcaacctccacctcccggattcaagtgattctcttgcctcagcctcccgagagctgggactacaggcatgcgccaccatgcccggctaaatttttgtatttttagtagagatggggtttcaccatgttggtcaggctggtctcaaactcctgaccacgtgatctgcccgcctcgggctcccaaagtgctgggattataggcatgagccaccgtgcctggccttgattttcatttttttgaaaattaattactggatttttgttactgtaagagtaacagatgttcattgkggaaaatattaaaaaggagaaaagcggggggagcctccaaagtctaccactattgacaatttggtctgtttccttatagtttctagttttagtgtgctcatatgatatacacatcaggcttgcgtcctatttgtgcttcctttttttttttttttgagatggcttcatcttgttgcccaggctggtgtgcagtggtgcaatctcggctcactgcagcctcaattccctgggtttaagtaatccacccacctcagcctcccaagtagctgggactacaggcatgtatgtgtcaccatgcct

SEQ ID NO: 140320 - DNA, 601 bp, Human
ccagtacgtacatcaagcaactgctgcagcaagaaatcttgctgaacaatgtttgctgaactacacagtgtgcttagcgacatcattgactgacattctgacttagcctcttccgtcactgagggttttggtccataagcagcactgacataaaggaggccagagcacacacccaggacttagcatccagcttaggaaatgaaatagcaccagtgccctgacactccctctttatcacctgccagttgcatttccccactctcagccccaccccaaccaggcaaccactcctgatttggataagcatcatttaaatgactatatgataacccaccacattgatgtattgtaatctacctacctattcagttacataagtacatagttctgatctggttttagttcactgaaaacctgtgtccttagctcaggacaggcaaagcttcatatgaccccttgtatgatttcagaatttggagtattttgattgattgattgattgattgagacaaggtcttcctgtgttgcccaggctggagtgcagtggcgtaatcatggctcactgcagccttgactgcctaggcttaaatgatcctctcac

SEQ ID NO: 140321 - DNA, 601 bp, Human
ttaaattttttgtacaggcagggtctctttatgttggccaggcataacttgagatttctggcctcaagtgaccttcccaccttggcctcccaaagtgctgggattacagctggatacagccactgcacccagctgagtatttcattttgatagttgaatttacaagtgttctaaagggttttttgcttcaacctaccattcaaaacatgcacacaccaaacaaaaccatacctctatgacttgtgtctgctaagagcatcttggtaaccccacaggggttacacagaataagctatagacrctttccccaagaaattccctcttcagtggcgagtgagaagaaatacatgagtggttatgacaccagacaggacatactagctagcaacgcgttgcggggtcaaagtgggtgtgagttttgagccctgcttaaccagcccagacaccctgacaggctctggagcagtggttctcctctgagggtgattttgtctgccaggagacattaggcaacatctggaagcagttttggttttcacagatgggggtgctactggcgtctaatgggtacgggccagggatgctgctaaacgtcctgcag

SEQ ID NO: 140322 - DNA, 601 bp, Human
accaaacaaaaccatacctctatgacttgtgtctgctaagagcatcttggtaaccccacaggggttacacagaataagctatagacactttccccaagaaattccctcttcagtggcgagtgagaagaaatacatgagtggttatgacaccagacaggacatactagctagcaacgcgttgcggggtcaaagtgggtgtgagttttgagccctgcttaaccagcccagacaccctgacaggctctggagcagtggttctcctctgagggtgattttgtctgccaggagacattaggcaacrtctggaagcagttttggttttcacagatgggggtgctactggcgtctaatgggtacgggccagggatgctgctaaacgtcctgcagtgcccaggacagcccacacaccaaagcgttatctgtacccaggacagcccacacaccaaagcgttatctgtacccaggacagcccacacaccaaagcgttatctgtacccaggacagcccacacaccaaagcgttatctgcccccaaatgtcaggactgccaggcttgagaaacccttctggaatgaaaggtctgtgagaccagggtttttttt

SEQ ID NO: 140323 - DNA, 601 bp, Human
catctctccctatgtgagaagcagagtcggggtggctggaggagaagagcaaagccctccctgacggtcccctttaggcaacagcctggctacagctgcagcagtcacctctgtgtctcctgagggcatgctgcctctgattctgggggctgaagggggagttttgtgggtggtctgtgtttcttacctctgagcagggaagtgaactgaatattaaatctcagaaaactatgtttttttgtaattaatttaatggcaaaatgtcacctgaaatggtgtctagtcttcatttatctcagcrtgaatatactcgtttcactgcaaaagatactatgtgtttgattatgaggtttgcctagatcctgctgggtgggatatttggtattatatgatagatgtattagctttctgagtccaaaatactctggctccaaaacccatgtggccccaggggtttcacatcaagagattgtgaacctatagcacccttgtgaacagtgtaagttagaaaggatgcagctgacctaaacccgccgctgaccaccttctaatgtgcctgtcatgcagatgctgaagtgcattgagctggatgagcggctga

SEQ ID NO: 140324 - DNA, 601 bp, Human; identical to SEQ ID NO: 35612

SEQ ID NO: 140325 - DNA, 601 bp, Human; identical to SEQ ID NO: 35613

SEQ ID NO: 140326 - DNA, 601 bp, Human
ccttttatgagactacactgtagtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatcccagctttgtggctgccgtcatcaccatcaccttcaatccgctctactggaatgtggtaagtgatgtgcctgacactgtccagacgggagtatcycactgcttggtgagccccacatgcaggggatcgcggtggttgctgctggctggccagacagacagacagctctgctcttccctcccgtgtctgtcgctggctggtgtggagtactaggcgcttcctgccgtcttgccttggggatccagcagccattgggctgcccaggctggcgtcaggatggtccaggactgtaggggtggccctcctaccctcacaagaacctgcaggagaacgctgccatggtggggctgccattggtcacatgtgcctggcagtctggtggccttctcatgcatg

SEQ ID NO: 140327 - DNA, 601 bp, Human
gagactacactgtagtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatcccagctttgtggctgccgtcatcaccatcaccttcaatccgctctactggaatgtggtaagtgatgtgcctgacactgtccagacgggagtatcccactgctyggtgagccccacatgcaggggatcgcggtggttgctgctggctggccagacagacagacagctctgctcttccctcccgtgtctgtcgctggctggtgtggagtactaggcgcttcctgccgtcttgccttggggatccagcagccattgggctgcccaggctggcgtcaggatggtccaggactgtaggggtggccctcctaccctcacaagaacctgcaggagaacgctgccatggtggggctgccattggtcacatgtgcctggcagtctggtggccttctcatgcatgaagtgggt

SEQ ID NO: 140328 - DNA, 601 bp, Human
tgagatttttctccatctggtgagagaagtgggtgggggccagcctgctcatgtcaaagacagtgcattccaaagaatgccctgttcctgctgtcctgaacatgctggacacactccgaggatggatgctctggcggcccacaagggaggggcttcgaggggaggtccagaggtgggagtgagactggcgagcttggtgtagccaaacacaggcctcccggacacccctttctcctgagaagccttggctgggctggggagcacctgtactctcagccacaccgtccccagctggccccarcctcctgacatgggcctctggagccagggctgcagccgaagtgcctggccatcctggcgtttcctcccactgcctggcctgcatgcttcctctctcctttcacctttgcacacacccagcatgccagagatatgaggtggtgaagggtgaggagggtgtttggaggctgaaaaatggtcctgcaaagacgtccacatcctgtgaaggtctcttatatggcacacacacaaggatctttgcagacgtgatgaagtcaaggagcttgagctggggagatggccctgagttacccaggtgggc

SEQ ID NO: 140329 - DNA, 601 bp, Human
ccagcctgctcatgtcaaagacagtgcattccaaagaatgccctgttcctgctgtcctgaacatgctggacacactccgaggatggatgctctggcggcccacaagggaggggcttcgaggggaggtccagaggtgggagtgagactggcgagcttggtgtagccaaacacaggcctcccggacacccctttctcctgagaagccttggctgggctggggagcacctgtactctcagccacaccgtccccagctggccccagcctcctgacatgggcctctggagccagggctgcagccgmagtgcctggccatcctggcgtttcctcccactgcctggcctgcatgcttcctctctcctttcacctttgcacacacccagcatgccagagatatgaggtggtgaagggtgaggagggtgtttggaggctgaaaaatggtcctgcaaagacgtccacatcctgtgaaggtctcttatatggcacacacacaaggatctttgcagacgtgatgaagtcaaggagcttgagctggggagatggccctgagttacccaggtgggccctaagtgccattgtgtgtgtccttttaacaatggagtg

SEQ ID NO: 140330 - DNA, 601 bp, Human
aagggaggggcttcgaggggaggtccagaggtgggagtgagactggcgagcttggtgtagccaaacacaggcctcccggacacccctttctcctgagaagccttggctgggctggggagcacctgtactctcagccacaccgtccccagctggccccagcctcctgacatgggcctctggagccagggctgcagccgaagtgcctggccatcctggcgtttcctcccactgcctggcctgcatgcttcctctctcctttcacctttgcacacacccagcatgccagagatatgaggtggtkaagggtgaggagggtgtttggaggctgaaaaatggtcctgcaaagacgtccacatcctgtgaaggtctcttatatggcacacacacaaggatctttgcagacgtgatgaagtcaaggagcttgagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctgg

SEQ ID NO: 140331 - DNA, 601 bp, Human
ggtcctgcaaagacgtccacatcctgtgaaggtctcttatatggcacacacacaaggatctttgcagacgtgatgaagtcaaggagcttgagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctggaagaagcaaaaaatggagtctcccccagagcctmtggtggaagcacagcccagtcggcaccttgattttggcccagtggtaactaattggggattgctgttgttttcagcccctaagttggcggtcatttgttacagcagccacaggaagcgaggccagggtatttaaaaagccaaagacccctgctggaagacgttgtgggcctaacctttggagtgttgggtgtgccacgctcttggctgtccacagtccttctctgagggagatgttgggctcttacagccggaggaggtccctgccctctggcttcctgcaggcctgacgttgaccagca

SEQ ID NO: 140332 - DNA, 601 bp, Human
acaaggatctttgcagacgtgatgaagtcaaggagcttgagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctggaagaagcaaaaaatggagtctcccccagagcctctggtggaagcacagcccagtcggcaccttgattttggcccagtggtaactrattggggattgctgttgttttcagcccctaagttggcggtcatttgttacagcagccacaggaagcgaggccagggtatttaaaaagccaaagacccctgctggaagacgttgtgggcctaacctttggagtgttgggtgtgccacgctcttggctgtccacagtccttctctgagggagatgttgggctcttacagccggaggaggtccctgccctctggcttcctgcaggcctgacgttgaccagcagtcattgaggtacatatgggtctcccagcactgggagcttggctggctgaa

SEQ ID NO: 140333 - DNA, 601 bp, Human
gagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctggaagaagcaaaaaatggagtctcccccagagcctctggtggaagcacagcccagtcggcaccttgattttggcccagtggtaactaattggggattgctgttgttttcagcccctaagttggcrgtcatttgttacagcagccacaggaagcgaggccagggtatttaaaaagccaaagacccctgctggaagacgttgtgggcctaacctttggagtgttgggtgtgccacgctcttggctgtccacagtccttctctgagggagatgttgggctcttacagccggaggaggtccctgccctctggcttcctgcaggcctgacgttgaccagcagtcattgaggtacatatgggtctcccagcactgggagcttggctggctgaatgcatagcaggtcctgaggacgcttttatttatgcaca

SEQ ID NO: 140334 - DNA, 601 bp, Human
accagcagtcattgaggtacatatgggtctcccagcactgggagcttggctggctgaatgcatagcaggtcctgaggacgcttttatttatgcacaagccccctcaggtcacttcccactagcctagccaacagtgtgtttttaaagtgaagttcattgtgaaggttctcagtggctcatgaatggcagagtggttaagatgcagtaagatttggccgggcgcggtggcccacgcctgtaatcccagcactttgggaggctgaggtgggtggatcacctgaggtcaggagttcgagaccarcctggccaacatagtgaaacctcatctctactaaaaatacaaaaatttagccggatgtgatggtgtacgcctgtagtcccagctactcgggaggctggggcaggagaatctcttgaacccaggaggcggaggttgcagtgagccgagatggcaccactgtactccagcctgggtaacagagtgagactctgtctttaaaaaaaaaaaaaaaaaaaaagatgcagtaagatttggaagacagcatgtgtctgtgtgtttggcatacgggtttttttttttttttttttttggtcataagct

SEQ ID NO: 140335 - DNA, 601 bp, Human
ccagcctgggtaacagagtgagactctgtctttaaaaaaaaaaaaaaaaaaaaagatgcagtaagatttggaagacagcatgtgtctgtgtgtttggcatacgggtttttttttttttttttttttggtcataagcttttgattagtctcattttgagatagtttttcactggaacagtttgtggtcattggtgggagagggagtgagctcttcaaagtggtttcaaaaggagaaaagttaagaaacatgttgcagttccgtgggctgctgccggggagagtatccggacggcatctggartgggatgacgaggcccagctctgtgatgccagaagcccagtgggtggatcagttgagccaaggagttggagaccatcctggggaacatggcaaaaccctgccactacaaaaaatacaaaaattagccgtgtgtggtggtgtgcacctgtagtcccagctactgggttggctgaggtaggagaatcacttgaacccaggaggtcgaggctgcagtgagctgtgatcacactactgcactccagcctgggcaacagagcaagaccctgtcttaaaaaacaaaaacaaagacaggccaacagg

SEQ ID NO: 140336 - DNA, 601 bp, Human
gacagcatgtgtctgtgtgtttggcatacgggtttttttttttttttttttttggtcataagcttttgattagtctcattttgagatagtttttcactggaacagtttgtggtcattggtgggagagggagtgagctcttcaaagtggtttcaaaaggagaaaagttaagaaacatgttgcagttccgtgggctgctgccggggagagtatccggacggcatctggagtgggatgacgaggcccagctctgtgatgccagaagcccagtgggtggatcagttgagccaaggagttggagaycatcctggggaacatggcaaaaccctgccactacaaaaaatacaaaaattagccgtgtgtggtggtgtgcacctgtagtcccagctactgggttggctgaggtaggagaatcacttgaacccaggaggtcgaggctgcagtgagctgtgatcacactactgcactccagcctgggcaacagagcaagaccctgtcttaaaaaacaaaaacaaagacaggccaacaggccacaaccagggaagcacttaaataacttaatagttatcaatgcagttgtccctgggtatccataggagattg

SEQ ID NO: 140337 - DNA, 601 bp, Human
ctgaggtaggagaatcacttgaacccaggaggtcgaggctgcagtgagctgtgatcacactactgcactccagcctgggcaacagagcaagaccctgtcttaaaaaacaaaaacaaagacaggccaacaggccacaaccagggaagcacttaaataacttaatagttatcaatgcagttgtccctgggtatccataggagattggttccagttccccgtggataccaaaatcggcagatgctcaggtccctgatgggaaacaatgttgtattcgagtataacgtatgcccaccctcccatrtactttacatcatctctagattacttatcatacccaagacagtgtacatgctgggtagttacactgtattattttttatgttattactttttgtttttatttttttcctgaatttttctttttttttttttttgagacagcatctcactctgtttcccaggctggagtgcagtggcatgatcttggcttactgcaacctctgcctctcaggttcaagcgattcccctgcctcagcctcccaagtagctgggattacggggacctgccaccaagcccagctaacttttttgtagttttagt

SEQ ID NO: 140338 - DNA, 601 bp, Human
catgttggcaaggctggtgtcgaactcctgacctcaggtgatctgcccgcgttggcctcccaaagtgctgggattacaggcatgagccaccacgcctggctcttgaatatttttatctgcagttgctgcggagggctggctggtggtggcgggactcatgctcaggtgttgtgcccagtgcatgtcatgcagtatttcaatgaatcttcacagcaaatgctgttaatatcccctttggagactgaagcttgaagaggttcattcatacattcttcaaatgtttattgagcatctactgtgygctgggcaccatcccggcccctggccctcacgcagcagcttcagtggtgaatgaatgtatagcactgccggtgacacagcaggcaaggggagggacagacaggggtggtggtcagggaaggcctctctgatgggtgtcctttcaccagaaacctgattctcatgcaggagggccctcaggtgtctggggaagagcattctgtcaggaaaacacaagtgcaaaagtcctggggcactcttgagtgtcctcggaggttttaagggacagctgccgctggagccaggcagagggagaatggag

SEQ ID NO: 140339 - DNA, 601 bp, Human
tgattctcatgcaggagggccctcaggtgtctggggaagagcattctgtcaggaaaacacaagtgcaaaagtcctggggcactcttgagtgtcctcggaggttttaagggacagctgccgctggagccaggcagagggagaatggaggagcaggacggagaggtggctggggacggtggtgcaggccttgcgggccatggggagagacattccctggactctgagctgggagccattgcagaggtggcatgatctgagtcagagtttcaaggtcactgcaccaaggacagaggagaagagrcaaaggtggagctgagaggccagcaggccccagatggcagcttgaccacagtgggactggcggaggtgggagcagtgatcagggagagctgagagaggtggcttggccagcccatggttgggcctgagtgacccgtgggaggcaaggccgttggctgccctggggcaaccgtgggaggagaggcttgtggaggaagagctcggttttgcctgtgtccgacacggatgtccttgggctccagacagtgtgagaaggccaggcatggtggctcacgcctataatcccaagcactttgggagg

SEQ ID NO: 140340 - DNA, 601 bp, Human
taatgaacactgtgataagggctcaggaaacaaagatcaaggtgtcacagagggactgacaggcttttccctctgtcatctgagtctcagtctgtggcctggactcctcagggcttcaggaccttgggtccaggcactgtggccctacgtgggagtctccagtctccaaagggagcccctgccaagacctccccaatgttctgttctttccctatcactccagatgccagggcagtggtccaaggaccagcatggactccctcttctcacctgcccccggatctgtaccctcgcggactcyacctggcttcatgccatcacccccgccagatcaccagcagcagctgcttgcagccagtctccccactgctcctctctagccacccttgagggccatgctcagaggtccccaggttttccaggaaatggaacttttcccctgtcccgggaggcccttctggcaggcgtcctcccacctgtatcctcagtcatcccaggtcttgggcctttctgggtgatctggcttctcttgtgcaaggctgcccacagacctttgttaccgcagcttggagtggtccttgtcaggtgtcccctccctcat

SEQ ID NO: 140341 - DNA, 601 bp, Human
acctggcttcatgccatcacccccgccagatcaccagcagcagctgcttgcagccagtctccccactgctcctctctagccacccttgagggccatgctcagaggtccccaggttttccaggaaatggaacttttcccctgtcccgggaggcccttctggcaggcgtcctcccacctgtatcctcagtcatcccaggtcttgggcctttctgggtgatctggcttctcttgtgcaaggctgcccacagacctttgttaccgcagcttggagtggtccttgtcaggtgtcccctccctcatrcctcctcaccctgccctctctgactcagggttgctgacttttggggccatccctggcactacaggtgtccagcaatgtccccggcctctgcccactagatgtcagtagtaccccaagcccaggccatctgagtggtttccagacattgcctgatgtcccttgagggccatggctgcctgggcgttctgagtacctacccctcagcacagcctgccatacctgctgtcactgtttgtctctcactgtccccttcccaggagcatcctaagagagttgaagcggagcctgctctgcttctgt

SEQ ID NO: 140342 - DNA, 601 bp, Human
tgtaaggaatcctgccaagacggcagatgcacacggggtcacgccggtttcctccagccttgggagggtgcttcctggtgcctttgtttgtccccttccaagccctgcgtggccaccctgctttctgctctccctgggtgcctggctctcatgtgcaggtctttgcttggggacacccaagtccatcctcaaggtcagtgtgcagctcctcccctctgaggcccctctctcccacagtgcaccctgcccaagacctctcgctccattgggccgggggtggctcctgcacatgtgctccagrgaggaaaggcatttgacaggtcagctgcagacaggtgttctgacactcactgtcaaccagaccaaagccccagcccttggccctgcagaggatacctatagaggggcagcaggccttatgtctgtatcaggacgctgacctgtccctctggccggggactttcctgcttttagcctgagagtctctttccctggaacccaagtcagtcctgggcagaacaggacagttggccactgtagtctggagagttgtttgggaagaggcagcttttcctttctgggaggtgagagtccacttgct

SEQ ID NO: 140343 - DNA, 601 bp, Human
ctcacaacttattaaccaaggagttacggagagagcataaccaggtaatgcgtggggagacagggtcgtgggggctggaggaggtgatggtgggccataggcagggcagcacttggcccacgtgggctttttggaggagtcataggggcagggtgggcaggagttgaggccaaggaaagggatatgagtgtagacaaaaggtggactacaggtgggcctggggcttgtgagggaggaccccaagtgcatacctgcaatctggactgtctgctcaaggatggtggcatgtgtgtgtgtgtggatgtgtgtgagtgtgtgcatgtgtgtgagtgtgtgtgtgtcagaagttaggatgggggcatgagccaaactgtctgagacccttgcttccatctggctcagaaatctggctcccagggcatggccgcatatccagtgggctccaagccagtgtttctggaccagaaagcgtcgtcctctgccagggcctcttgcacttgtgggaaagctgagctgagctgggcttactggcggagcctgtggcacaagaagggtttttctttgagcagagccagctggctcatcaggcctgactgagacc

SEQ ID NO: 140344 - DNA, 601 bp, Human
cacaacttattaaccaaggagttacggagagagcataaccaggtaatgcgtggggagacagggtcgtgggggctggaggaggtgatggtgggccataggcagggcagcacttggcccacgtgggctttttggaggagtcataggggcagggtgggcaggagttgaggccaaggaaagggatatgagtgtagacaaaaggtggactacaggtgggcctggggcttgtgagggaggaccccaagtgcatacctgcaatctggactgtctgctcaaggatggtggcatgtgtgtgtgtgtgtakgtgtgtgagtgtgtgcatgtgtgtgagtgtgtgtgtgtcagaagttaggatgggggcatgagccaaactgtctgagacccttgcttccatctggctcagaaatctggctcccagggcatggccgcatatccagtgggctccaagccagtgtttctggaccagaaagcgtcgtcctctgccagggcctcttgcacttgtgggaaagctgagctgagctgggcttactggcggagcctgtggcacaagaagggtttttctttgagcagagccagctggctcatcaggcctgactgagacctt

SEQ ID NO: 140345 - DNA, 601 bp, Human
gtggactacaggtgggcctggggcttgtgagggaggaccccaagtgcatacctgcaatctggactgtctgctcaaggatggtggcatgtgtgtgtgtgtgtatgtgtgtgagtgtgtgcatgtgtgtgagtgtgtgtgtgtcagaagttaggatgggggcatgagccaaactgtctgagacccttgcttccatctggctcagaaatctggctcccagggcatggccgcatatccagtgggctccaagccagtgtttctggaccagaaagcgtcgtcctctgccagggcctcttgcacttgygggaaagctgagctgagctgggcttactggcggagcctgtggcacaagaagggtttttctttgagcagagccagctggctcatcaggcctgactgagaccttggctctaggagcacagctcttgtctcttcagaccagtgtcacctaagatactgtggccctcctagctctcccccgctcctgtctgggctgtgctcacagctggactcctgcagaacgaatggcaggtctagcttcagctccatggctggggacagtcagtgccttgtccccagtgcccacgctcactcccctggcccc

SEQ ID NO: 140346 - DNA, 601 bp, Human
gctctcccccgctcctgtctgggctgtgctcacagctggactcctgcagaacgaatggcaggtctagcttcagctccatggctggggacagtcagtgccttgtccccagtgcccacgctcactcccctggccccttgatgttgggtctcaagtgcaagccgttccacggcacatgagtgtgggatctttcagagccaggcagtggacgtgggcttttagctggcaacagccctgctgcccctggggcactgcctgcctctgaatggcagctgagctgggcagcagcattgctctgtgtgcygctggcactggcctggtggggagcctctgctatcaggctagggctaactttagaattgtggtgcctgagcaacgtggtgacaaagtgtacaacaaggtgtctcgaactgggtcagctcacagcctgtgccaggatggctgggagtgacatggacaggaacaaaagggaggggagagggagcgcactcccacctggagcctggcaggcaggatccccactgagccgatctcttccactgagccggcccatccctccctgtaggttcctcatactccagagatggctgggtgggacccaagc

SEQ ID NO: 140347 - DNA, 601 bp, Human
ttgtccccagtgcccacgctcactcccctggccccttgatgttgggtctcaagtgcaagccgttccacggcacatgagtgtgggatctttcagagccaggcagtggacgtgggcttttagctggcaacagccctgctgcccctggggcactgcctgcctctgaatggcagctgagctgggcagcagcattgctctgtgtgctgctggcactggcctggtggggagcctctgctatcaggctagggctaactttagaattgtggtgcctgagcaacgtggtgacaaagtgtacaacaaggtrtctcgaactgggtcagctcacagcctgtgccaggatggctgggagtgacatggacaggaacaaaagggaggggagagggagcgcactcccacctggagcctggcaggcaggatccccactgagccgatctcttccactgagccggcccatccctccctgtaggttcctcatactccagagatggctgggtgggacccaagcgtgtcttccctggatgatttatttttggttctggcatttacagcatgatgaaggctattggacactgctagtgtgagcagaatcaccctaaccgaaagg

SEQ ID NO: 140348 - DNA, 601 bp, Human
gatctttcagagccaggcagtggacgtgggcttttagctggcaacagccctgctgcccctggggcactgcctgcctctgaatggcagctgagctgggcagcagcattgctctgtgtgctgctggcactggcctggtggggagcctctgctatcaggctagggctaactttagaattgtggtgcctgagcaacgtggtgacaaagtgtacaacaaggtgtctcgaactgggtcagctcacagcctgtgccaggatggctgggagtgacatggacaggaacaaaagggaggggagagggagcrcactcccacctggagcctggcaggcaggatccccactgagccgatctcttccactgagccggcccatccctccctgtaggttcctcatactccagagatggctgggtgggacccaagcgtgtcttccctggatgatttatttttggttctggcatttacagcatgatgaaggctattggacactgctagtgtgagcagaatcaccctaaccgaaaggcagcgtgcggccctgggcagtagggtttggtgtagacatctctcgggatccctcccacactgaggagaggaggcaggggaccc

SEQ ID NO: 140349 - DNA, 601 bp, Human
tggtcccctctcctgcttatagtttcctgggctaaaatcaaaggaggtaaattatctcccaaggtcctttccattctggatcctctgttaatccaagggagatggggaagagggcttggaaacagctggatttggggatgaagattccactgggggcagaggggaggcagccccccacccaagccccatactccatctccattcctcactccctgccaggagtggaatgtgggcaggtaagagtcccagaggggtaagagccattggtgggaagcaactgtgggaccagtgccgccaccayggcccaaggacctggtgttcgatgccgcatccttccggtggcgtctgtggctcttctccttccccctgacccacccatgcctccgccctggggctggtgggattgctctcaaaaccaccttagccaagagggctccttcccagactcaggaggaagaacataggggacagccaggcctaaaggggctgggcaggggctctagagaattaaagctgcccaggccacagccccgccctgtgagggcctcacaagccctgtgcaggccgagtgctagagactcccctcttccaggagccagtg

SEQ ID NO: 140350 - DNA, 601 bp, Human
gattccactgggggcagaggggaggcagccccccacccaagccccatactccatctccattcctcactccctgccaggagtggaatgtgggcaggtaagagtcccagaggggtaagagccattggtgggaagcaactgtgggaccagtgccgccaccatggcccaaggacctggtgttcgatgccgcatccttccggtggcgtctgtggctcttctccttccccctgacccacccatgcctccgccctggggctggtgggattgctctcaaaaccaccttagccaagagggctccttcccagactcaggaggaagaacataggggacagccaggcctaaaggggctgggcaggggctctagagaattaaagctgcccaggccacagccccgccctgtgagggcctcacaagccctgtgcaggccgagtgctagagactcccctcttccaggagccagtgccctcctggggaggcgggcagactgtgccccactcctgggtgaggtgggtggggctgtgctggagctggctgccctagtggcctcagacctggccatgtgcgttcttagaaaggcgtttggtctttcctctaagatgagcat

SEQ ID NO: 140351 - DNA, 601 bp, Human
aaagctgcccaggccacagccccgccctgtgagggcctcacaagccctgtgcaggccgagtgctagagactcccctcttccaggagccagtgccctcctggggaggcgggcagactgtgccccactcctgggtgaggtgggtggggctgtgctggagctggctgccctagtggcctcagacctggccatgtgcgttcttagaaaggcgtttggtctttcctctaagatgagcatagcgtcccttcctcagggttggctgaggagcttggtgtggacagccgggctccaggcacacagcggycccagtacacctgtcgctttgcctgccacccgcttacggtagcagcatggttgtaataaagcaataaagccagcgtggatgggcgatgttgctattgctattaatgatctttgctcatgaaatttttagtcgcctttctggccttcctctatctcaggccaaaactgccccttcttcctaaggggcaccctgtgcttcttgctgcagaatcctggggcttcccccttcgcatttccgtggaactcagagatggtacctccctgcgaggtggggctgagagggggcccctgcggatgcggt

SEQ ID NO: 140352 - DNA, 601 bp, Human
ggtacccccatgtccttgagcccactggagtctgtcccccttgccatcctcgggagcccggtgcggttgtgcccccctcatatctctgggcctctcagcacacaggtctgtcctgcctttgatagcaagacggacctgggcaaggttcctggcttctccgagccttggtattctcatctgtgacccaggcacagctgcctggctcactgttgcaagggccgggatggtgcctggagtgggtggtgcctggagccagctcagcgtcagtgaccctcgtctgttccctcttcctacctccagycttaccgtccgcttccccctcgggcagccaccccagggcatctgttgtggaactgctctgtgggttttgtccttgatacctttccaggcttcttcaggttgggctcaggcagggactcagggggacttagcttccagcttgcagcctcaccgcttgggttccggctgtggctggccattcactgtgctaagcttcgtgccttggcgttcttaactgtgaaagagggttacctgtaggttccacctcctgggtcgtgtgaggatgtgacacactccgtgtgcagcacagggagccaggcag

SEQ ID NO: 140353 - DNA, 601 bp, Human
gtggggtctggaggaagggaggagagaggggagaggaaggcgcggccggggtccttgctatcttcagtcacactgcacacattgctgactcctagacgtgtgtcaggccaggcccagggttcagggatcccagggcccaggggatggttggttaaaggcagtcttgggagcgggaaggacaagcggaagctcaggcagcgtgtaggtgagggtggggtgaggtggaggtggggaggagtgtcgaggggaggctggacaccctgcccctgtggctagggcagcagggagcctgtgtagacaygcagctggtgtggacgcgaagggtggcttggttgggacctgtcacccggtcaccatgctgctccttggctaggcagggctattcctcaagggccagtttggttaaaaggtgatgatgtctgcacagatgtggctccaaattccaccatccccaggggcccgcgcccccattcccggttctctaacccctccccggggccggtgtggtgaagacagcacagcttctgggccccaggcagcccctgttgctccttagctatgtggctttggataggttacctgcctacccttttctggatag

SEQ ID NO: 140354 - DNA, 601 bp, Human
gcctggctctacatggaactgggagagtggcctgtcattgtcaccagcccctgcaatgtccccctctactccttggtgctggcttgggcccaccccatttcagtcctgctgagctttgccttggttctttattcattcagcaaacatctcctgggcatttgccccaatggaaagtactgttctgggcgctgtgggcttttggccatgagcaggaagttgactccggaggctgcagggacctgcttaggcatcctcattaccgcctgggtcccagagcgagccaggagcctctgaggcagcrggggcttctcaaccacacacctggctctcctcctccaagactttctgcgtgcaccagcatcttccattttgtgtttcctgtctgtttaccatgtgtaattttgtcagcatgtcacgtccctttcataatgaagcaagggacaaagaaacaagggccagtggagcccagtacagggtggccagaggtgtcggctctatgtaggtctgctgctctggtgtgtccctgcgtgagggtcaggctggggaggtggcggcaagaatcagccaggcaggaaagactaacaggctgcccagaggccgg

SEQ ID NO: 140355 - DNA, 601 bp, Human
ccttggttctttattcattcagcaaacatctcctgggcatttgccccaatggaaagtactgttctgggcgctgtgggcttttggccatgagcaggaagttgactccggaggctgcagggacctgcttaggcatcctcattaccgcctgggtcccagagcgagccaggagcctctgaggcagcgggggcttctcaaccacacacctggctctcctcctccaagactttctgcgtgcaccagcatcttccattttgtgtttcctgtctgtttaccatgtgtaattttgtcagcatgtcacgtycctttcataatgaagcaagggacaaagaaacaagggccagtggagcccagtacagggtggccagaggtgtcggctctatgtaggtctgctgctctggtgtgtccctgcgtgagggtcaggctggggaggtggcggcaagaatcagccaggcaggaaagactaacaggctgcccagaggccgggagccggtgcatgggtggtagtggttgggggcattgctgagtgcagaggctccgggggaaaagccaggggttaagggatgccaggcaggcatctgacctgggactgaatcctctggca

SEQ ID NO: 140356 - DNA, 601 bp, Human
tgggtggtagtggttgggggcattgctgagtgcagaggctccgggggaaaagccaggggttaagggatgccaggcaggcatctgacctgggactgaatcctctggcagcaacctagaagcagctcagcaaggtgagggagatttgaggcatcagaggcaaattatgtcctcttagagcccctgcggatctgccaagactgagggcttctctgtctcttttctgcatcctgtgcttggctgaagatgagaaccttgctttcccactgagaggcagtgggccacagcactgcgggagccacgrcatctgcagacgcatttgatttccccattaatagcaaagctcccactccaaggatcttccagcagacaaagggcattttaaccttcctctcagtcccagttgcttggagtggctcatgtggcctctctgaaggagggaggaggcttcagacagccccatgcatgttcagaggcaacagaaatttgcaggaagggccaggcgcagcggctcacacctgtaatcccagcactttgggaggctgaggcaggtggatcatctgaggtcaggagtttgagaccagcctggccaacatggtgaaac

SEQ ID NO: 140357 - DNA, 601 bp, Human
aggaagggccaggcgcagcggctcacacctgtaatcccagcactttgggaggctgaggcaggtggatcatctgaggtcaggagtttgagaccagcctggccaacatggtgaaaccccctctctactaaaaatacaaaaaacagccaggtgtggtggcacgtgcctgtaatcccagctactcgggaggctgaggcaggggaacctcttgaacccaggaagcgggagttgcagtgagccaagatcatcccattgcattctggcttgggcgacagagcgagactccgtctaaaaaaaaaaaaaagtgagagagagagagcaggaaggaaggaaggaaggctctcatgcagaaggctccggccttggctgagcatccagtttgctgggtacctgggccaggcccttctctcttgggcaatgagactcccaatgacagctgcctcgcagggctgctctgagagtcagaagacctgttcctgagttttagggatgctcagttgagcaggacctggccctgttctctggagctcatggtctgggggacaccccctcacctgcctctggactctctggcgtccatccagccacttcagtgcgacgtgtg

SEQ ID NO: 140358 - DNA, 601 bp, Human
gcactttgggaggctgaggcaggtggatcatctgaggtcaggagtttgagaccagcctggccaacatggtgaaaccccctctctactaaaaatacaaaaaacagccaggtgtggtggcacgtgcctgtaatcccagctactcgggaggctgaggcaggggaacctcttgaacccaggaagcgggagttgcagtgagccaagatcatcccattgcattctggcttgggcgacagagcgagactccgtctaaaaaaaaaaaaaagtgagagagagagagcaggaaggaaggaaggaaggctcycatgcagaaggctccggccttggctgagcatccagtttgctgggtacctgggccaggcccttctctcttgggcaatgagactcccaatgacagctgcctcgcagggctgctctgagagtcagaagacctgttcctgagttttagggatgctcagttgagcaggacctggccctgttctctggagctcatggtctgggggacaccccctcacctgcctctggactctctggcgtccatccagccacttcagtgcgacgtgtgactgctgcttgtgcccttccccaggagtggctgtgttcc

SEQ ID NO: 140359 - DNA, 601 bp, Human
attaacttcttcctggccatggatacaggtccctgaggacaccgtgtgtggggacagcaaagccttcctaatcccccagccggccaggcaccttcacacctaaatggaaacctgcatgctggtttccatgaagaaaaggttgcgattggggtttctgggaggccagtgaggggttgggactctacagaggagagtggactcacggggcgctgggccgccctccagccaaggctcctggcctgggggaaagggggcaagggatgagggatgcagggagcagtgtgttcagaaaaggttgttycctgagcacagatttgacacctcttcactgtcagcgctgagacacgcccctgccctggggagctcagaaagtcaggtgcgggatccagtggcctaattttagatcttgggtctccatgtcgaaacgacagcagagtgattaaaaaagaaaacgacagcatggccttgcccccttgttaattatggatcaagcacatttccatgagaggggcatctccacgcagggccaccgtggccgcatttctgcagcctgcaggtctccgtggcacccacaccccccaaccgggaatgggggtggact

SEQ ID NO: 140360 - DNA, 601 bp, Human
ccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaayaaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctcaaaaaaaaaaagaattccatggctgcttgtcactgcagagggttggtctcacagcctggtcagggtcctgctgaggagatgtggcctggtcactgtgccttctggacacacaccacctagtgtggacacttgccacc

SEQ ID NO: 140361 - DNA, 601 bp, Human
agcaggcaaaagtagggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgacagcacctgtaatgtaggcaggcaatgggctcctccaggtggcaggaacacygtgaggagcatgcaacgtgctggagaccatggggcatgtgacctccgggcacaccctggacagacctgggtgagaggtgggctgggacgccaggacggtgaggggcttcaaggtgtgtttgtcctttgtccttatacaggtgacctgcatgggcgggtgaggtccatcagaatgctctagaacaggacaactgaggtcccggctgccccgctcaacacgccatgattcctagactgccctgagaggtcaggttttaaatagggtgtggcccggcaaggaccctgagggatgtgaggccag

SEQ ID NO: 140362 - DNA, 601 bp, Human
aggttgcagtgagccgagatcacaccattgcactccagcctgggcgacaagagcaaaactccgtctaaaaaaaaaaaaaagaaaagaaaaagaaacacaagctgggcttcctgcttcccagctgtgtggctttgggccagttactcactgtctgggtgcctccatgttcttgtttccttatataaaataaagttctttcctcgtggattgtcaggaggattctgtaataatccacaggatgtgttctgcatgcactaggtgctcaactttcctgacccccgtccagtgcccccctcaccgrccacgtctgccctctaagctgccagtcctataggaggcattaagacgtctagcaaggctgtgttctcagatgcctcgaaatgggacctcagccttggagttctctcctcccacatggaggcaagtcactgacagtcatctagcaaattgtatgcatggtcaagctcagaggttctattttgggtcaaaaaaggcatgagctggctgggcgccgtggctcacgcccgtaatcccaacactctgggaggctgaggcaagcaggtcacctgaggtcagcagttcaagaccagcctggccaaca

SEQ ID NO: 140363 - DNA, 601 bp, Human
caactcagattctgtcttttccagaagatgtctctgtccttccatgcccccagcctttgttccttgtcctcccctgtccctgcactcctggggtgggccctcctgctcccgagcctcctgcgtggaggctgtgagctccctgccacctgcgtggtcagtctttcctgcaccagcctcccaggacccctcctgcccacgctcctgagagattcaggcgccagtgcatgggtggggcacaggggctgcggcagacagagggtggtgatacaggggtggagtcccacaggccggatgccttgayacttctcagctgcagggctgtgcccggggctctgtgcccctgaatgagggcaatggttcccctgcacagtgaccttgtgagctgattcaggccccatgatcgtgattagctgacagcacattggccctcagagaaatgaaaatacacagttacacagtagcaaaatcccacgagcagtccctcagctggggcagggacacacggactgtggcacgtccacaccaaagaatcctgcgtagccacaaaaaggaacaagctggggatacatgtgacaccctgggcgcatcgcagaggcatcat

SEQ ID NO: 140364 - DNA, 601 bp, Human
atcagcagctgagtggcacacacacaggggatctcgcctgaggcctgggccagcatggggaaggcccctgcaggctgctgggcacggggatggctcagggtcctgggctgggctgggctaggcttgggggagcccggtgtgttgggctggagctggcctctgctgtcgctggaccacagtcacccatggagggcaggggttgggaacctgcagggacagcatctgccctctggccggtggggggttcttagtagcagggcaaggggaaggcaaagggggccaggcccaggagcaggtgggkcctcctcacaggagcagggcaggattcgaggagctctgggctcccacctccgagctggactctgagcatgctggctccttccttctttccagggcagcagcagccccacattcaggacagagccatctgtgtaagcagggctcagagaccctcagacagacagggaaaaggagcaaaatgtattgtcatcgtccagcctgaaatctccagtgggacccgtcagtggagcacgtagcagacaccctgtccctcccgtgccccccggcctgtaagggcagctgaggccgtcttacctgctga

SEQ ID NO: 140365 - DNA, 601 bp, Human
gggcacggggatggctcagggtcctgggctgggctgggctaggcttgggggagcccggtgtgttgggctggagctggcctctgctgtcgctggaccacagtcacccatggagggcaggggttgggaacctgcagggacagcatctgccctctggccggtggggggttcttagtagcagggcaaggggaaggcaaagggggccaggcccaggagcaggtggggcctcctcacaggagcagggcaggattcgaggagctctgggctcccacctccgagctggactctgagcatgctggctccytccttctttccagggcagcagcagccccacattcaggacagagccatctgtgtaagcagggctcagagaccctcagacagacagggaaaaggagcaaaatgtattgtcatcgtccagcctgaaatctccagtgggacccgtcagtggagcacgtagcagacaccctgtccctcccgtgccccccggcctgtaagggcagctgaggccgtcttacctgctgagggagaccccgcactccctgacttcccgggctgggtgctggcactggtgaagggtttcgggctgtgagcctcttgcctt

SEQ ID NO: 140366 - DNA, 601 bp, Human
catttcagtggatgcagggagcacagagcatgagtcgcacctggtggacgggcaggtgtagcaggccctcatgagaggaacaccattgactttcccactgggtgaggaagggacagctctgtaccatttccctctgctcaaacccacaggagccagccagggcatggacactcccatgaggtcacctttgctggtctgttccttgcggggctgctgagttcttgatagaggtaacaagcaaccctggggctcccgtgtgcaggaggaaggttggggactgcctggttgtgcttcggacccrgaggcagacagaggaggcctttgaacttggcctgagcttgttgggtgaagccaaggacagaggctggggtctgagtgaggggagatggtcccgtgaagtcagattggcacagattcccccatcagagttgggaggccccagaatgttcaggaacagcatgtggcaggggtcataactgaagccagacctgagttacaatccatttactcactgtgtgtccttggcaagtcctgcaagggaggcacactatcggacgtcccccgtggggctggcatgcagattgaataggatacatggctg

SEQ ID NO: 140367 - DNA, 601 bp, Human
tgagaaaccattgctaaatccagggtcatgaagatttatacctatgttttcttctaagagttttatagttttagctcttacatttaggtctttgatccatttcgagttagtttttgtatatgatgtgaggctgagagtccaccttcattcttttgcatgtgaatatcctgttgtccttgtgctatttgttgaaaaggctattctttccacattcatttgttttggcagccttgttggaaatcacttgccatgtatgtggaagtttatttctgggctctgtatgctattccattggtctatrtctatccctatgtcagtgccacactgtcttgattactgttgcattgtggtaagtttgaaatcaggaagtgagtcctccaactttggttttttgtttttttgtgtttttttgagatggagcctcactctgtcacccaggctggagtgcgatagcacgatctcggctcactgcaacctctgcctcccgagttcaagcgattctcctgcctcagccttacgagtagctgggattacgtatgcccaccaccactcccagctaatttttgtattttcagtagagacaggtttcgccatgttggcc

SEQ ID NO: 140368 - DNA, 601 bp, Human
tgaaaaaaattgagttttttgttttcttattatcaagttctaagagttctgtatatatttttgatataagtccctcaagaagtatgtgctttgccaatattttctgccagtctatggctgatcctttcattctatcaagaatgtcttttgaagagaagaagctttaaaagtttggtgaatttcaagttatcacgttttcttttatgaatcatgcttttcatattgtgcctaagaaatcatcatataatccaagatcataaagattctctctagtctattttcttctaaaagttttagaagrctttatatatttagattgatatatttatatatagatttaggtttatatttctatttatagtccatcttgaattcatttttatattttttctgagttatggattgaagttctttttttttttttttttttttttgcatatgatagccaattgttccagtggcatctgtggaaaggctgtcctttctccactgaattgccttagcactttgtcagacatctcaaaatctggttgtgttagttccactttgtccttttatttcagagttgtcttgagtattctaagttttttgtattttcata

SEQ ID NO: 140369 - DNA, 601 bp, Human
ttttttttttttttttgcatatgatagccaattgttccagtggcatctgtggaaaggctgtcctttctccactgaattgccttagcactttgtcagacatctcaaaatctggttgtgttagttccactttgtccttttatttcagagttgtcttgagtattctaagttttttgtattttcatatccatctatttgtggtttccatctgatttttgacatagatgattattgttgtctgtgaataaagacaaatcctactgagacagactgagaccatgtctcataaaaaagaaaaaaaaaaccatttcagaataatgcgttagtgtcctagcaacctcagcatgtctgcctttagccagctggggacccttcaagtgtttcttagtgttcttctggcgtttccacctcgtctttcatagctttcagtctcaggttcaacatcttctgttcccagagtagactggaatcggccttttaaccaaggagctctggttatttttagtggaaaatgatatttggagaccacagtttgaatgctagggtgctcactgttccaggcctctctaggaaaaatgatttttttttttttttttttgagacg

SEQ ID NO: 140370 - DNA, 601 bp, Human
atcctaaatacagtaacataattaatgtgtatatagtcaaaataataataatatctgtattattaaatattttatcaccaacaatagatttactcgatgcagtctagaatctttctggttcttttgtcctcaggctgtgcggcaggagggaggattagtcaaaatactgtatttcaaaatcacttgaaacttcttatctgtgtttttaccaggtttattgattgagtttttggatttctagtagttcctttgttctctctctttttttttggagacggagtctctctgtcacccaggctgragtgcaatggtgccatctcagctcactgcaacctccgcctccggggttcaagggattctcccacctcagcttcccaagtagctgggattaaaggcacccgccatcatgcccggctaatttttgtattttcgtagagacggggtttcaccatgttggtcaagctggtcttgaactcctgacctcaggtgatccgcccgcctcggccacctaaagtgctgggattacaggtgtgagccactgtgcctgccctgttcttactcttaattatgcaaaacatttacatggttccatagtcaacaa

SEQ ID NO: 140371 - DNA, 601 bp, Human
cttctccagggtggggctgtagcgcagttcattcagcccctccccctgccagtggacactggggtgggttccatctttatacgatgctataggtagtgctggagctagaatttgaactcagagcccatgttcctattgctctttctcctgtgctctgtgggccgtcataatggaggaggcggggagcaaaacggagtgaagaggttgagcatgagcactgaggctgggggaggcgagtgtcccccgctgtgccatggcccctcgggtgtgaagctgggtcatgttgctttgctggggcctygggtgcaggttgtctggaagtgggcagctggtgctgggacctgctctctggcactagtgtgctcactgcagggcgagagcttgggtgcaccttggacagggattgattcactggactagctggtggagtgggcaggtctgttgatctgttggagacaatgactgttggagcccttgagcaggctgtgtcacgtggaagggcagttgagccatgtgctgtgggacgctttggatgctgccctgagctgccactggtcctatgtcctggagaggccctggcccaggttcagcagcactggcc

SEQ ID NO: 140372 - DNA, 601 bp, Human
tagtatcgttccaggcatttcatgggcaggaattcgcttaatccgcacagcagctctgtgacgcagtcgagagtattattagctccattttacagatcaggaaacaggcagagagaaaggaaataacctgcccaagctccaagctgcaagtagaggagccggtgtttgagcccagaacctggcgctgggagccacgagctgccctgctgggcactggggtggacacttgcccatcagtccttcagtgagtgcgaaggagccgtgtctcacttcaaagagggatttaaaaattctaccctcrccgggcacagtggctcactcctgtaatcccagcactttgagaggccgaggcgggcggatcacctgaggtcgggagtttgagaccagcctaaccaacatggagaaatcccgtctctactaaaaatacaaaattagccgggcatggtggcgcatgcgtgtaatcccagctactcgggaggctgaggcaggagaatcacctgaacccgggaggcggaggttgtggtgagccgagattgcgccgttgcactccaggctgggcaacaagagcgaaactccgtctaaaaacataaacaaaaataaa

SEQ ID NO: 140373 - DNA, 601 bp, Human
gggagagacgggcgctctcacatgtcctgggccacatgccagggctaggagcctttcatccctcacctgctctacccctccttccacgctggccggggatcggggtggggggtactgtccgtcctgtttttcgtactttgcagctgactcagtttaggtagcgggcagctgagtgatttgcctatgaagtgctgtcggcttttggcgaatgtcaaggccaggatggtgtccctgggtctcgaccccattcctgttttcctcccactccacttgccttgggcctgtctcttctgccctagggtagaggctgtgggtgagatttgcaaaaaaagaaaaggagccggcatttggggaggagacctgtgtgttccagagctcagctgggaactccttgccagggtgtgggagaggctgggctactgaatggagcaaacacacacccagggcccggttgcattagggttccaggtcaacagcacagactgttttaggattaaaagcagtcccatgggacaggttgcaccaaaacattgtttgtttgtttgtttgttgtttgatacagagtttcgctctgtcacccaggctggagtgcagtggcacg

SEQ ID NO: 140374 - DNA, 601 bp, Human
cgggcgataaccagctcaggactgtggaaacagcaggcaggcaggaagagctcccttctctccaccgttggtggccagatgttgagattccagatgtgattagtttgaaaaaaaacaaagtaaaaggattctgaggctaaaagtcactgtttgaaagtctgtgccttgagaagagcacttgggcagagggaggagggtgaggggttttctttgctttgctttgcgcctgtgatggacactttgtgaggcccccagcggaaatttgggcctgtgctctgaaggccgcgtgctcctgcagccwtgggctcctctggcagttctgctggggcccttttagagtctgtgggatgcactcagcagctcccaggtagggcctgaggtcagaccccatgtgtctccccagggacagatcttctccgccagacgtctctttctgcctcttggtgggttcatggctgtgtctggttgaagagttgtttccagaaggaccttgttgtccgtccagatgaactgagcaagtgtgaaaatccctgtggaacttgctctagggcagataatgtgcagctggggtgcatgtggttgttgctcccgtgtaattctt

SEQ ID NO: 140375 - DNA, 601 bp, Human; identical to SEQ ID NO: 35614

SEQ ID NO: 140376 - DNA, 601 bp, Human; identical to SEQ ID NO: 35615

SEQ ID NO: 140377 - DNA, 601 bp, Human; identical to SEQ ID NO: 35616

SEQ ID NO: 140378 - DNA, 601 bp, Human; identical to SEQ ID NO: 35617

SEQ ID NO: 140379 - DNA, 601 bp, Human; identical to SEQ ID NO: 35618

SEQ ID NO: 140380 - DNA, 601 bp, Human; identical to SEQ ID NO: 35619

SEQ ID NO: 140381 - DNA, 601 bp, Human; identical to SEQ ID NO: 35620

SEQ ID NO: 140382 - DNA, 601 bp, Human; identical to SEQ ID NO: 35621

SEQ ID NO: 140383 - DNA, 601 bp, Human; identical to SEQ ID NO: 35622

SEQ ID NO: 140384 - DNA, 601 bp, Human; identical to SEQ ID NO: 35623

SEQ ID NO: 140385 - DNA, 601 bp, Human; identical to SEQ ID NO: 35624

SEQ ID NO: 140386 - DNA, 601 bp, Human; identical to SEQ ID NO: 35625

SEQ ID NO: 140387 - DNA, 601 bp, Human; identical to SEQ ID NO: 35626

SEQ ID NO: 140388 - DNA, 601 bp, Human; identical to SEQ ID NO: 35627

SEQ ID NO: 140389 - DNA, 601 bp, Human
tccaggagtttgagaccagcctgggcaacatgacaaaatcctgtctctacaaaaataaaaaattagctgggtgtgggtgacatgtgcctgtagtctcagctactctggaggctgaagtgggaggattgcttgagcctggacttagaggctgcagtgagctataaccatgccgttgcactcagcctggatgacagagtgagattctgtttcaaaaaaaactttaaacctaccacccagagataagccctgctaattatgtgaaagagcttttcttctctctctctctctctctctctctctstgtgtttatatgtgtttggggatgggtgcacactcttcataaacttttttttttttgagacagggtctcgctcttttgcccaggctgtagtccagtggcatgatctcagctcactgcaaactctgcctctcaggttcaagagattctccagctcccaagtagctgggattacagtcatgcaccgccacgcctggttaaattttgtatttttagtagagatggccatgttggccaggctggtctcgaactcctgagctcaggtgatctgcccacctcagcctctcaaaagtgctgggatta

SEQ ID NO: 140390 - DNA, 601 bp, Human
gtgcctgtagtctcagctactctggaggctgaagtgggaggattgcttgagcctggacttagaggctgcagtgagctataaccatgccgttgcactcagcctggatgacagagtgagattctgtttcaaaaaaaactttaaacctaccacccagagataagccctgctaattatgtgaaagagcttttcttctctctctctctctctctctctctctctgtgtttatatgtgtttggggatgggtgcacactcttcataaacttttttttttttgagacagggtctcgctcttttgcccakgctgtagtccagtggcatgatctcagctcactgcaaactctgcctctcaggttcaagagattctccagctcccaagtagctgggattacagtcatgcaccgccacgcctggttaaattttgtatttttagtagagatggccatgttggccaggctggtctcgaactcctgagctcaggtgatctgcccacctcagcctctcaaaagtgctgggattacagggcatgaaccaccatgcccggccttcatcaattttttaaaaacgactttattgaggtatactttatgtatcacaaaattt

SEQ ID NO: 140391 - DNA, 601 bp, Human
gggtgaggtggggaaagccttaactggctcaggggtgagaggtcagggagccattgagactggctccaggtgtgggtcccctgctgggttggggcttgtgggaggtgggacggggctgggggtccatccccctagggggaatttgtggcctaccccgaaccctgtttgagctcctttcctaactgactccccatccctgcacctgtctcccagcaggccttgcctctgcatgctgcccctgccaggctctggggtccctgtgctccctgcagctagaaggctgggatcaggggtcttaacragcagccctactgtatgaccttggacaagtccaagaaccttcaggttcttaacaatgtaaagggaacagtactaaaagcagcttcttggaattgtggggatccgatgagtgaaggcttaagcagtgcatggcacatagtaggccctgaaccaatgccagttagtgttattattatcaccatttagccagatgcagtggctcacgcctataatcttattgactttagaggctgaggttggaggattgcttgagaccaggagttcaagaccagcctgggcaacatagcaaggccctgtttgt

SEQ ID NO: 140392 - DNA, 601 bp, Human
caggtgtgggtcccctgctgggttggggcttgtgggaggtgggacggggctgggggtccatccccctagggggaatttgtggcctaccccgaaccctgtttgagctcctttcctaactgactccccatccctgcacctgtctcccagcaggccttgcctctgcatgctgcccctgccaggctctggggtccctgtgctccctgcagctagaaggctgggatcaggggtcttaacgagcagccctactgtatgaccttggacaagtccaagaaccttcaggttcttaacaatgtaaagggarcagtactaaaagcagcttcttggaattgtggggatccgatgagtgaaggcttaagcagtgcatggcacatagtaggccctgaaccaatgccagttagtgttattattatcaccatttagccagatgcagtggctcacgcctataatcttattgactttagaggctgaggttggaggattgcttgagaccaggagttcaagaccagcctgggcaacatagcaaggccctgtttgttttagagaaaacaaacaaatcaccatttagagcacctaaccagtacctggcacgcgataggtttag

SEQ ID NO: 140393 - DNA, 601 bp, Human
aaccttagcactgccattttgactgaaaacaggtgcccagcagcaggggctactcccagaattgccactgcatcaggcccgtgggttgttttcagctgccagtgataagtatgtgccctgggccacctctcggacaaggtgtctgaattggtgccgaccagcatcacatgtaattgccatctcgcaggtgctgctgagggtaattccgcacacctgtagctccgggaagagcctagtggggaggaggaaacgtggctctgaggtttatagggtcagacggtcagtatgttgggagctggcrtgtggaggggcacagacaagggaagaatgggaggtggcatcagagcaagttttgatggaggaataggaattcaccaggtggaaagggcattcctggtggagggaacagcctggccttcaatagcttgtggtgttcagaaagcaggcagggaaagggaggcccagggagacaccagttaggggatgggggtggaggcagacgagggtggaggaagccatggctggagtctgcacggcctctgactggggtccctgctgtggtcagccctgtgctgggtgaggctggggtcacagctggttc

SEQ ID NO: 140394 - DNA, 601 bp, Human
tcctggcctccaccccctcactgcctccgctcctcctatcctgcccacgcccactgcagggcctttgcacacactgtttcttctgccctcccttccggcccactccctcatatcattcagtcctcctttcagatgtcacctcctaagatgggctgccctgaccacctcatctataatggccccagtgcctggcacaggattggcacacagtagatattgtcagagatggatctgggttctgtggacaaggctgtgggggcaggtgaagagctccctcttccaggaggttgtttggggttcraggccttgtttgggttgtaggcttctgtgctggtcagcgttgggccctacaagcgcatgccatgaggcctgcccaggatttccctcatggcctcacagaatacatcggccagagtcattaaagggcgcctgcatctgccttcagagagaggtttgaaggtagaactggggagggatgccaggtgggggttcaggtttcctgttgggtcctgatagaatcagggcaggagaggaagaagaagagggaagaggaggaacccaggcttggggaggggtggcagggcttcacaagcctggggaa

SEQ ID NO: 140395 - DNA, 601 bp, Human
ggctggctctagagtttcctttttcagtcttaacctggtgaccagcttccacagaaattggcacggtgactcatgcctgtaatcgcaacacattgggaggccgaggtgggaggatcacctgaggtcaggagttcgagaccagcctggccaacgtggtgaaaccctgtctctactaaaaatacaaaaattacatttcattacaggtgtggtggcgcacacctgtaatcccagctactcaggaggctgaggcaggagagtcacttgaacccgggaggtagaggttgcagtgagctgagatcgygtcactgcactccagcctgggtgacagagccagactctgtctcaaaaaaaaaaaaaaaaaaaaagaaattggccagtagatcagccccaggggagagtgagccagggtttggccaggccttgagtttcagaggctggccatggccagtggcacccaggcccttcccccttcctcggggcatcttagcttagtctgtgccctctgcccaagggccagccctctgttcccaggtcacaccccctcctcttggaaggccccccccgccccacccccatcagagtctttaatgactctgctgcc

SEQ ID NO: 140396 - DNA, 601 bp, Human
ctctactaaaaatacaaaaattacatttcattacaggtgtggtggcgcacacctgtaatcccagctactcaggaggctgaggcaggagagtcacttgaacccgggaggtagaggttgcagtgagctgagatcgcgtcactgcactccagcctgggtgacagagccagactctgtctcaaaaaaaaaaaaaaaaaaaaagaaattggccagtagatcagccccaggggagagtgagccagggtttggccaggccttgagtttcagaggctggccatggccagtggcacccaggcccttcccycttcctcggggcatcttagcttagtctgtgccctctgcccaagggccagccctctgttcccaggtcacaccccctcctcttggaaggccccccccgccccacccccatcagagtctttaatgactctgctgcccctggggctcagagagcaaccgccctctcccatcgcgcttcctcagtgggatgggagggggttagagcaggaagatgagacaaataaagacacaataagaggcaggagtatgtggtaaagccaagatgggtaaggggaggggacaggcttgactgttcacagtggcc

SEQ ID NO: 140397 - DNA, 601 bp, Human
cactcatgtcagagcctttgccaagagcaatgctgtgttttgttttgggggtgagggaacacccgcgggctgaggggagggttgggccatgctagagaggccgtctgttgtccttgaacctcccaaagctgggaaataagggcctgggctggacggcggtggcgaggacaggttgcgagagagacatggctgggttttcttgcttagggtcctgaatagagagcaaggttgaggccgcagggaccccagcccccaatggactgctgagtcgctgggtctgcccagggttcaggcaccctcycaggttgcagccaactggggtgtggaccaggcagaggcgctggcctgcagtttggggcagaggcaggctttgctggtggtctacttggctgcaaaatcatctggccaggctctgatcactttgtgtgtgtgtgtgtgtgtaacttttacctttgacaaaagagggaagacaggcccaggcacctcctcaaaagaaccctagagcctgtcaccccttccttacccatcttctgtcctagggactgcagcccttcctggcttcccagggccctacaatgaatagtgggtcgggactcacttg

SEQ ID NO: 140398 - DNA, 601 bp, Human
ccgtctgttgtccttgaacctcccaaagctgggaaataagggcctgggctggacggcggtggcgaggacaggttgcgagagagacatggctgggttttcttgcttagggtcctgaatagagagcaaggttgaggccgcagggaccccagcccccaatggactgctgagtcgctgggtctgcccagggttcaggcaccctcccaggttgcagccaactggggtgtggaccaggcagaggcgctggcctgcagtttggggcagaggcaggctttgctggtggtctacttggctgcaaaatcawctggccaggctctgatcactttgtgtgtgtgtgtgtgtgtaacttttacctttgacaaaagagggaagacaggcccaggcacctcctcaaaagaaccctagagcctgtcaccccttccttacccatcttctgtcctagggactgcagcccttcctggcttcccagggccctacaatgaatagtgggtcgggactcacttggtgactgctgggttgtgaggccttgagggggaggggcagacttcacccatctggcagagggacatcggtgctggcagtcaggaaacccttatttccaggc

SEQ ID NO: 140399 - DNA, 601 bp, Human
tcctcttgggggacttccctgtctgccattctctttggggatcctgcgctgccctaggaagagtgggcccaggctgcacagttggtccttggtcacagaggatcccaccacttcttcagggcctcaaggcaatcctgcctctctctgcacccctcttccccctgtaaactgaggggaggggaaaatcacccactcctcagcagtttctaagttgctttgtcaaattcagtgcccagaggatcctgctgggggtgcgttttaggatgagaccaggagtggccaatggtggggtgtggggccyatcgctcctatatgaagaccccctctgccctagactgctcctccctccccatccccatctccatcccaaagactggagctgctggatctgtggatggaggcgtgccccccgtttcacacattgagaaacaggccccaagtggagccagggaaggctgcacctgggcctctggattccttttgttctgtgtggggttgggggtgatggactgtggagagggcaggagagctgtctggaagggttggtcacctcatgggcaaatgcttggaagctggtctgagtccacggtgcagtgtgtat

SEQ ID NO: 140400 - DNA, 601 bp, Human
gaacagatcaggggcaactggaaggaagagagggagtgagactgagcctggacaagcagggaattggaattcagcctccccaggcctggccagcctcgtttatttagttaaactggtttgcaggcctcttcaataaaggtggggctgtgctaggcattggggatgcagcaatgaacaagacagacaaaaattgtccctcaaagaagagccgaccttctggtgggggagatggacagtaggcaggatgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaaccccacaacccccgacctgacaggccacctgtgcgctccccctccctcccacaccgtgcagctgaataaa

SEQ ID NO: 140401 - DNA, 601 bp, Human
atgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaaccccacaacccccracctgacaggccacctgtgcgctccccctccctcccacaccgtgcagctgaataaatctgctgtcttgcgcaaggccatcgactacattcgctttctgcaacacagcaaccagaaactcaagcaggagaacctaagtctgcgcactgctgtccacaaaagcagtgagtcctggctttattgagctccagtctggcctcttctctagccttgctccacctcccggccccaccccatccctagccccaccccacccttggttctggcccaccctctgccctgcccacctcacccttggctgt

SEQ ID NO: 140402 - DNA, 601 bp, Human
gatggagagccctgagcctccactctcctggcccccaggtgttcctacatgaggccacggcccggctgatggcgggggccagccccacacggacacaccagctcctcgaccgcagtctgaggcggcgggcaggccccggtggcaaaggaggtgagggggcagctgctgaccagggatgtgctgtctgctcagcagggaagggcgcacatgggatgtgataccaagggaggctgtgtgtgtgtcagacgggacagacaggcctggcgcagtggctcacacctagcactttgggaggctcagytgggaggacagcttgagcccaggagttggaggccgcagtgagcctgagtgacagggagagtccctgtctcaaaaaaaaaaaaagaccaagcatcttcttgatggttacctgatgacaattcctttcacaaggaatcagtggggtgactgtcatttgtgggatacatgactgcacgtgcgtgactcagtctgtggactttgtgtgtgggctgagactagggtggggagaggggaacccgccaggcccccgccaggtacctgtgtgccaggtacaggcggctggtgccgtggcttgtgtgtg

SEQ ID NO: 140403 - DNA, 601 bp, Human
accgtgcccggccattttgtgattctttaatgtctgctctgtctggactagaagctccatgagggcaaggactatactttgctcattgctgaaacactgcggcctgcagtatctagcacagtcagttctgagatatttgctgaataaatgagctttgagatggagtttcgctcttcttgcccaggctggagtgcaatggcgcgatctcagctcaccacaacctccacctcccgggttcaagcgtttctcctgcctcagcctcctgagtagctgggattacaggcatgtgccaccatgcccrgctaacttttttatttttagtagagatggggtttctccatgttggtcaggctggtctcaaactcccgacctcacgtgatccgcccgcctcagcctcccaaagtgctgggattacaggcatgagccaccacgtccgggcattgaataaatgagctttgaacacccagggaaccagatcaaattaaactgggtatttcctcaagttcctggatcaaaacatcacagcctacaaaccgagatcattgtatttggtggttttccccaggctcagcaatgacgaggcaagtgcagccttgcgcag

SEQ ID NO: 140404 - DNA, 601 bp, Human
acggcgcccagctggtatgtcattattatatgtcaataaggctgtttttaaaaatctctcagggaagcacatcctctgtaattgtcaacaggtcactgagtgggggcttcagtccataaaactactcatttcaccagaacaaaacagaaatatctcaagcaatactacttctctttccttaaacactttttctaaatgaagtttcccgctgaacctcttttccttcagctctttggacaatctgcaagtgtcttcactttgtgattctttttttgagacagagtttcaatcttgttgcccrggctagagtgcaatggagcaatctcagctcactgcaacctccacttcctgggctcaagctattctcctgcttcagcctcctaagtagctgggattacaggcgcccaccaccacgcccagctaattgtttgtatttttagtagagacagggtttctttttttttttggaggcagaatctcgctctgtcgcctaggctagagtgtagtggcgcgatcttggctcaccgtgcaacctccgcctcctgggttcaaacaattatcctgcctcagcctcccaagtaactgggactacatgtgcatg

SEQ ID NO: 140405 - DNA, 601 bp, Human
gaaaaagctctgaagcggatatgatgatggttgcacaactttgtggatggttttgtaaaaccactggattatatacttcaaatgggtggactgcacggtatgtctctttttttttttgagacagagtttcactctgttgcccaggctggagtgcaatggtgcaatcttggctcactgcaacctccgcctcccaggttcaagagattctcctgcctcagcctcccgagtagctgggattacaggcacccgcccccacgcccagctaatttttgtatttttagtagagatggggtttcaccaygttggccaggctggtctcgaactcctgacctcttgatccgcccgcctcgacctcccaaagtgctgggattgtaggcatgagccacggcgcccagctggtatgtcattattatatgtcaataaggctgtttttaaaaatctctcagggaagcacatcctctgtaattgtcaacaggtcactgagtgggggcttcagtccataaaactactcatttcaccagaacaaaacagaaatatctcaagcaatactacttctctttccttaaacactttttctaaatgaagtttcccgctgaacctc

SEQ ID NO: 140406 - DNA, 601 bp, Human
ttccattcctaggtatattctcaaaagaattgaaaacatctgtaatcccaccacttttggaggctgaggcacgagaactgcttgagcctaggagtttgagaccagcctagacaacataggtagatcctacctctacaaaaaatgaaaaattagctgggtgtagtagtgtgcatctgtggtcacagcgactctagaggctgacgcaggaggatcatttgagtccaggcggtaaaggctgcagtaagccatcatcatgccactgcactccagcctttttgagatagggcaagaccctgtctcaaaaaaaaaaaaaagaaagaaagaaaaagaattgaaaacaagattcaaacaaatatttacacgaatgttcatagcagcactattcccaatagcccaaaagtgaaaactgcccaaacatctatcaactgataaatggatcaatacatgtagtccatacattagatccatacatatccaatggctggaatatcattcagccataaaaatagtaagtattgatagatgctgcaacatgaatgaaccttgaaaacatgtgctaaatgaaagaagccagacccaaaagaccacatattatatgatg

SEQ ID NO: 140407 - DNA, 601 bp, Human
catttttgtgtcatatgaagaagccattgctgacccaaggtcagcaactctgtctcaaaaactctgtctcaaaaaaaaaaaaaaaaaaaagatgcttgagcatcattagccatcagagaaatgcaacccaaaattcacaaaatcacttcacacccacaaggatggctaaagtaaaacagaaattaacaagtgttgacaaagatgtggagaaactgaaaccttcatatgatgctagtgggaaatgtgcaatagtacaattgctttggaaaatagtttgacagttcctcaaaatgtcaaacayagaattatcctatggcctaacaattccattcctaggtatattctcaaaagaattgaaaacatctgtaatcccaccacttttggaggctgaggcacgagaactgcttgagcctaggagtttgagaccagcctagacaacataggtagatcctacctctacaaaaaatgaaaaattagctgggtgtagtagtgtgcatctgtggtcacagcgactctagaggctgacgcaggaggatcatttgagtccaggcggtaaaggctgcagtaagccatcatcatgccactgcactccagccttttt

SEQ ID NO: 140408 - DNA, 601 bp, Human
ttacttttggcgtagtccaatttttgtgtatttctcttttgtcacttgcatttttgtgtcatatgaagaagccattgctgacccaaggtcagcaactctgtctcaaaaactctgtctcaaaaaaaaaaaaaaaaaaaagatgcttgagcatcattagccatcagagaaatgcaacccaaaattcacaaaatcacttcacacccacaaggatggctaaagtaaaacagaaattaacaagtgttgacaaagatgtggagaaactgaaaccttcatatgatgctagtgggaaatgtgcaatagyacaattgctttggaaaatagtttgacagttcctcaaaatgtcaaacacagaattatcctatggcctaacaattccattcctaggtatattctcaaaagaattgaaaacatctgtaatcccaccacttttggaggctgaggcacgagaactgcttgagcctaggagtttgagaccagcctagacaacataggtagatcctacctctacaaaaaatgaaaaattagctgggtgtagtagtgtgcatctgtggtcacagcgactctagaggctgacgcaggaggatcatttgagtccaggcgg

SEQ ID NO: 140409 - DNA, 601 bp, Human
ttttactgttagcttttggacaaggtcaggcacaggataacttacttttgggtataacactacatttttgtattttttgtagagacagggtctcactatgttgccccagctggtcttgaactgctggcctcaagtgatcctcctgccttggctttctgctgagattacaggcatgagccactgtgcctggctttttttcattgttaacttggaagagttctttatatattctagatacaagtctcttatcagatacatgatttataaatatattccctcattctgtagactttcatttcamtttcttaattttgtccttagaaacacaaaagttaggccgggcgaggtggctcacgcctgtaatcccagcactttgggaggctgaggagggtggatcacgaggtcaggagatcaagaccatcctggctaacatggtgaagccccgtctctactaaaaatacaaaaaattagccaggtgtggtggtgggtgcctgtagtcccagctactcgggaggctgaggcaggagaatggcatgaacccaggaggcagaggttgcagtgagccaagattgtgccactgcactccagcctgggcaaaaga

SEQ ID NO: 140410 - DNA, 601 bp, Human
caatcctttgttgaggttttcaattggtttgtctttttttactgttagcttttggacaaggtcaggcacaggataacttacttttgggtataacactacatttttgtattttttgtagagacagggtctcactatgttgccccagctggtcttgaactgctggcctcaagtgatcctcctgccttggctttctgctgagattacaggcatgagccactgtgcctggctttttttcattgttaacttggaagagttctttatatattctagatacaagtctcttatcagatacatgatttayaaatatattccctcattctgtagactttcatttcaatttcttaattttgtccttagaaacacaaaagttaggccgggcgaggtggctcacgcctgtaatcccagcactttgggaggctgaggagggtggatcacgaggtcaggagatcaagaccatcctggctaacatggtgaagccccgtctctactaaaaatacaaaaaattagccaggtgtggtggtgggtgcctgtagtcccagctactcgggaggctgaggcaggagaatggcatgaacccaggaggcagaggttgcagtgagcc

SEQ ID NO: 140411 - DNA, 601 bp, Human
gattacaggcctaagccaccacacctggcctcaagcatctttttatgtgcttattggacattctaaattttctttaaagaaatgttcattcaatcctttgttgaggttttcaattggtttgtctttttttactgttagcttttggacaaggtcaggcacaggataacttacttttgggtataacactacatttttgtattttttgtagagacagggtctcactatgttgccccagctggtcttgaactgctggcctcaagtgatcctcctgccttggctttctgctgagattacaggcatragccactgtgcctggctttttttcattgttaacttggaagagttctttatatattctagatacaagtctcttatcagatacatgatttataaatatattccctcattctgtagactttcatttcaatttcttaattttgtccttagaaacacaaaagttaggccgggcgaggtggctcacgcctgtaatcccagcactttgggaggctgaggagggtggatcacgaggtcaggagatcaagaccatcctggctaacatggtgaagccccgtctctactaaaaatacaaaaaattagccag

SEQ ID NO: 140412 - DNA, 601 bp, Human
tatctccattttactgaaacccagaaagtttaataacttgcctgacatctgggaatgagattctggggaagtgaggatgtgagcctgggcagccaatgtccagaaccccactccaaaccactgtgccctgcagctccccaggacacagtcatgtggctgcaggtcagcacatgctgatccaggccacgagcagggttttgaaagcttaagtgtgaatgctgtacacatattctttgcctctcagactcctgctacaggaacacgatacatcaagttcataccataaaccagaataaaattyactactctgcaggacttggactcacatccaaagataaattactaccaaataaggtctacgattcaactcaaactctgtattttgtgtttctctgacacctatttatcatattagaactttaaaagttgacaatttttagaggcatttatatgacacaatgaaggccaaatcataccttacatttgtcattcaggttgctaaattcaagcaaaaatgtggccaataaaagttatctaagtctagaaataaatccttatattgatgctcaattaattctcagcaagagtgtgaatacaatac

SEQ ID NO: 140413 - DNA, 601 bp, Human
tcctgggctcaagtgatcctcctgcctcagcttcccaagtagctaggactatagggacaggtcagcatgcctggcttctttttattactattattatttttttttagtagagacaggagcttgctgtgttgcccaggctggtctcaaactcctgagctcaggtgattctcctgcctcagtctcccaaagtgatgggattacaggcatgagctaccaaaccccacccaggctagaatacattttttttttttttttttgagatggagtttcactcttgttgcccaggctggagtacaatggygcaatcttggctcaccgcagcctccacctcccaggtgcaagcaattctcctgcctcagcctcccgagtagctgggattacaggcatgcaccaccatgcctggctaatttgtttgtatttttagtagagacggggtttctccatgttgttcaggctggcctcgaactcctgacctcaggtgatctgcccaccttggcctcccaaagtgctgggattacaggtgtgagccaccgtgcctggccgctagaatacttttgaagaaagctgcatcccttactaccccaatgcagtgtcacaaagc

SEQ ID NO: 140414 - DNA, 601 bp, Human
tcttgctctgttgctcaggcaggagtacatggcgtgatcatagctcactgcagccttgaactcctgggctcaagtgatcctcctgcctcagcttcccaagtagctaggactatagggacaggtcagcatgcctggcttctttttattactattattatttttttttagtagagacaggagcttgctgtgttgcccaggctggtctcaaactcctgagctcaggtgattctcctgcctcagtctcccaaagtgatgggattacaggcatgagctaccaaaccccacccaggctagaatacattttttttttttttttttgagatggagtttcactcttgttgcccaggctggagtacaatggcgcaatcttggctcaccgcagcctccacctcccaggtgcaagcaattctcctgcctcagcctcccgagtagctgggattacaggcatgcaccaccatgcctggctaatttgtttgtatttttagtagagacggggtttctccatgttgttcaggctggcctcgaactcctgacctcaggtgatctgcccaccttggcctcccaaagtgctgggattacaggtgtgagccaccgtgcctgg

SEQ ID NO: 140415 - DNA, 601 bp, Human
taccttttttggtttttggtgttttttttgagacagattttcactctttttacccaggctggagtgcaatggcgcaatctcagctcaccacaacctctgcctccaggggttcaagcgattctcctgcctcagcctcctgagtagctgggattacaggcatgccccaccacgcccaccacacccagctaattttttatttttagtagagacagggtttctccatgttggtcaggccggtctcgaactcctgacctcaggtgatccgcccgcctcagcctcccaaagtgctgggattacaggygtgagccagcacccggcctagaatatctttttttaagagacggggtcttgctctgttgctcaggcaggagtacatggcgtgatcatagctcactgcagccttgaactcctgggctcaagtgatcctcctgcctcagcttcccaagtagctaggactatagggacaggtcagcatgcctggcttctttttattactattattatttttttttagtagagacaggagcttgctgtgttgcccaggctggtctcaaactcctgagctcaggtgattctcctgcctcagtctcccaaagtgatg

SEQ ID NO: 140416 - DNA, 601 bp, Human
ctggaacagggcaggacgtgccacaaaggccatctcaggagagtcccctgggcgtctgctcaactgttcccctcctacctggagtccccttgcccttcactacctggcaggttccttttcattcctcaagatggcagcacaatggcgtggcctcccggggagcagcagttcctgcctgcctgcctgagccccaacgccacgattactttgagatctatgttccaatgtctgtttaccagggaactctttgaaggtaagaactctcttacctatttgtgtccccgcagcccctgggatgagrctgagcatgcagcagatgctggataaatagtcatgagggtgactgatcagccttggtctctgctgctgggcccacatctcttgtactcagtgcccacttcagcaccagatacacagttatccactcagttactgacgagtcccttcgctttgtctagatactgggcacaaactgaccataggaatcttctaccaatttaagagccaaatggagataaaggaccactgggtatggtctagatttgcattcccaaacgggaatttctgcaaaggtattaatcgagaagctatgaaaaaatgt

SEQ ID NO: 140417 - DNA, 601 bp, Human
gaggcggagcttgcagtgagctgggatcacaccgctgcactctagcctgggtgatggagcgaggctgtctcaaaaaaaaaaaaaaaaaaaaaacaaaaaaaccctaagttagatcacatcaatctctcttcaacttcaccctccacccacccctgccacccccaacatgcttcctaagttccagtgccagctgtccagttcctttatgttactcagacaaacaaaggcctggcccggctcaggcattggcacctgctcctctcctggcctgcaaggcctgtcccgactcttcactggcccrttcattcttactcttcaggtctgatgtcaattctcagctccctagagccagcttcccattctacccaaagcagccccttccctgtttcctctgcagcacagccccttgtttagttccttcactaagcttatcacagttggaaatcattttagtttatatgttgtcatcttccctgctgtgagacctgccctgaaactggagaccttaggtgtgttatttacatatatatccccagtgctagcacagtactgggtgcatattaagtcgtaaaatgtatctgtttaatgaacccatgaataa

SEQ ID NO: 140418 - DNA, 601 bp, Human
ggcgtggtggcagatgcctgtagtcccagctacttgggaggctgaggcagaacagcatgaacccgggaggcggagcttgcagtgagctgggatcacaccgctgcactctagcctgggtgatggagcgaggctgtctcaaaaaaaaaaaaaaaaaaaaaacaaaaaaaccctaagttagatcacatcaatctctcttcaacttcaccctccacccacccctgccacccccaacatgcttcctaagttccagtgccagctgtccagttcctttatgttactcagacaaacaaaggcctggccyggctcaggcattggcacctgctcctctcctggcctgcaaggcctgtcccgactcttcactggcccattcattcttactcttcaggtctgatgtcaattctcagctccctagagccagcttcccattctacccaaagcagccccttccctgtttcctctgcagcacagccccttgtttagttccttcactaagcttatcacagttggaaatcattttagtttatatgttgtcatcttccctgctgtgagacctgccctgaaactggagaccttaggtgtgttatttacatatatatcccca

SEQ ID NO: 140419 - DNA, 601 bp, Human
ccgggcatggtggctcatgcctgtaatcccagcactttgggaggccaaggcgggctgatcacaaggtcaggagatcgagaccattctggctaacacagtgaaacgccatctctactaaaaaatacaaaaaaaaattagccgggcgtggtggcagatgcctgtagtcccagctacttgggaggctgaggcagaacagcatgaacccgggaggcggagcttgcagtgagctgggatcacaccgctgcactctagcctgggtgatggagcgaggctgtctcaaaaaaaaaaaaaaaaaaaaaaaaaaaaaaccctaagttagatcacatcaatctctcttcaacttcaccctccacccacccctgccacccccaacatgcttcctaagttccagtgccagctgtccagttcctttatgttactcagacaaacaaaggcctggcccggctcaggcattggcacctgctcctctcctggcctgcaaggcctgtcccgactcttcactggcccattcattcttactcttcaggtctgatgtcaattctcagctccctagagccagcttcccattctacccaaagcagccccttccctgtttcctctg

SEQ ID NO: 140420 - DNA, 601 bp, Human
gtctcactctatgttgcccaggctggccttccggccttctgttgcccttctcagccttctgagtagctgggagcacaggtgagcgccactcacccagctcctccttgtggttttgacttgcatttccctaatgactgatgatgttttcaggtagttactggccatctgtatatcttcattggaaaaatgtctatccaaattcattgccccaaatccacattttaaaaacctaaattggccgggagcagtggctcacgcctgtaatcccagcactttgggaggccgaggtgggcagatcacsaggtcaggagatcgagactaacctggctaatacggtgaaaccctgtctctactaaaaatacaaaaaattagcggggcatggtggcaggcacctgtagtctcagctactcgggaggctgaggcaggagaatggcatgaacccaggaggcagagcttgcagtgagccgagatcatgccacagcactccagcctgggcgacagagcgagactctgtctcaaaaaaaaaaaacaaaaacaaaaacaaaaacaaaaaacaaaaaacctaagttatggccaggcacggtggctcatgcctgtaatc

SEQ ID NO: 140421 - DNA, 601 bp, Human
atgatctcagctcactgcaacctccacctcctgggttcaagcgattctcctgcctcagtctcccaagagctgggattacaggtgcctgccaccatgcctagctaatttttgtatttttagtagacaggatttcatcatgttggccaggctggtctcaaactcttgacctcaggtgattcgccctccatggccttccaaagtgctgggataacaggcgtgagccaccatgcccggcctaacatttggaggaaatgtttttcaaggtgtttttccacactggctgcactgttttatattcacrcccacaatgtgaattgtggtttttttagagactgtctcactctatgttgcccaggctggccttccggccttctgttgcccttctcagccttctgagtagctgggagcacaggtgagcgccactcacccagctcctccttgtggttttgacttgcatttccctaatgactgatgatgttttcaggtagttactggccatctgtatatcttcattggaaaaatgtctatccaaattcattgccccaaatccacattttaaaaacctaaattggccgggagcagtggctcacgcctgtaatcc

SEQ ID NO: 140422 - DNA, 601 bp, Human
taactttttttttttttttttttttgatcatggagtctcactctgtcacctaggctggagtccagtggcatgatctcagctcactgcaacctccacctcctgggttcaagcgattctcctgcctcagtctcccaagagctgggattacaggtgcctgccaccatgcctagctaatttttgtatttttagtagacaggatttcatcatgttggccaggctggtctcaaactcttgacctcaggtgattcgccctccatggccttccaaagtgctgggataacaggcgtgagccaccatgccyggcctaacatttggaggaaatgtttttcaaggtgtttttccacactggctgcactgttttatattcacacccacaatgtgaattgtggtttttttagagactgtctcactctatgttgcccaggctggccttccggccttctgttgcccttctcagccttctgagtagctgggagcacaggtgagcgccactcacccagctcctccttgtggttttgacttgcatttccctaatgactgatgatgttttcaggtagttactggccatctgtatatcttcattggaaaaatgtctatccaa

SEQ ID NO: 140423 - DNA, 601 bp, Human
cctctcccagcaccaagtttccacccacctggacgcctcacacacctcacacaggatttccaacgtgggaaacgtgatcccctactcctaaagcgtgtctctccccgagtcttccctcagttcctagtctattttagataaacagagatgataaagacagagctctgctcaagcaaaacacctaaaaatcacctatttttcctacctttattccacccccaatatcagatccatccccaggtcttatgggtcccgccaaagcacacgtcatccacccacctctctccacagacctcacccyagtcaaactgagtcgtctcccactgagcggctgcaaccacctccactgactcttcaacttccagttctcacccctccaagccatttccacccagcatccagacccactctttttaaacagctttacagaggtataaataatataataatcaacatgcaataaactgcacatattaaaagggtacaattcaataaatttgaacataaagacatacgtgggaggctgggcgtggtggctcacgcctgtaatcccagcactttcagtggccaaggcaagcagatcacctgaggtcaggagttc

SEQ ID NO: 140424 - DNA, 601 bp, Human
ccttcgctgccatcctctgcttgtgcttctcatcctccacccaggcctgtctggccaggccctgaaggagcccagctatcccactgctcccacctgcacccaagcaactaaatgttgccggagaagaaaattcacatcatcagttggacttgtttcaccttcaattcctgacaccaagccagggcctgcagctgcctggcagctctcttcaatgccctctctggtgctctgggcacagccaggacacacccgccccatttcctcaaccttcttgtgggtgagactccaagcccacctcatsatggatctggagactcacctgccgccgggctcacttcttcctcccttcctgctgcacaggaggaagccacaccactcccttctcctgggctccacctgtgccctggatcctccccctctgcccttcacagacactatgccctgcaatacccgcttgctatccttctccacaatccttattcaaacgtgtgctggaacctcccaaatgcccacttgctatcctcctccatgaacctcattcaaacgcatgctggcacctcccgaatgcccgcttgctatccttctccatgactcctcattc

SEQ ID NO: 140425 - DNA, 601 bp, Human
tgcccacagggccccagccctcactaatggagccacctggtcccaaacaccctcatgaggctggcgttcgctactggagcctgtgcctcctgcacgtcttgctgagcctctggaagatggcactttgctgacgctttctctctggcaaacgcgtccctcaacaggcagaggttagactcccgggtccctgggcacagggtgtgccctctcattacctgatacttggcactacctccaccaaccacgcaatcccctctcctaaagactcagcctctccccagcatcctcactcctgccccarccaaaactggcctcacacgaagggagcacctccccaactcgcctctgagtgacagctgcctcttcctcatcccccacagacttcagagatggcaggtgagggcagcgtctgccttctccactgctccttccagatccctgatgccaatgcccacactcgacagcacacccctagagcccttcctactcactgtcacctaccattgccagttactgtcccttatgcacctcactcgctggctcgccatcctctccattcctgctctatcaccatcctcagtgacttgacacacacatgtcc

SEQ ID NO: 140426 - DNA, 601 bp, Human
agtccctgaaacacaggcttggccttggcttggcttggctccgcgtgaggagcgccacatccccaaggtcgtagctccgcgggagagctgacccaaatggcctcccaggtgcctgcgccctgccctcatgcccacagggccccagccctcactaatggagccacctggtcccaaacaccctcatgaggctggcgttcgctactggagcctgtgcctcctgcacgtcttgctgagcctctggaagatggcactttgctgacgctttctctctggcaaacgcgtccctcaacaggcagaggtkagactcccgggtccctgggcacagggtgtgccctctcattacctgatacttggcactacctccaccaaccacgcaatcccctctcctaaagactcagcctctccccagcatcctcactcctgccccaaccaaaactggcctcacacgaagggagcacctccccaactcgcctctgagtgacagctgcctcttcctcatcccccacagacttcagagatggcaggtgagggcagcgtctgccttctccactgctccttccagatccctgatgccaatgcccacactcgacagcacacccct

SEQ ID NO: 140427 - DNA, 601 bp, Human
gcctggcccacactctgaatccacatttactggctgcaggtaagatactcctctctcctaagtataagtgaactcgtgctcctagcgtgttaaaagggggtcagcgaaggccggccatggtggtgcgtggtgcgcagctgtgttcccagctactcaagaggctgaggtgggaggatcacttgagcccaggagttcgaggctgcagtgagctgggatggcacctgtgagtggccactgcactccagcctgggtgacagaacaagacccactctctaaaaacatgagggatgtcagggtaacyagggaacaaggtgtcatgaggacatgatgaaacagtgggcaccaagcacccacataatgccagagcaactgttcagcaagtgtgattcccactgagcacacagagggcacgctatgttggctgaatgtgtgaatttctttttttttttttttaattaagtttttttgtggggggacagtctcgctctgtcacccaggctggagtgcagtggcacgatcttggctcactgcaacctccacctcccaggttcaagcaattctcatgcctcagcctcccaagtagctgggactacaggcatga

SEQ ID NO: 140428 - DNA, 601 bp, Human
gacagaagcagacaggtgccaggcgcgttttcgaaatcggtcccatgggacatgggactcaccaacaggctggaagtgagggcttagaggaagacatcagcacggcccctgatttccgacctgaggccaccagacagcactgccatgcacaaggaaaccagcaccccagggacagatacatcgggtctgagtgtctggagctcagagggcagtcccgggccgaggcaacgcaggtgggacagctggcacaaagacagtatctaaatccccaggaacggatgaatgaggccatgtcgttcayctcactcccacaactgctggtcaaccaccatggccacccagtgaaactccagctgaaatagtgactccagtcccgcaatccttaaacttgagggtgtatgagaatcacctggcgggctcgtcagacccacattgctactcccagagtgtctgattcagaaggtgtagggtggggctgaaaaatgtccactcctaaggagtctccaagggatgctgactctggtctcaggactcactttgggatcactgctcgacctgaaacagtgggcctggcccacactctgaatccacatttactggc

SEQ ID NO: 140429 - DNA, 601 bp, Human
cagacgaaaacacaaacccatttcaagtggtgggaagtgtcatccaaaaaacaagatggagaaagaatacacttcaatatgatggtcacgaaatgtggggagacttctgggccgaggcctcgtggacaagaaggcaccagacctaggggtgggaggagaacattccaagccaaaagctgctggagaagcacacagagaggggggcacagtgggtggagaggcaggcaggccctgcaggtcatgctcaggagggtgtatgtggtttttaaagggaaactattcagaggtttcaagtcaggakctgccatgatctgctctgtgagggccttgtcagcctgcatggaactgaaaggagcaggcagtttaggaggccctgtcagctgtactggcagtaaatgccaagatgctggcaatgagaagagacagaagcagacaggtgccaggcgcgttttcgaaatcggtcccatgggacatgggactcaccaacaggctggaagtgagggcttagaggaagacatcagcacggcccctgatttccgacctgaggccaccagacagcactgccatgcacaaggaaaccagcaccccagggacagataca

SEQ ID NO: 140430 - DNA, 601 bp, Human
aggggaacacactggcggtgggcacaggctcttgacaggcagacccggagcaggcctcactggctggccaagcgtcagacctggtaaatgagctgcctcatccctctgagcctcagtttcttcatctgtcaaatcagaagagttttcttgtttcacaggcagctgttgtaaacctcaaaagtgagaataaagggacattgcctggcgtatcaaaggtgtcaaatgaatggcaagcactgtactcgccggtgtttaataactctctgttggacaaatgaatctactcatttaacaacaaacrctgagtcctcccagtgtgccaccctgcgctgggtgctgggcttgacagtgggcaggagggtgagagcccagcctgcacaggtcccagcccagtcaggagatggaccaagaacaagccacagacgaaaacacaaacccatttcaagtggtgggaagtgtcatccaaaaaacaagatggagaaagaatacacttcaatatgatggtcacgaaatgtggggagacttctgggccgaggcctcgtggacaagaaggcaccagacctaggggtgggaggagaacattccaagccaaaagctgctg

SEQ ID NO: 140431 - DNA, 601 bp, Human
tagatgtggattcttgttgcctttgctctttcgtttagtttgatcaggacatccactatgagtgtgacccttcttctggcaacagcatctcaactcctctgggaagccacgcctctgccaccaactgcagccttttaggacagtccatcagggcacccagggctgggtgtgggacccaagctcagctgatgggcctccctctcctggggactaggaatcttgggcaatgaaacccaaggatggagaaagggcgcttcagcgtcttgggctgtttgctggagagacggtctgcgggctctgmccctacggcctcaggcctgcttcctcgggcttccctttgattccctgagcaaggcaatatccttctaatcagtcctgcctttgttcaagtgagccagagcctgttgatgttactgtgactggggtcctgacatccctttcctcttaaatatgcgcggtttccaaatcctctccagtgaatgcaggctacctccaggggaacacactggcggtgggcacaggctcttgacaggcagacccggagcaggcctcactggctggccaagcgtcagacctggtaaatgagctgcctcatccctct

SEQ ID NO: 140432 - DNA, 601 bp, Human
ctgggtttagaatgttgggaaaccttctttccagccagaaagaaggttctggcaacctgaatgtaacccaattccactccctccatgtggtgataaagtgagagacctcacagcagtcaggttcccatcctctgactgggtcttgaaagaaaatcaaccaaggagaaaagtttccacttctagcaacaaaggctgaacctactcagtggacaggagctggggaaggaactgtgagtgctctggggcttaagcctagaccggggctaccgtgggagacctctgtcctgtgcagatgtgcccygagacccatctccagcccttccttgcctcccccaggcatggaacacaggaaccattaataccagcccgccctcagccagggaagaagtaccagtccatagggttgggaggggcacaaacggtgggtgagggggtgcttggaagcaaccttcgccttactcacttctcacccgcacttctccccttgtcttagttctagggttaaaggtggtggtgtggctaaaccatgaggacagctgggagatttggataaactaatccatttcacctggcccaaccccgctcccaatcagcccctgta

SEQ ID NO: 140433 - DNA, 601 bp, Human
tggaaaatctcagagtaaaatgccatgcctgtgcatgaagaacctgacacggattttcaaatctctctagggggtgaaaaggtacaggtcatgctgcttaagtttcaagtcaaggagtccgagaagaggcagtgaggccgaggagcagagcatgggctctgaagtctgactccccactttctggccgctaaccctcagcttcaactgtctgtgcctcagtctgcccatctgtagaacagggataataaagatacctattttaaggccaggcgctgcggctcacgcctgtaatcccagcacyttgggaggccgaggcgggcagatcacgaggtcaggagatcgagaccatcctggctaacacagtgaaaccccgtctctactaaaaatacaaaaaaattagctcggcgtggtagcaggcacctgtagtcccagctactcgggaggctgaggcaggagaatggcatgaacccgggatggggagcttgcagtgagccaagatcacgccactgcactccagcctgggagacagagcgagactccgtctaaaaaataaaaataaaaaatagaaatacctattttgtagggctactatgaaggctaa

SEQ ID NO: 140434 - DNA, 601 bp, Human
agcccctcccttaatttggcttgtgattactccccttgttgaactggaaaatctcagagtaaaatgccatgcctgtgcatgaagaacctgacacggattttcaaatctctctagggggtgaaaaggtacaggtcatgctgcttaagtttcaagtcaaggagtccgagaagaggcagtgaggccgaggagcagagcatgggctctgaagtctgactccccactttctggccgctaaccctcagcttcaactgtctgtgcctcagtctgcccatctgtagaacagggataataaagatacctmttttaaggccaggcgctgcggctcacgcctgtaatcccagcaccttgggaggccgaggcgggcagatcacgaggtcaggagatcgagaccatcctggctaacacagtgaaaccccgtctctactaaaaatacaaaaaaattagctcggcgtggtagcaggcacctgtagtcccagctactcgggaggctgaggcaggagaatggcatgaacccgggatggggagcttgcagtgagccaagatcacgccactgcactccagcctgggagacagagcgagactccgtctaaaaaataaaaat

SEQ ID NO: 140435 - DNA, 601 bp, Human
aaaatcaacgtcgaatcaggcagacatgtcatctggaaaccagacttcaaatcagaagagcacattccccttcgcacccaagcccctcccttaatttggcttgtgattactccccttgttgaactggaaaatctcagagtaaaatgccatgcctgtgcatgaagaacctgacacggattttcaaatctctctagggggtgaaaaggtacaggtcatgctgcttaagtttcaagtcaaggagtccgagaagaggcagtgaggccgaggagcagagcatgggctctgaagtctgactccccamtttctggccgctaaccctcagcttcaactgtctgtgcctcagtctgcccatctgtagaacagggataataaagatacctattttaaggccaggcgctgcggctcacgcctgtaatcccagcaccttgggaggccgaggcgggcagatcacgaggtcaggagatcgagaccatcctggctaacacagtgaaaccccgtctctactaaaaatacaaaaaaattagctcggcgtggtagcaggcacctgtagtcccagctactcgggaggctgaggcaggagaatggcatgaacccgggatgg

SEQ ID NO: 140436 - DNA, 601 bp, Human
cggtggctcacacctgtaatcccagcactttgcggggctgaggcagatggatcacctgaggtcaggagttcgagaccagcctggccaatgtggtgaaaccttgtctctacaaaaaatacaaaaattagccgggcatggtggcagatgcctgtaatcccagctagtcaggaggttgaggcaggggaatcacttaaacccaggaggcagacgttgcagtgagctgagatcacgccattgcattccagcctgggcaacaacagcaaaactctgtcaaaaaaaaaaaaaaagtctacgtttttasgtttttatttcaggttagaggaagaggctcaattaaggagtgggttttttttttgtttttttttttttgagacggagtctgactgtcactcaggctggagtgcagtggcaccatctcggctcactgcaacctctgtctcacgggttcacgccattctcctgcctcagcctcccaagtagctgggactacaggcgcccgccacaacgctcggctaattttttgtatttttagtagagacggggtttcaccgtgttagccaagatggtctcaatctcctgacctcatgatctgcccacctcg

SEQ ID NO: 140437 - DNA, 601 bp, Human
aagaaagaaagcaaagaaatgtaattcattatcttaagttaaaaaaaaaatggtctatgttggccaggcgcggtggctcacacctgtaatcccagcactttgcggggctgaggcagatggatcacctgaggtcaggagttcgagaccagcctggccaatgtggtgaaaccttgtctctacaaaaaatacaaaaattagccgggcatggtggcagatgcctgtaatcccagctagtcaggaggttgaggcaggggaatcacttaaacccaggaggcagacgttgcagtgagctgagatcacrccattgcattccagcctgggcaacaacagcaaaactctgtcaaaaaaaaaaaaaaagtctacgtttttacgtttttatttcaggttagaggaagaggctcaattaaggagtgggttttttttttgtttttttttttttgagacggagtctgactgtcactcaggctggagtgcagtggcaccatctcggctcactgcaacctctgtctcacgggttcacgccattctcctgcctcagcctcccaagtagctgggactacaggcgcccgccacaacgctcggctaattttttgtattttta

SEQ ID NO: 140438 - DNA, 601 bp, Human
agttagctttggaattattagccatctgaacagccaattttattttattttttggaaatgtaattcacatatcataaaatttaccaatttaaagtgtacaattcaatggtctttagtgtatcaacaatgttatgcaaccactaccactatctaaattccagaatgtttccatcacccctaaaagaaaccccatgccaattagcatgaacaatttttaaaataaacacggtatgggccagaaacacgccaagaaagacaccatgagccccactgagatggcaggggtgacactggggttcargagctccaggggaagctcctgaatgctggcagtgtggccgtgccatccccaaaagaacctagggtttctttacatgccaagagaaagtgccaagtcttttagcctaagtcctacagggagtaactggaaaacgtactggagcaactggaaatttaatgtaaaatatgcaaagaaggccgggtccagtggctcacgcctgtaatcctagcactttgggaggctgaggcaggcgattgcctgagctcaggagttcaagactagcctgggcaacacgatgaaaccccatctctactaaaatac

SEQ ID NO: 140439 - DNA, 601 bp, Human
gagtgcaggcaggaagtccatgaaccacctcgagagcaaagagttcagtgattaccaagaagacacagaagtaaagggggatgctggcagaggacagtgctggaaaagatcagaggggcagatggctggcagctctcgaccccacctccctgcccttcctgctccgcgtggctcacaggcccatgaccaaatggacacatcagaaataagagatctatgagctagacacagtccctagcaggcaaaatgttggaagggacagagtcctgctccactcagatgagcagatcccaagacaggycttaaatcaaggagggtggggtatgcaggtgtggagttgggtgaatgacactgctagaaaaataataccataggccggatgcggtggctcacacctgtaatcctagcactttgggaggccgaggcgggtggatcatgaggtcgggaaatcaagaccatcctggccaacacactgaaaccctgcctctactaaaaatacaaaaaattagccaggcatggtggtgggcgcctgtagtcccagctacttgggaggccaaggcaggagaatggtgtgaacccaggaggcggagcttgcagtgag

SEQ ID NO: 140440 - DNA, 601 bp, Human
aacctaaaactacatgtagctaaagaattgctggcaggactcccaggggaggcgctctctccaagacctaggagtgcaggcaggaagtccatgaaccacctcgagagcaaagagttcagtgattaccaagaagacacagaagtaaagggggatgctggcagaggacagtgctggaaaagatcagaggggcagatggctggcagctctcgaccccacctccctgcccttcctgctccgcgtggctcacaggcccatgaccaaatggacacatcagaaataagagatctatgagctagacacrgtccctagcaggcaaaatgttggaagggacagagtcctgctccactcagatgagcagatcccaagacaggtcttaaatcaaggagggtggggtatgcaggtgtggagttgggtgaatgacactgctagaaaaataataccataggccggatgcggtggctcacacctgtaatcctagcactttgggaggccgaggcgggtggatcatgaggtcgggaaatcaagaccatcctggccaacacactgaaaccctgcctctactaaaaatacaaaaaattagccaggcatggtggtgggcgcc

SEQ ID NO: 140441 - DNA, 601 bp, Human
gtatccaagcataaagcggtgctgtcgttctaaaccagaatcaggaaaaatgcctgccatggaacctaaaactacatgtagctaaagaattgctggcaggactcccaggggaggcgctctctccaagacctaggagtgcaggcaggaagtccatgaaccacctcgagagcaaagagttcagtgattaccaagaagacacagaagtaaagggggatgctggcagaggacagtgctggaaaagatcagaggggcagatggctggcagctctcgaccccacctccctgcccttcctgctccgcrtggctcacaggcccatgaccaaatggacacatcagaaataagagatctatgagctagacacagtccctagcaggcaaaatgttggaagggacagagtcctgctccactcagatgagcagatcccaagacaggtcttaaatcaaggagggtggggtatgcaggtgtggagttgggtgaatgacactgctagaaaaataataccataggccggatgcggtggctcacacctgtaatcctagcactttgggaggccgaggcgggtggatcatgaggtcgggaaatcaagaccatcctggccaa

SEQ ID NO: 140442 - DNA, 601 bp, Human
agcttggcatggcggcacacacctatagtcccaactactcaggaggctaaggtgggaggatcacttcagcccagggggtcacagctgcagtgaggcgggatcatgccactgtacttcagctggagtgacagcaaaactctgtctctcaaaaaagaaaaaaaagaaaaagaaaattaaaatacaaatcacagactgggataaaatatttgtaaaacacattatctgataaagaacttgtttctagcatatctaaagaactctcacaactcacaaacaactcaatgagaaacgaggcaaaagrcttgaacatttcgttacagaaaatatacaaagggttacttgcttaaaaacatgtccaatgtcattaatcaaggaaatgcaaatcaaaacaacaatgagacaccactccctgcctatgagaacagccaaaatccagagccctgacaataccaaatgctgacaaggatagggagcaagagggactctcattcactgtggattttttttaagagactttattttttagagcaggtttaggtttacagcaaaattgagcagaggtacagagttcccatataccctccactcccacacaacgcac

SEQ ID NO: 140443 - DNA, 601 bp, Human
caaaagttactataaaactacagtggccaggcacagtggctcacgcctgtaatcccagcactttgggaggccaaagtgggcggatcacaaggtcaggagatcaagaccatcctggccaacatggtgaaaccccgtctcaactaaaaatacaaaaattagctgggtgtggtggcgcgtgcctgtaatcccagctactcgggaggctgaggcacgagaatcacttgaacccagtaggaggttgcagtgagccgagatcacaccactgcactccagcctggcgacagagcaagactccatctcaaaaaaaaaaaaaaaaaaactacagtaactgagacagtgtggtatttacattaggtgggacacttagatcagagaagcaggatacattccagaaatggaccccaggctaccatgacacttcagtgagaaagggtggcctttccaacagaggcacaactggatccacatgcaaaaaaaaaaaaaacctctccatttttacctcctacaatatatgataattaactcaaaacgagccaggcatggtggctcacgcttgtaatcccaatactttgggaggccaagacaggtggatcacttgacg

SEQ ID NO: 140444 - DNA, 601 bp, Human
aaaaaaaacatgaaatagagacaaatttaacacaatatgtgcaagagtggtacactgaaagctacaaaacattgctgagagaaggtagaggtggcctacataaatgaggatgtgtatgtgcttgtggatcagaagacccaatattgttaagctttatagctacaatgcacttgcaatcaaattctcaccaggttctttgtagaaactgaccagcttgttctaaacattctatagaaatataaaggacccagaatagccaaaacaatttttaaaatgaagaataattttggaaaactcacaytgctttcaaaagttactataaaactacagtggccaggcacagtggctcacgcctgtaatcccagcactttgggaggccaaagtgggcggatcacaaggtcaggagatcaagaccatcctggccaacatggtgaaaccccgtctcaactaaaaatacaaaaattagctgggtgtggtggcgcgtgcctgtaatcccagctactcgggaggctgaggcacgagaatcacttgaacccagtaggaggttgcagtgagccgagatcacaccactgcactccagcctggcgacagagcaagactc

SEQ ID NO: 140445 - DNA, 601 bp, Human
aggagaatggcatgaacccaggaggcggagcttgcagtgagccgagatcataccactgcattccagcctgggcaacagagcaagactccatctcaaaaaaaaaaatcacttgtattctatatatttggaaatttcaattaaacaaagtttataatagcattaaaaacgaaataagctgaactgtacacttgataaattttatcatgtgtatttaccattataaaatatttaaaaatatatttataaagatagtctctatgccaaaaaaaaaaacatgaaatagagacaaatttaacacaayatgtgcaagagtggtacactgaaagctacaaaacattgctgagagaaggtagaggtggcctacataaatgaggatgtgtatgtgcttgtggatcagaagacccaatattgttaagctttatagctacaatgcacttgcaatcaaattctcaccaggttctttgtagaaactgaccagcttgttctaaacattctatagaaatataaaggacccagaatagccaaaacaatttttaaaatgaagaataattttggaaaactcacactgctttcaaaagttactataaaactacagtggcca

SEQ ID NO: 140446 - DNA, 601 bp, Human
ccctgatgtgtttgttacacattgcatgcctgtatcaaaacatctaatgtacctcataaatacacacctactatgtacccacaaaaattaaaaattaaaattaaaaaaccacttgtattccaaaaattagctgggcatggtggcgggcgcctatagtcccagctacttgggaggtggaggcaggagaatggcatgaacccaggaggcggagcttgcagtgagccgagatcataccactgcattccagcctgggcaacagagcaagactccatctcaaaaaaaaaaatcacttgtattctayatatttggaaatttcaattaaacaaagtttataatagcattaaaaacgaaataagctgaactgtacacttgataaattttatcatgtgtatttaccattataaaatatttaaaaatatatttataaagatagtctctatgccaaaaaaaaaaacatgaaatagagacaaatttaacacaatatgtgcaagagtggtacactgaaagctacaaaacattgctgagagaaggtagaggtggcctacataaatgaggatgtgtatgtgcttgtggatcagaagacccaatattgttaagcttt

SEQ ID NO: 140447 - DNA, 601 bp, Human
gtaagactccgtctcaaaaaaaaaaaaaaagatcacagaacccacagataaatccatatatctaccttgaactcatttttgacaaaggtgccaagaacatatattggggaaacgacagtctcttcaataaatggcactggaaaactggatatccatatgcaaaagaatgaaactagacccctatctcttgccatatacaagaactactaaaagaaaacattggggaaactctccaggacattggtctggacaaagatttcttgaatagtaccccaaaagcacaggcaaccaaagcaaacayggacaaatgggatcacatccagttaaaaagcttctgcacagcaaaggatacagtcaacaaagtgaagagacaatccacagaatggaagaaagtatttgcaaactatccatctgacaagggattaataaccagaatacataaggagtcaaacaactctatagaaaaaaatctaataatctgattttaaaatgggcaaaagatctaaatagacatttctcaaaagaagacatatggtggctgcgtgtgatggctcacacctataatcccagcactttgggaggctgaggtgggcaggagttc

SEQ ID NO: 140448 - DNA, 601 bp, Human
ccgggagacggacattgcagtgagccgagatggtgccattgtactcccgcctgggcgacagagtaagactccgtctcaaaaaaaaaaaaaaagatcacagaacccacagataaatccatatatctaccttgaactcatttttgacaaaggtgccaagaacatatattggggaaacgacagtctcttcaataaatggcactggaaaactggatatccatatgcaaaagaatgaaactagacccctatctcttgccatatacaagaactactaaaagaaaacattggggaaactctccaggayattggtctggacaaagatttcttgaatagtaccccaaaagcacaggcaaccaaagcaaacacggacaaatgggatcacatccagttaaaaagcttctgcacagcaaaggatacagtcaacaaagtgaagagacaatccacagaatggaagaaagtatttgcaaactatccatctgacaagggattaataaccagaatacataaggagtcaaacaactctatagaaaaaaatctaataatctgattttaaaatgggcaaaagatctaaatagacatttctcaaaagaagacatatggtggc

SEQ ID NO: 140449 - DNA, 601 bp, Human
gataagaatacagaaccaggccaggcgcagtggctcatgcctgaaatcccagcactttgggaggccgaggcgggcggatagcgtgaggtcaggagttcaagaccagcctggctaacgtggtgaaaccccatctctactaaaaatacaaaaattagctgggcatggtggcacatgcctgtagtcccagctactccagaggctgaggcaggagaatcacttgaacccgggagacggacattgcagtgagccgagatggtgccattgtactcccgcctgggcgacagagtaagactccgtctcaaaaaaaaaaaaaaagatcacagaacccacagataaatccatatatctaccttgaactcatttttgacaaaggtgccaagaacatatattggggaaacgacagtctcttcaataaatggcactggaaaactggatatccatatgcaaaagaatgaaactagacccctatctcttgccatatacaagaactactaaaagaaaacattggggaaactctccaggacattggtctggacaaagatttcttgaatagtaccccaaaagcacaggcaaccaaagcaaacacggacaaatgggatca

SEQ ID NO: 140450 - DNA, 601 bp, Human
taatcctagcacttcgggaggccgaggcaggcagatcacgaggtcaggaaatcgagaccatcctggctaacacagtgaaaccccgtctctactaaaaaatacaaaaaattagctgggcgtggtggcgggcgcctgtagtcccagctacttgggaggctgaggcaggagaacggtgtgaacctgggaggtggagcttgcagtgagccgagatcgcgccactgcactccagcttgggtgacagagtaagactccatctcaaaaaaaaaaaaaaaaaataccaatgacattcttcacagaaatmcaaaaaaaaaaaaaaaaaaaaaacccttaacatttacatagaaccacaaaaattccagaatagccagagctatcctaagcaaaaggaacaaaactggaaaaatcacattatctgactttaaatgatactacaaagctacagtagtccaaatggcatgttactggcataaaaacagacacacagatcagtggataagaatacagaaccaggccaggcgcagtggctcatgcctgaaatcccagcactttgggaggccgaggcgggcggatagcgtgaggtcaggagttcaagaccagcctg

SEQ ID NO: 140451 - DNA, 601 bp, Human
attaaaataccaatgacaggccaggtgcggtggctcacgcctgtaatcctagcacttcgggaggccgaggcaggcagatcacgaggtcaggaaatcgagaccatcctggctaacacagtgaaaccccgtctctactaaaaaatacaaaaaattagctgggcgtggtggcgggcgcctgtagtcccagctacttgggaggctgaggcaggagaacggtgtgaacctgggaggtggagcttgcagtgagccgagatcgcgccactgcactccagcttgggtgacagagtaagactccatctcaaaaaaaaaaaaaaaaaataccaatgacattcttcacagaaatacaaaaaaaaaaaaaaaaaaaaaacccttaacatttacatagaaccacaaaaattccagaatagccagagctatcctaagcaaaaggaacaaaactggaaaaatcacattatctgactttaaatgatactacaaagctacagtagtccaaatggcatgttactggcataaaaacagacacacagatcagtggataagaatacagaaccaggccaggcgcagtggctcatgcctgaaatcccagcactttgggaggccg

SEQ ID NO: 140452 - DNA, 601 bp, Human
gagacgatggtcaacaggagacccatggagtgcacatagcaggaggaggcacacaggccacagacaacgatagccagggggcaagggctctgcagtcagcacagagctccaacctcacacagaggcctcactgcaaaggcggcatcttctctggacccgactgacaaggcggctggctctccacaggtcggcaagaacattccaggcagagggaaaaacaaacactgatgttccaaggcaggccggtgctcaggtgtttgaggaatggggaaaaccctggagtgtggctggaacatggaamatctgggagtgtgggaagagaagggtcaggttttgtttttttaatttccactgcattgtgaccaatgcttttgtaagatatgaaatcaaatcatgtgcctgaacactgcatcagacaaactgccatgaacatttccaatcacacacacccagtttccgtgtttcatctcggaccggcgccactctgcagacaaaatacggagctgctctgcagaaagggtttgcgtgggaaaatgatgtgccacgatagtggtgacgagatcccgtacagatgaagaaatggaggctcagagagggtctg

SEQ ID NO: 140453 - DNA, 601 bp, Human
gaacattccttcatggacacgtgtgtgcacacacacatgcacacacacacacatatgcacagggcccttctcctagcccagtgagcacctatccttctaaagctgccacctcctaagccttccctgaactctcccagtctaattgtcctccctagcaatgtcacagtcggagctacacatctctataacttacttcgcatcttccccacaggactgtaaatcgctggtgcaggctggatggggggcaagagcctggggctaatgttttcagcagacccactccacaggcatgcagtgtccrtcatcgtatctaagcctcacggcaacattccaagtagccaaactttcctgacttgtgtagtaatttagccaatattgcatgaggtacagttccaggaaccagagagacgatggtcaacaggagacccatggagtgcacatagcaggaggaggcacacaggccacagacaacgatagccagggggcaagggctctgcagtcagcacagagctccaacctcacacagaggcctcactgcaaaggcggcatcttctctggacccgactgacaaggcggctggctctccacaggtcggcaagaa

SEQ ID NO: 140454 - DNA, 601 bp, Human
cagggagcagaccggggcctggcaagccaccggcatcctctcgccactggtgggctctcggcatcctttccctttgcctcgattccctggggaaattgactttttcctatagggtagcaggtcctggctgctctcaccaccccagtgcagccaggggtgggcgcagcctaagcacggcacctgctctggcccatgggccccaggcaccctaactgagccctgcccagctccaggctgtctctacagccatccagattccaacacccttgttgatttctgacactggcaaccaacccttaastcacagaccctgttacagctacagaggttaaccagcagcagattttaagcagaggaggggcaggactggatgcactttttccctaagctcctctggttcctgcataaacaaacagaaacactgagtggcccaggctgcacagggagctcagggctctgccaccctggggcagagccgggcaggtccttgccctcccagggactccgtttttccctgtgtatgacaaggaaatgggacatgggtgccttagggtggctttcttccagttggaggtcgcttcaggagtcccacttcacaaag

SEQ ID NO: 140455 - DNA, 601 bp, Human
ctgcacagcataacccaaacacagggagcagagggcggccatgtgtgccacccctgccacctgctgggccactgccacctcctgccccacatgcatgtgggcagtgcgtactgttaggcactgaagaaagaaaaccaagacaaaaagcagttcctaccctcagggagcttacagctgaggagacagcggtcaaggccctcttaaacaatggttacataacacctgggacaggcctacaaagaagccacaggctgcccaaggaaggctttcttcaggacaggcaagctgaccacaggggcayccctagcacacagcgcattccaggtgctaacggacatggggcagggtgtgtctgggccgatggatagcaaactggggtgctggtgctccccggggggcagggagcagaccggggcctggcaagccaccggcatcctctcgccactggtgggctctcggcatcctttccctttgcctcgattccctggggaaattgactttttcctatagggtagcaggtcctggctgctctcaccaccccagtgcagccaggggtgggcgcagcctaagcacggcacctgctctggcccatgggccccag

SEQ ID NO: 140456 - DNA, 601 bp, Human
gtgacatcagacctgggagccaaccaagagccgagggcaggggtcagcctagacctcagctaacaggcagggagggatggaggcctgacaccaaggcccagcgccaggcagtcagtgctgggagggagtccagcccaggacgccagcactcagggagcgcacatggctggtccacactccagtagctagaaagcagcagagtcacgacaaacccagccctgtcccctcttcacacccagcgaacactgcacagcataacccaaacacagggagcagagggcggccatgtgtgccacccctkccacctgctgggccactgccacctcctgccccacatgcatgtgggcagtgcgtactgttaggcactgaagaaagaaaaccaagacaaaaagcagttcctaccctcagggagcttacagctgaggagacagcggtcaaggccctcttaaacaatggttacataacacctgggacaggcctacaaagaagccacaggctgcccaaggaaggctttcttcaggacaggcaagctgaccacaggggcacccctagcacacagcgcattccaggtgctaacggacatggggcagggtgtgtctgg

SEQ ID NO: 140457 - DNA, 601 bp, Human
ggtggtgagaagaaagtgacatcagacctgggagccaaccaagagccgagggcaggggtcagcctagacctcagctaacaggcagggagggatggaggcctgacaccaaggcccagcgccaggcagtcagtgctgggagggagtccagcccaggacgccagcactcagggagcgcacatggctggtccacactccagtagctagaaagcagcagagtcacgacaaacccagccctgtcccctcttcacacccagcgaacactgcacagcataacccaaacacagggagcagagggcggccrtgtgtgccacccctgccacctgctgggccactgccacctcctgccccacatgcatgtgggcagtgcgtactgttaggcactgaagaaagaaaaccaagacaaaaagcagttcctaccctcagggagcttacagctgaggagacagcggtcaaggccctcttaaacaatggttacataacacctgggacaggcctacaaagaagccacaggctgcccaaggaaggctttcttcaggacaggcaagctgaccacaggggcacccctagcacacagcgcattccaggtgctaacggacatggg

SEQ ID NO: 140458 - DNA, 601 bp, Human
agtagcagggaccacaggcatgcgccatgatgatcagctaatttttttgtgtttttttttttttttttgtagagacagggagtctcaccatgttgcccaggctggtctccaactcctaggctcaaacaatccttccacttcagcccctgaagtagctgggactacaggcatgcaccaccatgcccagataatttttgtattttttgtagagagagtctcgctatgttggccaggctggtttcacactcctgggctcaagccatccacccacatcagcctcccaaattacaggcgtgagtcrccacgcccatctccctctcctttctacggcagttcaaggttgactggcttgtttggttttggggaggggggtcttctgtcccaacccaccttccctgcaggagctctgctctgccctcctgtcattcattgcatcagtccacattgcttttgggggaaaaaatgggttttgttgctaaaaacaaacatttggaaaccagagttgagtccccatgttacatgaggaagacaaggctttgaagctgaagggacttccccaaggccacccctcaagctaaccctagagctggcacccactcct

SEQ ID NO: 140459 - DNA, 601 bp, Human
ccagttaggtaaaccaaaaaacttcccctctcctgtgctgtgttgtattttgttttgttttctggagacagggtcttactctgtcacccagactggaatgcagtggtgcaatcacagctcgctgcagcctccacctccccagctcaggtgattttcccacctcagcctccagagtagcagggaccacaggcatgcgccatgatgatcagctaatttttttgtgtttttttttttttttttgtagagacagggagtctcaccatgttgcccaggctggtctccaactcctaggctcaaacartccttccacttcagcccctgaagtagctgggactacaggcatgcaccaccatgcccagataatttttgtattttttgtagagagagtctcgctatgttggccaggctggtttcacactcctgggctcaagccatccacccacatcagcctcccaaattacaggcgtgagtcaccacgcccatctccctctcctttctacggcagttcaaggttgactggcttgtttggttttggggaggggggtcttctgtcccaacccaccttccctgcaggagctctgctctgccctcctgtcattca

SEQ ID NO: 140460 - DNA, 601 bp, Human
ccaagaggcaaagaaacaacactcacgggcagtttcaacgcctagatttggccggccaaagccctcctcacccctttccagttaggtaaaccaaaaaacttcccctctcctgtgctgtgttgtattttgttttgttttctggagacagggtcttactctgtcacccagactggaatgcagtggtgcaatcacagctcgctgcagcctccacctccccagctcaggtgattttcccacctcagcctccagagtagcagggaccacaggcatgcgccatgatgatcagctaatttttttgtgtttttttttttttttttgtagagacagggagtctcaccatgttgcccaggctggtctccaactcctaggctcaaacaatccttccacttcagcccctgaagtagctgggactacaggcatgcaccaccatgcccagataatttttgtattttttgtagagagagtctcgctatgttggccaggctggtttcacactcctgggctcaagccatccacccacatcagcctcccaaattacaggcgtgagtcaccacgcccatctccctctcctttctacggcagttcaaggttgactggcttg

SEQ ID NO: 140461 - DNA, 601 bp, Human
gatggaggccaagccagcctttgggccctcaaggtcacgggaccccacagaccactgtctgccctgactctggcgggaacccacgaggctggggagggtggggtggggtgggtacactcgtggagtccaccctctggacgcagtgatggaggtgggcatgtttcccaagccagttctaaaacaatcagggaaaaaaatagaatgtatattcccactggggtgtccaaaagactcgacctgaaactactgacggctaccaggaggaggatgtcaaaaaccaggccagggcagagccaagagrcaaagaaacaacactcacgggcagtttcaacgcctagatttggccggccaaagccctcctcacccctttccagttaggtaaaccaaaaaacttcccctctcctgtgctgtgttgtattttgttttgttttctggagacagggtcttactctgtcacccagactggaatgcagtggtgcaatcacagctcgctgcagcctccacctccccagctcaggtgattttcccacctcagcctccagagtagcagggaccacaggcatgcgccatgatgatcagctaatttttttgtgtttttttt

SEQ ID NO: 140462 - DNA, 601 bp, Human
ggctggagatggaggccaagccagcctttgggccctcaaggtcacgggaccccacagaccactgtctgccctgactctggcgggaacccacgaggctggggagggtggggtggggtgggtacactcgtggagtccaccctctggacgcagtgatggaggtgggcatgtttcccaagccagttctaaaacaatcagggaaaaaaatagaatgtatattcccactggggtgtccaaaagactcgacctgaaactactgacggctaccaggaggaggatgtcaaaaaccaggccagggcagagscaagaggcaaagaaacaacactcacgggcagtttcaacgcctagatttggccggccaaagccctcctcacccctttccagttaggtaaaccaaaaaacttcccctctcctgtgctgtgttgtattttgttttgttttctggagacagggtcttactctgtcacccagactggaatgcagtggtgcaatcacagctcgctgcagcctccacctccccagctcaggtgattttcccacctcagcctccagagtagcagggaccacaggcatgcgccatgatgatcagctaatttttttgtgt

SEQ ID NO: 140463 - DNA, 601 bp, Human
gggcgcggcggctcacccctgtaatcccagcacgttgggagcccaaggtgggtagatcacctgaggtcaggagtttgagaccagcctgactaaaatggagaaacctcttctctactaaaaatacaaaattagccaggcgtggtggcgcttgcctgtaatcccagctactcgggaggctgaggcaggagaatcgcttgaactcaggaggcggaggttgcggtgagccgagatcatgccactgcactccagcctggagaacaagagtaaaactctgtctcaaaaaaaaaaaaaaaaaaaaaaatagccaggcgtggtatctcatgcctctgtcctcagctacctgggaggcagaggtggaaggatcgcttgagcccaggggttcaaagctgcagtgagccgtggtcgtgccactgcactccagcctgggcgacagagtgaggccccatctcaaaaataagaggctgtgggacagacagacaggcagacaggctgaggctcagagagaaaccaggagagcagagctgagtgagagacagagaacaataccttgaggcagagacagctgtggacacagaagtggcaggacacagacaggagggac

SEQ ID NO: 140464 - DNA, 601 bp, Human
gtgctagatgaccgttcattcattcgttcattcattcagcaaacatttactgaaccgtagcactggggcccagcctccagctccactattctgtaccccgggaaggcctggggacccattccacaaacacctctgcatgtcagccttaccagcttgctacgctaaggctgtccctcactcattcttctatggcaacatgccatgaagccaagtcatctgcacgtttacctgacatgagctcaactgcacgggctggacaagcccaaacaaagcaacccccacggccccgctagaagcaaarcctgctgtgctgggcccagtgacagccaggccccgcctgcctcagcagccactgggtcctctaggggcccgtccaggggtctggagtacaatgcagacctcccaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtgactctcagcctggggacgtgtggcagggc

SEQ ID NO: 140465 - DNA, 601 bp, Human
ggagagttcttgagctaccttccatcccccatgctgtgtgcactgagagaacactggacaatagtttctatccactgactcttatgggcctcaactttgcccataatttcagcccaccaccacattaaaaatcttcatgtaataatagccaattataataaaaaataaggccagacacagtagctcatgcctgtaatcccagcacattgggaggtcaaggtgggaggatcacttgaggtcaggagtctgagactagtctggccaacatggcaaaaccccatctctactaaaaatacaaaarttatccaggcatggtggtgcatgcctataatcctagctactcaggaggctgaggtagcagaattgattgacccagggaggtggaggttgcagtgagccgagattacgccactgcactccagcaggggcaacagagtgagactgtgtctcgaataaataagtaaataaataataaaaataaaaaataagttaggaatacgaaaaagataggaagataaaagtatacctagaagtctaggatgaaagctttgcagcaactaagcagtacatttagctgtgagcctcctttcagtcaaggcaa

SEQ ID NO: 140466 - DNA, 601 bp, Human
actgtgggttgcagatgaaaggagtagacaaatgagtgatgccctcatcccttctgccctgttagggagacgagagtgtcaggttggagccagtacttagttactggcatgtggggcctcactggaggcccagtctagggctggagttgggttgctcagaaaaacagactggtccaaagtcttccccggggtctcctcctggcctcttcttgccgccgcctgctctgggcagagcccgggagtgtgagccgccagaagcagcggcacgtggctgtctctctgggcctcctcctcctaggamgggcgtgccctccttgctccctctgggcttcccagaaactgtggctattgatgctgatggtcctatctccccacagtgcccagagaccaggctccaagcaacagccctgtccttagcactctattcccaaaccagtgcctggactggaccaacctcaaacgagagccggagctggagcaggaccagaacttggccaggatggccccggcaccaggtaccccgctgtgacccactgtcattccccagggagtgccaaggggaggaaggatgaagggactcttgcagcagggccccttgggg

SEQ ID NO: 140467 - DNA, 601 bp, Human
gccctcatcccttctgccctgttagggagacgagagtgtcaggttggagccagtacttagttactggcatgtggggcctcactggaggcccagtctagggctggagttgggttgctcagaaaaacagactggtccaaagtcttccccggggtctcctcctggcctcttcttgccgccgcctgctctgggcagagcccgggagtgtgagccgccagaagcagcggcacgtggctgtctctctgggcctcctcctcctaggaagggcgtgccctccttgctccctctgggcttcccagaaacygtggctattgatgctgatggtcctatctccccacagtgcccagagaccaggctccaagcaacagccctgtccttagcactctattcccaaaccagtgcctggactggaccaacctcaaacgagagccggagctggagcaggaccagaacttggccaggatggccccggcaccaggtaccccgctgtgacccactgtcattccccagggagtgccaaggggaggaaggatgaagggactcttgcagcagggccccttggggccctggagtcaggaaggacccacgaagtcactggatgcag

SEQ ID NO: 140468 - DNA, 601 bp, Human
gctctgggcagagcccgggagtgtgagccgccagaagcagcggcacgtggctgtctctctgggcctcctcctcctaggaagggcgtgccctccttgctccctctgggcttcccagaaactgtggctattgatgctgatggtcctatctccccacagtgcccagagaccaggctccaagcaacagccctgtccttagcactctattcccaaaccagtgcctggactggaccaacctcaaacgagagccggagctggagcaggaccagaacttggccaggatggccccggcaccaggtacccygctgtgacccactgtcattccccagggagtgccaaggggaggaaggatgaagggactcttgcagcagggccccttggggccctggagtcaggaaggacccacgaagtcactggatgcagcccgggctctgtggcttctgcttgggcctctcagacagggagctaattccccgacgtgggctaggtgggagaagaggccagaagcagcagctgggccggtccgtgcagggagtgaggtgggcactgtggagtgaggctgggggtgtctctgggctggaaaagctgaggagccacagtgagg

SEQ ID NO: 140469 - DNA, 601 bp, Human
ctccaagcaacagccctgtccttagcactctattcccaaaccagtgcctggactggaccaacctcaaacgagagccggagctggagcaggaccagaacttggccaggatggccccggcaccaggtaccccgctgtgacccactgtcattccccagggagtgccaaggggaggaaggatgaagggactcttgcagcagggccccttggggccctggagtcaggaaggacccacgaagtcactggatgcagcccgggctctgtggcttctgcttgggcctctcagacagggagctaattcccsgacgtgggctaggtgggagaagaggccagaagcagcagctgggccggtccgtgcagggagtgaggtgggcactgtggagtgaggctgggggtgtctctgggctggaaaagctgaggagccacagtgaggacccagacattcctggcagtaagtatctgggttgacaccctgaaaccctccacatgaggtgatgaaggtagtggtgtgtggtagagggtggtgggaagggggtgccctgtgtttattttatttcattttattttttgagacagtgtctcactctgttgcccaggctggagt

SEQ ID NO: 140470 - DNA, 601 bp, Human
caagcaacagccctgtccttagcactctattcccaaaccagtgcctggactggaccaacctcaaacgagagccggagctggagcaggaccagaacttggccaggatggccccggcaccaggtaccccgctgtgacccactgtcattccccagggagtgccaaggggaggaaggatgaagggactcttgcagcagggccccttggggccctggagtcaggaaggacccacgaagtcactggatgcagcccgggctctgtggcttctgcttgggcctctcagacagggagctaattccccgaygtgggctaggtgggagaagaggccagaagcagcagctgggccggtccgtgcagggagtgaggtgggcactgtggagtgaggctgggggtgtctctgggctggaaaagctgaggagccacagtgaggacccagacattcctggcagtaagtatctgggttgacaccctgaaaccctccacatgaggtgatgaaggtagtggtgtgtggtagagggtggtgggaagggggtgccctgtgtttattttatttcattttattttttgagacagtgtctcactctgttgcccaggctggagtgca

SEQ ID NO: 140471 - DNA, 601 bp, Human
gggcacctgggccctcctctccgcactccctctcaactcactggcagctctgggcgttctctgtgctgtgaatgttggggctctggtgggattaaggattcaaaacgttcatcctcatcaccattcattgagctctgaccacgtgcctggccctgtgctaagcaattgacaggcatgagtgccagagtcagatgaaaggttaaggttcagagaggttaagtcacttttccaggatcagacagcaagtagatatcagaaccagcattcaaacccagcttcggccaactcccagctcttaacyactgggctattcagcctctagatgaggcaaggaggggcctccagatcccctctctcacatccaactttgtagaagggagactgagccacagagaggcaaacggacctccctgggacacacagcaagcaagcagcagaactggcaatccagtgccccttactctgtgtacccagccttggccagagctgggcatggaagagaccatgggaccccaggcctgtccctgtcaccgcagcccccagtggcctcacatgctgcccctgctcccaggtcttctccacccctcacgggctcgaagtg

SEQ ID NO: 140472 - DNA, 601 bp, Human
ctcctctccgcactccctctcaactcactggcagctctgggcgttctctgtgctgtgaatgttggggctctggtgggattaaggattcaaaacgttcatcctcatcaccattcattgagctctgaccacgtgcctggccctgtgctaagcaattgacaggcatgagtgccagagtcagatgaaaggttaaggttcagagaggttaagtcacttttccaggatcagacagcaagtagatatcagaaccagcattcaaacccagcttcggccaactcccagctcttaaccactgggctattcmgcctctagatgaggcaaggaggggcctccagatcccctctctcacatccaactttgtagaagggagactgagccacagagaggcaaacggacctccctgggacacacagcaagcaagcagcagaactggcaatccagtgccccttactctgtgtacccagccttggccagagctgggcatggaagagaccatgggaccccaggcctgtccctgtcaccgcagcccccagtggcctcacatgctgcccctgctcccaggtcttctccacccctcacgggctcgaagtgcatgtgcgacgct

SEQ ID NO: 140473 - DNA, 601 bp, Human
tgctcatccactcagacacgcggccctacccctgccagttctgcggcaagcgtttccaccagaagtccgacatgaagaagcacacctacatccacacaggtgagtgagtctcacctgcctgtgccccctgggcagagcacccccacctttccctgagagatgcatcagaggcccccagcgtgaggctgggggcggggtctagttacaaagtcaaaggccactgctgatggagggctgggcacctgtgctacttaagtgcacttaatgcatggaaaaaaatacagggaggaaacagcaaaayctcaacactgttgatctcatggcagacatgagactagcaggcgaactgctcattcatttgttcactcattcactcactcacttgctcattcatttgttcactcatttgctcatttattcacacattcgctcactcatttgctcattcatttgttcactcattcattcatttgctcattcatttgttcactcattcatttgctcattcatttgttcagtcattcattcatttgttcactcatttgctcattcatttgttcactcattcattcatttgttcactcatttgctcattcatttg

SEQ ID NO: 140474 - DNA, 601 bp, Human
ccactgctgatggagggctgggcacctgtgctacttaagtgcacttaatgcatggaaaaaaatacagggaggaaacagcaaaatctcaacactgttgatctcatggcagacatgagactagcaggcgaactgctcattcatttgttcactcattcactcactcacttgctcattcatttgttcactcatttgctcatttattcacacattcgctcactcatttgctcattcatttgttcactcattcattcatttgctcattcatttgttcactcattcatttgctcattcatttgttcastcattcattcatttgttcactcatttgctcattcatttgttcactcattcattcatttgttcactcatttgctcattcatttgttcactcattcattcatttgttgattcatttgttcactcattcactcatttgctcatttattcacacattcgctcactcatttgctcattcatttgttcactcattcatttgcttattcattcattcactcattcattcacttgcttattcattgcctccttgctattagctgagtgcctcttttgtgccaggtataccaggcttggagatgtattg

SEQ ID NO: 140475 - DNA, 601 bp, Human
attcgctcactcatttgctcattcatttgttcactcattcattcatttgctcattcatttgttcactcattcatttgctcattcatttgttcagtcattcattcatttgttcactcatttgctcattcatttgttcactcattcattcatttgttcactcatttgctcattcatttgttcactcattcattcatttgttgattcatttgttcactcattcactcatttgctcatttattcacacattcgctcactcatttgctcattcatttgttcactcattcatttgcttattcattcmttcactcattcattcacttgcttattcattgcctccttgctattagctgagtgcctcttttgtgccaggtataccaggcttggagatgtattgataaacaagatgactcggcagctgcccctaaccaccctataatccagtaggggtggaggagggtccaagttgtatctttgcttctctctcttttctaattattttctaaagtgaatgtgagttggccatgagagaaaacacaggaaggtattggaaaatgaacccgggggcagggcaggggagcagcaggcctggtgaggaggccct

SEQ ID NO: 140476 - DNA, 601 bp, Human
gaggagatcaaggttttggggttgatctgcagagacagggggagtcctgggtggggatagagacagggagagtcctgggtggggatagagacaggggaagtcctgggtggggatagagacagggggagtcctgggtggggatagagacagggggagtcctgggtggggatagagacagggggagtcctgggtggggatagagacagggggagtcctgggtggggatagagacagggggagtcctgggtggggatagagacagggggagctccgtggggcagactcaccacaggacactgargcttgtgcccgccaacaggcagaaccccagacccagggccagtctccggcgatgcattgctgggggctgcacctgagcctgggcacttgtagagacccccactggcctgggcggatgaggctgtcccctcgcagggatgtcaggctctgagcctggtctctgaggtcccaggaacacctgcaaaggaacacttttgttgttttgagatagagtttcactcttgtcaactgggctggagtgcagtggcgcaatctccattcactgcaacctcttctcttgggttcaagcgattctcttgtc

SEQ ID NO: 140477 - DNA, 601 bp, Human
attatgtgtcagtccctgggtggaataagatgatggtgaccggaccgatgcagtagctcatgcctgtaatctcagcactttgggaggctgaggcaggtggaacacttgaggtcaggagtttgagaccagcctggccaacatggtgaaacgccatctcaaataaaaatacaaaaattagccaggtatggtggcgggtgcctgtaatcccagctacttgggaggctgagacaggacaatctcttgaactggggaggtggaggttgctgtgagccaagatcacgccactgcactccagccaggrcgacagagtgagactctgactcaagaaaaaaaaaaaaaagactccttagttgaggaggactttggtcacatgttcatttgttccttgaatccatggaacacaaaattgagcaacaaggtcaagtcctaaaagcactgaacacaacccctgctggtcaccgggagcaacagcaggctgtttatgggcatctttgcactctgtgttctcagtggccagacacagcaagcaaggctcacagctgtgcaacatgtggacggtcagaccatgcagggggctgcaaggatgctggaagaccgaaat

SEQ ID NO: 140478 - DNA, 601 bp, Human
ctgggaaattgggagcaacctaaatcccgagagcaattggtggtgggaaagagagagaggctcaaaaattatgtgtcagtccctgggtggaataagatgatggtgaccggaccgatgcagtagctcatgcctgtaatctcagcactttgggaggctgaggcaggtggaacacttgaggtcaggagtttgagaccagcctggccaacatggtgaaacgccatctcaaataaaaatacaaaaattagccaggtatggtggcgggtgcctgtaatcccagctacttgggaggctgagacaggasaatctcttgaactggggaggtggaggttgctgtgagccaagatcacgccactgcactccagccagggcgacagagtgagactctgactcaagaaaaaaaaaaaaaagactccttagttgaggaggactttggtcacatgttcatttgttccttgaatccatggaacacaaaattgagcaacaaggtcaagtcctaaaagcactgaacacaacccctgctggtcaccgggagcaacagcaggctgtttatgggcatctttgcactctgtgttctcagtggccagacacagcaagcaaggct

SEQ ID NO: 140479 - DNA, 601 bp, Human
agccctgggaaattgggagcaacctaaatcccgagagcaattggtggtgggaaagagagagaggctcaaaaattatgtgtcagtccctgggtggaataagatgatggtgaccggaccgatgcagtagctcatgcctgtaatctcagcactttgggaggctgaggcaggtggaacacttgaggtcaggagtttgagaccagcctggccaacatggtgaaacgccatctcaaataaaaatacaaaaattagccaggtatggtggcgggtgcctgtaatcccagctacttgggaggctgagacrggacaatctcttgaactggggaggtggaggttgctgtgagccaagatcacgccactgcactccagccagggcgacagagtgagactctgactcaagaaaaaaaaaaaaaagactccttagttgaggaggactttggtcacatgttcatttgttccttgaatccatggaacacaaaattgagcaacaaggtcaagtcctaaaagcactgaacacaacccctgctggtcaccgggagcaacagcaggctgtttatgggcatctttgcactctgtgttctcagtggccagacacagcaagcaa

SEQ ID NO: 140480 - DNA, 601 bp, Human
gcccaggtggctcacacctgtagtcccagcactttgggggcccaacgcgggcaaagcgcttgagcccagtagttcaagaccagcctgggcaacatggcaagacctcatctctacaaaaacaacaaaaattagctgggtatggtggtgtgcacctgtggtcctggctacttgggaggctgaagcaggaggatggcttgagcccaggaggtggaggctgtagtgagctgtaatcacactactgcactccagcctgggccacccacaaagtgagaccctgtctcaaaaaaaaaaaaaaaaaaaagaacttcacctgtgggctgtggtgtctgctcctatctgagtttcagctgcttagccagcctcaccatcacataagtcaattttcctaggtatgttggccatctgtctaccttcctacctcttactggttctgtttctctagtggaacactgactgccatttctctgcatctgcaaaatgggcaaaaccatccttagccttagcgatgtggtgagagttacacaaggtgtgtgaggggctcttgaccatgtccagcatggagcaagtgctcagtaaggtgagggatcctgggcaagtcttg

SEQ ID NO: 140481 - DNA, 601 bp, Human
attaacattctatatcagttgattttacataaaagagagtatcctagacaacctgggtgggaccgatccaattggttgaaaggccttaagaacagaactggtggccagcccaggtggctcacacctgtagtcccagcactttgggggcccaacgcgggcaaagcgcttgagcccagtagttcaagaccagcctgggcaacatggcaagacctcatctctacaaaaacaacaaaaattagctgggtatggtggtgtgcacctgtggtcctggctacttgggaggctgaagcaggaggatggyttgagcccaggaggtggaggctgtagtgagctgtaatcacactactgcactccagcctgggccacccacaaagtgagaccctgtctcaaaaaaaaaaaaaaaaaaaagaacttcacctgtgggctgtggtgtctgctcctatctgagtttcagctgcttagccagcctcaccatcacataagtcaattttcctaggtatgttggccatctgtctaccttcctacctcttactggttctgtttctctagtggaacactgactgccatttctctgcatctgcaaaatgggcaaaaccatcct

SEQ ID NO: 140482 - DNA, 601 bp, Human
gaggagctggggacccctacagaagtgatctgtccagggtcactgagagagtaagtggcagggcagtgattcgaacccagtgccgcttgctcccaaggctgatgcttttccaaccatgtcgctctcgttgtcggaaagaagatgtgaaaacctgcaaagggccaggcgcggtggctcacgcctgtaatcccagcactttgggaggcggaggcgggtggatcacaaggccaggagttcaagaccagcctggccaagatggtgaaacctcgtctctactaaaaatacaaaaattagctgggcrtggtggcgggcgcctgtaatcccagctactcgggaggctgaggcaggagaattgcttgaacccaggaggcagaggttgcagtgagccgagatcgcaccattgcactacagcctgtgtgacagagcaagattccatctcaaaaaaaaaaaggaagaaaagctgcaaaggcctggtgactgggacctcgggtgagctaagagctaattaacctgagcccactgtaatggtcagttgtaggcaatcctcctgccttagcctcctgagtagctggacctgccaggcactcattaccacccccgg

SEQ ID NO: 140483 - DNA, 601 bp, Human
agaaggaggagtcagaggcccctgcgggtgggcacccagggtccatgcaggctccctctgaccttcccccacagccccacccgactctacagaggagctggggacccctacagaagtgatctgtccagggtcactgagagagtaagtggcagggcagtgattcgaacccagtgccgcttgctcccaaggctgatgcttttccaaccatgtcgctctcgttgtcggaaagaagatgtgaaaacctgcaaagggccaggcgcggtggctcacgcctgtaatcccagcactttgggaggcggasgcgggtggatcacaaggccaggagttcaagaccagcctggccaagatggtgaaacctcgtctctactaaaaatacaaaaattagctgggcatggtggcgggcgcctgtaatcccagctactcgggaggctgaggcaggagaattgcttgaacccaggaggcagaggttgcagtgagccgagatcgcaccattgcactacagcctgtgtgacagagcaagattccatctcaaaaaaaaaaaggaagaaaagctgcaaaggcctggtgactgggacctcgggtgagctaagagctaattaac

SEQ ID NO: 140484 - DNA, 601 bp, Human
tgctggtggcagaggcaagaaagagccatcatcatgggtctggggacagagacactcagcacaggaagaaggaggagtcagaggcccctgcgggtgggcacccagggtccatgcaggctccctctgaccttcccccacagccccacccgactctacagaggagctggggacccctacagaagtgatctgtccagggtcactgagagagtaagtggcagggcagtgattcgaacccagtgccgcttgctcccaaggctgatgcttttccaaccatgtcgctctcgttgtcggaaagaagatktgaaaacctgcaaagggccaggcgcggtggctcacgcctgtaatcccagcactttgggaggcggaggcgggtggatcacaaggccaggagttcaagaccagcctggccaagatggtgaaacctcgtctctactaaaaatacaaaaattagctgggcatggtggcgggcgcctgtaatcccagctactcgggaggctgaggcaggagaattgcttgaacccaggaggcagaggttgcagtgagccgagatcgcaccattgcactacagcctgtgtgacagagcaagattccatctcaaaaa

SEQ ID NO: 140485 - DNA, 601 bp, Human
ccaaactccagtgagctaggcactactatccacctgcacagaaaaagctcagagcagttgggtacgctgcccagggtcacacagcccaggtccctgactcccagccctgtgtctttccacagtccctaactctctgggccccaaggccaccctgatgttagcacctccactaccccaccttataaatcagagctcttttgtccttttcccccgcccccatcaggcctctccatgacacctacctgtgctccagcagcttgggctgagggtactgtgacctgcaaccaagaaggaccagtgrtggaggagagccaccaccctcacggccacaaaagaggaaatgccagtctccttaccataccacgggctggagtggcttctccctcttgtagtgcagcttcatgttgctggtggcagaggcaagaaagagccatcatcatgggtctggggacagagacactcagcacaggaagaaggaggagtcagaggcccctgcgggtgggcacccagggtccatgcaggctccctctgaccttcccccacagccccacccgactctacagaggagctggggacccctacagaagtgatctgtccaggg

SEQ ID NO: 140486 - DNA, 601 bp, Human
tctccctggacggtccataggcctgaaaagctgctgtgatcttcctgtcaagctggtgactgagacttcccatcactcgctgtcatctctgagagcacagatttgttccttcttccttctccttttcattttcttcaagatgtggtcccaaaacacgaataccgccagcccatatccctgtctgccactcacccaagccagtctggagttcctgatctcattctcttcccgtttctgtcatcctgttggtgtccctttcttggtttatttttccaggaagggcaaaagaacaaaaaggggraacaggacacctgcctagggcattgcttctcttctcctggtggtgtttcagaattgcctgtccccgggaaaagggtgagggacttggtgattgtacttttccttgatcccaggaaagaacttcagtcccttttctggcttctgagaggagagatttttgttgctgctggtaaagatgagatgtggaacccccaggccctatctcaattcagacttacccacctgggaaacttggaggcttccaaacctctgcagataaaacatagtacatgaaatgatgtaaacaaaacttgtgctcatg

SEQ ID NO: 140487 - DNA, 601 bp, Human
ggaggcttccaaacctctgcagataaaacatagtacatgaaatgatgtaaacaaaacttgtgctcatgggactggagagtaaagactggaaaagttatcagtaaaacttgacctgaagctaagtttctagggacgtcatcgtgattgacgtgttcggtactgatggcttagttgatgccaggcactgtgctgaggatgggcatagttgaagtgagtgacagagtcctggggtgggaggctgggcgtgccaagaaattcttataattcaatatccgatgaggcacaatcacctagtggttgmgaatgaggtactggagtcggttgtgaatgtacatgatggggatcggatgaggtcatgcatgtcgtgacgggtctcgtgcgtaacacatagtaggatcccagtcagcgagcattagtattctgtccacacagtactgagtacaggcacggcgtggagggagtccctggagggttaaagagtattttgtgagtaaagtcaggggaaatggagagtgtgcctttccctttttgagttcttctgggcttaggaaggagatgaaccagataagcctactgtttgttgagtgcttccttttcatgg

SEQ ID NO: 140488 - DNA, 601 bp, Human
cctcaaaagacaactgatccatcccaccaatagcaactcgtctccttgggtcctctgtcctcccgtggcatagttccttaccccttggtttaatatttatgtcatcttgccttctgtcaagagcagattgatgaggactagggctgtgtcttgtttatctttctttccccttcaatggtttaacttggtaacactcaactattggcttaagaaagaatcagctgaggcagggcgccgtggctcacacctgtaatgccagcactttgggaggttgaggcggactggtcacctgaggtcaggagttcgagaccagcctggccaacatgatgaaaccccgtctctactaaaaatataaaaattagccaggtgtggtggcgggctcctgtaatcccagctactcaggaggctgaggcaggagaattgcctgaacccaggaggtggaggttgcactgagcccagatcgcaccactgcactccagcctgggcgaccgcaagactccatccccctaaaaaaaagaatcagctgaagctgggcttgtagaccgaatgttctcttggttcatgtagagttttccctatctgaaatgcttgggaccagaag

SEQ ID NO: 140489 - DNA, 601 bp, Human
tttttttttttttttaaagacagtctgtcttgctctgtcacccaggctggagtgcagtagtgtgttctcgcctcattgcaatctccacttcccgggttcaagcgattctcctgcctcatcctccccaagctgggattacaggcgcctgccaccacgcctggctaatttttttgtatttttagtagagacgcggttttgccatgttggccaggctgttctcaaactcttctcttgacctcagatgatccacccgccttggcctcccaaagtggtgggattataggcatgagccaccacgccyggcaagtattttctatttagaaaaacatggtaatgccacatatctaaaactggaacaaaaataacagatcagtggaagagaatggaaacaagtaatcccagacataaatacaaatataatattgcggaagccaacatttcaaattggtcgggggcaagtactatttagtcagtggtgctgggaaatcagtttccaaatgggacaactattgggaaaatagtctcactcaacatgaaactgagagaataaatgtttaaaacttcaaaagaactaaatacaggtgtatattatttagccttc

SEQ ID NO: 140490 - DNA, 601 bp, Human
gggcggcagagtgagactctcaaaaaaaaaaaaaaagagttcagaggtagattctggagatggatcaatttctgtgtgtccctggacaaactccttaacctctgctcctcacttgcaagaggttttcggaagattcaatggatggatgtttattatacacttaaagcagaagtcatcaagttggctgtcacctgggttgtttttgttttgttttgtttttgttttggggtttttttgtttttgctttgttttgctttttttcaagacagggtctcatggtgtaaatgaagttttctgagarcacaaccacacctattgatactgttgtctatggctgcttttgtgctttagtgtcagagaggagtcctgactcatctgttctacaattcctgaagaatttactaggcagctccaacaaagtgtttcccagcctagttcaatgcctagcatctagaaagcaccgtagagttatgaaatgtaccaccacgaatacagtttttactgcagtgtaaccatcaaaatgaactaagcacatctgtgtgaactcaaacaatctccaaaagagaagtgacacttggggagggttcagaatgatgtgctg

SEQ ID NO: 140491 - DNA, 601 bp, Human
gtctatgtgcaggtggacatttacatacaacttttttttcagtttagctgcaattatactataatagtgttttgatttctgccctgggtttaaaattttgttgtgaattattttcatagctgttcacttttcattgtacagatgtaccattatgttacgttattgttggtgtgatgaactgtattttctccatttattttacagatagaggacaaagaaactataaacaatttagatacttcatcatctgacttcactatattacaggtaaactgttgtatgtctcagtacttttagaatraaaggtcagaccacaatttctggaatccatttcagacaccatatgccagttccagctaataatcaccacaagggttgtttcctttgtcaggatcgttaatgggtgtttgctttctgctttcctccaaatataatgtacgcattgccagggacttaactctaggcttcgacgagtggcctccaagcgctgtggcttaccagcagtcattagagtcatgttttgtggcattcttaatttcattgcttgtggcaggggaaggcagcctgtctcatctaccctgggtggcatcccctgcagaaa

SEQ ID NO: 140492 - DNA, 601 bp, Human
ttaactaccagcattacatagatgaatgagaaggaagggtggtccccatgctcgtggggcctggcctgatggttaacagtgcagactcacactcatacacggcctttgctcagagcctgtctctgcttcccacctgctgtgtgtccttgggcaagttactcagtctgtctggtcacagtctgttactctgtaaaaagaagggtgctaccattaggaccaacctcctgcaaccgatgacgagtctgtgtgtatgtaaggtgcttacatttgtgcctggaacctagtcagtgcccatcagttractggaattccagaggagtgtaccttgtgtgcacaggaaacataaaggctgggggatcacatcatgtggaaaaagctcctttgcttagtggggcacagctggagttgggttagagggaaatagggaaagccttcctgaaaggagatgccactgagctggatactgagggatgtggatgacttggctggacggggcaggggagggctgggcctgtcagggagggaggtggcatagggatccattggctgaaggctgaaggccacagagggacatgagcttactgtggacacaaggtgcaga

SEQ ID NO: 140493 - DNA, 601 bp, Human
gaagacgggaggaagtttgattttgacgcttgtaatgaagtccctccggctcctaaagagtcctcaaccagtgagggcgctgatcagaaaatgaggtttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatggttgtgttyttaaattcttcctaattacctttagcccagcagaattaattaactcctgtgggtctgaaatcttatggttaggtcagattttcaatacaagtttgtcggggtatcattttttcagaactaaatttcgggtaggtatgcaacctcagcacgaattttatggttttgagtttgtttcctccatgctgcttccttgtggagtgacattgtcttttgtctctagttctcccgaagatgactcggatacaaaaaggctttccaaagaggaaaagggtaggtcacctcggcgacaccagtcccttg

SEQ ID NO: 140494 - DNA, 601 bp, Human
ctcccgagtagctgggattacaggcgcacaccattatctttttagtagaaacaaggtttcaccatgttggccaggctggcctcgaactcctcacctcaggtgatccgcccgcctcggcctcccaaaagtgctgggattacaggcatgagccactgcgcccagcctcaaattattttaagaaatgcagaaagctttcctttatccttacttttgctctgataactgttaacttattttctaaagctaactttaaaatttacatatgggactgttggcttttccctgagtcggtgtgtggcartccacgttccctgtctaccctgaaagtgtcagcacctccccgtgatgcattcctacacccagcagtgtggagcatgccatggtgacctggcccatctcgccagcctccctctagcctgctctccaccttgaccccttcctgtactcttatcttcttgctgggctgcagtgtgagctgagcatggtggctcatgcctgtaatcccagcagtttggtatgctgagctgggaggatacttgagcccaggagatggataccaccttgggcaacatagtaagaccccatcttcacaagaaattta

SEQ ID NO: 140495 - DNA, 601 bp, Human
tgttattattattttttagacagtctgactctgtggcccaggctggaatacagtggcacaatctcagctcactgcaacctccacctcccgggggtttttaagtgattctcctgcctcaccctcttgagtagctgggattacaggcacctgccactatgcccggctaatttttgtacttctagtagagacaggatttctccatgttggtcaggctggtctcaaactcctgacttcaagtgatccacccgtcccggcctcccaaagtggtaggattataggcgtgagccactgcgccagcaattttttttttttttttttttttgtcagagtatcgctctgtcgcccacactggagtgtagtggcgcgtcctcggttcactgcaactactgcctcccaggttcaagggatcctcccacctcatcctccaaagtaactgagattacaagcatgcgccaccatgcccagctaatttttattttttatttatttatttatttttatttatttattttttgagacggagtctcagtcagtcactcaggctggagtcgagtggctcgatcttggctcactgcaagctctgcctcccgggttcacgcca

SEQ ID NO: 140496 - DNA, 601 bp, Human
ggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggtaagcagatccatgctgcccttagcacgtggcgttcagaatcgtgttagggacctcacagtccagttagcttgagattttttttttttttttttgagacggagtcttgctttgtcgcggaggctggagtgcagtgacccgatcttggctcactgcaagctctgcctcccgggttcacaccattctcctgcctcagcctcccgagtagctgggactacaggcgtttgccacctctcccggctaatttttttgtattttcagtagagacggggtttcactgtgttagccaggatggtctctatctcctgacctcgtgatccacctgcctcggcctcccaaaatgctgggattacagctgtgagccaccgcgaccggcca

SEQ ID NO: 140497 - DNA, 601 bp, Human
tgccttcttcctgccctttctttgagcaagaggcaaaatgaggaaagagaaaagtaaagcactagaaaagtctaggtttgtggaatggaaatttgggattatttggggttagtcttggctgtcagtccaaacagttactctgaagctgtttttagccttgaccctggggttctgtgtgccacactcaccacacatgtgcaacagtgccagggaaccttgggatgtgacctggctctgctgggaagtgtctagtgagccgcacagctgactcagacaggtgcatctggggaggctgtggttrctgtgtctgtcctcgagtgcctgccctcttttgaaagtaaggacatccttcatcaccccagggcccagcttagccttggaaaacaactagatctgtggtctgtgctcattctcttcgggggctagcacattagaacaataagctccattttctccttccatcttacattgagactgagacttcccaggagagccttggacctctagtggctttccctataaacttgggggcagcacattgctgtgtggaagatgcctcctctctgaggactccactcatgagcccttcctcctcctgcca

SEQ ID NO: 140498 - DNA, 601 bp, Human
tcaggagtcccttttcttactttgttgaggggaggcatcagagcacatgctgggaggataggccaggaagcaggcagtggtaacgtgggacatcgtgcacgtggtggagcatgccgccatctctcccttcaccctggcagagctctccgttgaacggggaggtgaacttggacatggacaacaaccagcctgtgtcaagggggtttccttaccaggactcctttctagtttcctttcacctacaatgtggtcatggggcaaaaaccccagagaccacatatgtattggtggaaagagaaaraacaggactgtggagccaaagctacctcactagcttttgtgaaagtcaggctggaaagtgcttccagccacagaaataggctgtgggtgtaaatattaaccttggccatcaaataagtaggcatagagtgtgactcgccctctcttggtcttccctgaaacagcagggtcaagaactcctggtctgtgttagccacgtggcttacaaaaacaatgacacagaagagggaaaggtgggactagccaagtggaaggccagccgtttatctctcagtgtcctgtgtcttatatcctgagcaga

SEQ ID NO: 140499 - DNA, 601 bp, Human
cggggaggtgaacttggacatggacaacaaccagcctgtgtcaagggggtttccttaccaggactcctttctagtttcctttcacctacaatgtggtcatggggcaaaaaccccagagaccacatatgtattggtggaaagagaaaaaacaggactgtggagccaaagctacctcactagcttttgtgaaagtcaggctggaaagtgcttccagccacagaaataggctgtgggtgtaaatattaaccttggccatcaaataagtaggcatagagtgtgactcgccctctcttggtcttcyctgaaacagcagggtcaagaactcctggtctgtgttagccacgtggcttacaaaaacaatgacacagaagagggaaaggtgggactagccaagtggaaggccagccgtttatctctcagtgtcctgtgtcttatatcctgagcagagcaaggtgcaagaccctggactgggcatccagcagaaacttccgagaaacttgactgtgaggaaggatgcttgcctagcaattggtcggatgaagggctccatttgatacttccttcactgtggaaggaagaaatttgtaaaaattatttccag

SEQ ID NO: 140500 - DNA, 601 bp, Human
gtgaccagctcagtgccacaccaccagcagatccaagtggctgtgagtcagagaagctggggaagcagaggctgaggtgtttgctcagtttctcaggtctggaagccgttggaggtgtagcaaactggagaagtcaggtgacagtaggtaaacaggactgatgggggagggaacctgtttctggaccctctctgagcttatgtcttcactctgaaaatacccaattgcagctcaaaaggggtctcagccccacagtatggggaggacatgctctgctctgttcaaaaggctgctgggtaattgtgtgtgtgtgtgtgtgtgtgcgcgcgcgcgcgcgcgcgtgtggttggtcttcagaggctcggaaaatttgtaaattattcaacctgtaggacctgttgcccaaacctggagggcccaagttaatgcaaaaaaattcctaagaccctccctaaggtgtgtcccacgcacccacctcatgaacaccttctcccttctaaccctctgcagcccacctggtcagaagcccgccccaacgcagccagaagggcggaaggaatgcccaggatgccagggttccacgctagctccacccacccca

SEQ ID NO: 140501 - DNA, 601 bp, Human
gcaaggagagatttctggcaacagagagcccgaagcgggagggccttcattcagttcctcaatgacaccatttaggcagccgtcctcaaacctgacagtgcctaagaatcacaaggggcagtttgtttaaaaggacatgccccaggcctcactcctaggtgttcttatttaataaatctgggttagggttcaaaaatcatcatgtttaccaaagccctcccacccagcacacacaccagatctgatgctaggctcagaactaagcttttgagaaatactgatttagggtgaggctaggcaygtgtgtgggtaatgggggcaggaagaggtgccctagaaggaaattcagaagctgagatagctctttgagatacttaaaggtatacatacttcttttgtgtattttcttgcattgcagtaggaagagggaacttgagtcacccaagtccagccttccagcaccagagtgttggaaccggcagaagcctaagtcccagctagtccaggcccttagacaacgagtacacctgagaagtcctggcagctccagggtgtgtgggcggcagctgatcccgaggaaaacaaacctctgggctctaag

SEQ ID NO: 140502 - DNA, 601 bp, Human
aaacagtgcgatactggcacatgaatagggagaccaaattatggaagagactagaaagttcagaactaataaaaataaaaaatagtttagtctgcactactgatctgtatactttaaaatggttattttattttatttttttttgaggatgagtcttactcttgtcgcccaggctggagtgcagtggcacaatcgtggctcactgcaacctctgcctcccctcttgcctcagcctccggagtagctgggattacaggtgcctgtcaccacagctggctactttttgtatttttagtagagttggggtttcaccatgttggtcatgctggtttcaaactcctgacctcaaatgatccacctgcctcggcctcccaaagtgctgggattacaggtgtgagccactgcacccggctgatacattttatattatgtgtttttaccacattaaaaaaataacttagtctaagtgcttgctacacatacaggcagtttctaagtgtgctacatagattaactaacttgatcttctcaatagtctatttgacagaagaagagactgaggttatatagctaattaggggtgacctgcattcaagtccag

SEQ ID NO: 140503 - DNA, 601 bp, Human
tccataccaaaaaatacaaaaattaggccgggtgaagtggctcacgcctgtaatcccagcactttgggagacagagaaggtcggatcacaaggtcaggagtttgagatcagcttggccaacatggtgaaatcctgtctctactaaaaatacaaaaattagccgggtatggtggcgggtgcctgtaatcccagctacttgggaggctgaggcaggagaatcgcttgaaaccggaaggttgcagtgagctgagatcatgccactgcactccagcctgggcaacaagagtgaaactccatctcaaaaaaaaaaaaaaaaaaattagctgggcatagtggtgcatgcctgtaatcccagctactcgggaggctgaggtaggagaatcacttgaaccccggagatggagtttgcagtgagccgagatcgcaccactgcactccaccctgggcaaccctgtctcaaaaaaagaaaggatatctaaggagggcaaacaatccactccctggcccaaacctaaccccagggagcagatagagaaataaagagattaaaagcaggacgcagcagggccttagaaagtaaagccattggtacctgcagatg

SEQ ID NO: 140504 - DNA, 601 bp, Human
actgtacactgctggagagagggtctgggagggaggctcctttggacccataaacaggtaatgctcaatgctgactcagagacccacgtgcgcgtgtgaccaactcaggagataaaacatctaatcctcctctggcagcatcagagataaccacctggctccagtccaagaaggtacaacctgggtcaactctcagagattataaactaattagaggaaaagatatctaaggccatgtgcggcagctcacgcctgtaatctcagcactttgggaggctgaggctggcggatcacctgagaycaggagttcaagaccagcctagccaaaatggtgaaaccccatccataccaaaaaatacaaaaattaggccgggtgaagtggctcacgcctgtaatcccagcactttgggagacagagaaggtcggatcacaaggtcaggagtttgagatcagcttggccaacatggtgaaatcctgtctctactaaaaatacaaaaattagccgggtatggtggcgggtgcctgtaatcccagctacttgggaggctgaggcaggagaatcgcttgaaaccggaaggttgcagtgagctgagatcatgcc

SEQ ID NO: 140505 - DNA, 601 bp, Human
gtcatcccagcacattgggaggctgagatgggaggatcgtttgtgcccaggtggctgagaccagcctgggcaacacggcaaaactccatctctaccaaaaaactctaaaattagctgggcatggtgacacatgtctgcggtcccagctatctgggaggctgtggcagaaggatcacttgagcccaggaggtcaagtctgaagtgagctgtgattgtgccactgcactccagcctgggacccagagcaagactgtgtctcaaaaaaacaaaaaacagtgagagttctggggagggctggtgwctggagtatctgaaatgcagtaaggagggaaggaagacctacaggggaacatggagggtgtgagcaccctcaaagagatcaggcctgactccacaggcagggggacttttggttcctctgtggccccttctgaaatgctatgcctttgcaacccaagagcctgggttaggttggaggccatcctgtgctgccagctggcctgggcagtggggacccatgtccctgctcagaaacccaggcggtgggatggggttggcaggcatgagccaagcctgtcaaaagtatgtgcaggctcaatgg

SEQ ID NO: 140506 - DNA, 601 bp, Human
tacaaaattagccgggcgtggtggcacacacctgtaatcccagctactcaggaggctgaggcaggagaatcacttgaacccaggaggcagagattgcagtgaactgagattgcaccattgcactccagcctgggccacaaaagtgaaactctatctccaaaataataataataataatttaaaaaaaaagaattgagagtcaccaggcatcgtggcttacgcctgtcatcccagcacattgggaggctgagatgggaggatcgtttgtgcccaggtggctgagaccagcctgggcaacacrgcaaaactccatctctaccaaaaaactctaaaattagctgggcatggtgacacatgtctgcggtcccagctatctgggaggctgtggcagaaggatcacttgagcccaggaggtcaagtctgaagtgagctgtgattgtgccactgcactccagcctgggacccagagcaagactgtgtctcaaaaaaacaaaaaacagtgagagttctggggagggctggtgactggagtatctgaaatgcagtaaggagggaaggaagacctacaggggaacatggagggtgtgagcaccctcaaaga

SEQ ID NO: 140507 - DNA, 601 bp, Human
atacaaaattagccgggcgtggtggcacacacctgtaatcccagctactcaggaggctgaggcaggagaatcacttgaacccaggaggcagagattgcagtgaactgagattgcaccattgcactccagcctgggccacaaaagtgaaactctatctccaaaataataataataataatttaaaaaaaaagaattgagagtcaccaggcatcgtggcttacgcctgtcatcccagcacattgggaggctgagatgggaggatcgtttgtgcccaggtggctgagaccagcctgggcaacayggcaaaactccatctctaccaaaaaactctaaaattagctgggcatggtgacacatgtctgcggtcccagctatctgggaggctgtggcagaaggatcacttgagcccaggaggtcaagtctgaagtgagctgtgattgtgccactgcactccagcctgggacccagagcaagactgtgtctcaaaaaaacaaaaaacagtgagagttctggggagggctggtgactggagtatctgaaatgcagtaaggagggaaggaagacctacaggggaacatggagggtgtgagcaccctcaaag

SEQ ID NO: 140508 - DNA, 601 bp, Human
caccaggcgccgtggctcacgcctgtaatcccagcactgtgggaggccgaggcgggcagatcacctgaggtcgggagtttgagagcagcctgaccaacatggagaaaccccatactaaaaatacaaaattagccgggcgtggtggcacacacctgtaatcccagctactcaggaggctgaggcaggagaatcacttgaacccaggaggcagagattgcagtgaactgagattgcaccattgcactccagcctgggccacaaaagtgaaactctatctccaaaataataataataataattwaaaaaaaaagaattgagagtcaccaggcatcgtggcttacgcctgtcatcccagcacattgggaggctgagatgggaggatcgtttgtgcccaggtggctgagaccagcctgggcaacacggcaaaactccatctctaccaaaaaactctaaaattagctgggcatggtgacacatgtctgcggtcccagctatctgggaggctgtggcagaaggatcacttgagcccaggaggtcaagtctgaagtgagctgtgattgtgccactgcactccagcctgggacccagagcaagactgtgt

SEQ ID NO: 140509 - DNA, 601 bp, Human
catacttggcaggctgtccttcctttcaccccatccaaggtggctgtcagaggagggagtaaggatcagtgactcccaggcagataacacccctaaagctggtgaggttggagtccacactggctactggccacagtccagggacagagacatagacatcaaaggggcggagacagctctgcctggcattgagccctgtctagctatacagatacccttcacacttccctctcactttaacacctagagccagagtcctcctccctggcaccctctacctcaaggctggcagaaaagggamagatataaggccatcatggcagccggtcatctaaggttttctctggtcaccaacagaccttgggtaagaaagctggttgaattgtcaccgtgcagccaggcgagtttgggcaggttcctgagacacctatggccttactttctcccacggtgggcaagtcctgtgtttgataaacatttgaggaggctgcagcagccaggcactggcaaggaagacacagtcaggcatcccagagacctgcccttgagaaacgggagacacattcactgctgcaaggccaggacacagcacacagtactg

SEQ ID NO: 140510 - DNA, 601 bp, Human
gataaaaattagcccaaccaccttggactcatttattaaccaatcaaattagtccaaccagctaaggaaacagaggccagggaacacagccagttttcatgtaagcacacttggtcctttgaaccaaatgcataaccatttattagcaagcagtagcaataaatctggccaaagatttcagagaggaccagcagctgctgagtgcctgacctcacctcctcgcccatgctcctgggactcagaagcagcacaaggctctctgcctggcctgcaaatcccttcttgtttatgaggcgttttyatctcatacttggcaggctgtccttcctttcaccccatccaaggtggctgtcagaggagggagtaaggatcagtgactcccaggcagataacacccctaaagctggtgaggttggagtccacactggctactggccacagtccagggacagagacatagacatcaaaggggcggagacagctctgcctggcattgagccctgtctagctatacagatacccttcacacttccctctcactttaacacctagagccagagtcctcctccctggcaccctctacctcaaggctggcagaaaa

SEQ ID NO: 140511 - DNA, 601 bp, Human
ggcaccctgctttgttctccattatattccaagtgcccgggacgttgcctggcccatggcaggagtctgctgagtactggatgaatgtgtgaacgaatggatgccattaggaatgaatgccaggcacccaagtgcacacgtacacaggaggtttccaaatcgcagggtattcatggcagaatgcccgttatatagttggtaactgaggcacagaggaatcaagagactggcccagatgcccagctggggtaggaaccagggcttctggttccctgttccatgctccctccagtaccctacrtctactacagcaatgctgtgtttactctagggaccaaactggaaggttaaaaaaaaaatgcattctctaccccttgaaaaaaattgggtgtattctactactcaagaaaaataagattaaagattaaaggaacaagtacactttttttgagtagcagttatagagtcatagaatctaagataaaaattagcccaaccaccttggactcatttattaaccaatcaaattagtccaaccagctaaggaaacagaggccagggaacacagccagttttcatgtaagcacacttggtcctttga

SEQ ID NO: 140512 - DNA, 601 bp, Human
tcacagatggtaatccgcacttttcatcatagaggacagaacaaaaacatgactgccaggcagcccagtaactctatggaaacagacccaagtgggagctgaaccaccctattgaagtcactgctctggctttctgatacagtagtcctgccttatctgaggttttgctttccaagatttcggctacctgtggtcaactgcggtccaaaaatattaaatgggaaattccataaataatcacttcagaaattttaaagtgcccactgttctgagaagtgtgacgagatttcacaccgtcccrcccaggacatgaatcatcactttgttcagcattcctgcgctgtgcatgctacccatcactcgtcctgacatccaccgccatcatcatggctcggtgacccagagtcacccaaaacagctgatcctccttctaacacatggtcagaaagccctagtagcctaacactgagtcacaatgcctacatcattcacctcacttcatcccatcatgcaggcatttcacaacctcatatcatcacaagaagggtgagtacagtaataagacattttgagaaacagagagaccacattcacataactg

SEQ ID NO: 140513 - DNA, 601 bp, Human
aggcttggggcatgagctgacagtgctaatggcagctgcatcattcacagatggtaatccgcacttttcatcatagaggacagaacaaaaacatgactgccaggcagcccagtaactctatggaaacagacccaagtgggagctgaaccaccctattgaagtcactgctctggctttctgatacagtagtcctgccttatctgaggttttgctttccaagatttcggctacctgtggtcaactgcggtccaaaaatattaaatgggaaattccataaataatcacttcagaaattttaaastgcccactgttctgagaagtgtgacgagatttcacaccgtcccgcccaggacatgaatcatcactttgttcagcattcctgcgctgtgcatgctacccatcactcgtcctgacatccaccgccatcatcatggctcggtgacccagagtcacccaaaacagctgatcctccttctaacacatggtcagaaagccctagtagcctaacactgagtcacaatgcctacatcattcacctcacttcatcccatcatgcaggcatttcacaacctcatatcatcacaagaagggtgagtacagt

SEQ ID NO: 140514 - DNA, 601 bp, Human
tcctttgctgggctgtgaagctatccaggcttggggcatgagctgacagtgctaatggcagctgcatcattcacagatggtaatccgcacttttcatcatagaggacagaacaaaaacatgactgccaggcagcccagtaactctatggaaacagacccaagtgggagctgaaccaccctattgaagtcactgctctggctttctgatacagtagtcctgccttatctgaggttttgctttccaagatttcggctacctgtggtcaactgcggtccaaaaatattaaatgggaaattccakaaataatcacttcagaaattttaaagtgcccactgttctgagaagtgtgacgagatttcacaccgtcccgcccaggacatgaatcatcactttgttcagcattcctgcgctgtgcatgctacccatcactcgtcctgacatccaccgccatcatcatggctcggtgacccagagtcacccaaaacagctgatcctccttctaacacatggtcagaaagccctagtagcctaacactgagtcacaatgcctacatcattcacctcacttcatcccatcatgcaggcatttcacaacctcat

SEQ ID NO: 140515 - DNA, 601 bp, Human
agcctagccaatatggtgaaaccctgtctctactaaaaatacaaaaaataaaataaaaaattagcctggcgtggtggcgcatgcctgtagtcccagttactcaggaggctgaagcagaagaatcacttgaacccaggaggcagatgttgcagtgacagagactgcactccagcctgggcgacagagactccatctcaaaaaaaaaaaaattgagcaataaatgtaaaatctagagatgaggaaactagctggatttacaaatatatataaacatgtagcctagcgcctggcacgaggggtraggggagctaggctggagggctcagctagtcactcaggcaatggtcggctggccagctctggtctcccgctgggcctgtgctcttggcactgtaggggatatagaaatgaatcaagagaggccccaccctgccttcaaggcactaacaaaaaagatctgtcctcagatgactagacacccagcagaaatgccactccagagacacaaaaagtgctagaggggttctggcaggtgagtccagaaaagaattctgggtaactgaagacattcgaggtgagtcagccaccatcccacctggcc

SEQ ID NO: 140516 - DNA, 526 bp, Human
gtcaggagttcgagtccagcctagccaatatggtgaaaccctgtctctactaaaaatacaaaaaataaaataaaaaattagcctggcgtggtggcgcatgcctgtagtcccagttactcaggaggctgaagcagaagaatcacttgaacccaggaggcagatgttgcagtgacagagactgcactccagcctgggcgacagagactccatctcaaaaaaaaaaaaattgagcaataaatgtaaaatctagagatgaggaaactagctggatttacaaatatatataaacatgtagcctagcgcctggcacgaggggtgaggggagctaggctggagggctcagctagtcactcaggcaatggtcggctggccagctctggtctcccgctgggcctgtgctcttggcactgtaggggatatagaaatgaatcaagagaggccccaccctgccttcaaggcactaacaaaaaagatctgtcctcagatgactagacacccagcagaaatgccactccagagacacaaa

SEQ ID NO: 140517 - DNA, 601 bp, Human; identical to SEQ ID NO: 19563

SEQ ID NO: 140518 - DNA, 601 bp, Human; identical to SEQ ID NO: 19564

SEQ ID NO: 140519 - DNA, 601 bp, Human; identical to SEQ ID NO: 19565

SEQ ID NO: 140520 - DNA, 601 bp, Human; identical to SEQ ID NO: 24565

SEQ ID NO: 140521 - DNA, 601 bp, Human; identical to SEQ ID NO: 24566

SEQ ID NO: 140522 - DNA, 601 bp, Human; identical to SEQ ID NO: 24567

SEQ ID NO: 140523 - DNA, 601 bp, Human; identical to SEQ ID NO: 24568

SEQ ID NO: 140524 - DNA, 601 bp, Human; identical to SEQ ID NO: 24569

SEQ ID NO: 140525 - DNA, 601 bp, Human; identical to SEQ ID NO: 24570

SEQ ID NO: 140526 - DNA, 601 bp, Human; identical to SEQ ID NO: 24571

SEQ ID NO: 140527 - DNA, 601 bp, Human; identical to SEQ ID NO: 24572

SEQ ID NO: 140528 - DNA, 601 bp, Human; identical to SEQ ID NO: 24573

SEQ ID NO: 140529 - DNA, 601 bp, Human; identical to SEQ ID NO: 24574

SEQ ID NO: 140530 - DNA, 601 bp, Human; identical to SEQ ID NO: 24575

SEQ ID NO: 140531 - DNA, 601 bp, Human; identical to SEQ ID NO: 24576

SEQ ID NO: 140532 - DNA, 601 bp, Human; identical to SEQ ID NO: 24577

SEQ ID NO: 140533 - DNA, 601 bp, Human; identical to SEQ ID NO: 24578

SEQ ID NO: 140534 - DNA, 601 bp, Human; identical to SEQ ID NO: 24579

SEQ ID NO: 140535 - DNA, 601 bp, Human; identical to SEQ ID NO: 24580

SEQ ID NO: 140536 - DNA, 601 bp, Human; identical to SEQ ID NO: 24581

SEQ ID NO: 140537 - DNA, 601 bp, Human; identical to SEQ ID NO: 24582

SEQ ID NO: 140538 - DNA, 601 bp, Human; identical to SEQ ID NO: 24583

SEQ ID NO: 140539 - DNA, 601 bp, Human; identical to SEQ ID NO: 24584

SEQ ID NO: 140540 - DNA, 601 bp, Human; identical to SEQ ID NO: 24585

SEQ ID NO: 140541 - DNA, 601 bp, Human; identical to SEQ ID NO: 24586

SEQ ID NO: 140542 - DNA, 601 bp, Human; identical to SEQ ID NO: 24587

SEQ ID NO: 140543 - DNA, 601 bp, Human; identical to SEQ ID NO: 24588

SEQ ID NO: 140544 - DNA, 601 bp, Human; identical to SEQ ID NO: 24589

SEQ ID NO: 140545 - DNA, 601 bp, Human; identical to SEQ ID NO: 24590

SEQ ID NO: 140546 - DNA, 601 bp, Human; identical to SEQ ID NO: 24591

SEQ ID NO: 140547 - DNA, 601 bp, Human; identical to SEQ ID NO: 24592

SEQ ID NO: 140548 - DNA, 601 bp, Human; identical to SEQ ID NO: 24593

SEQ ID NO: 140549 - DNA, 601 bp, Human; identical to SEQ ID NO: 24594

SEQ ID NO: 140550 - DNA, 601 bp, Human; identical to SEQ ID NO: 24595

SEQ ID NO: 140551 - DNA, 601 bp, Human; identical to SEQ ID NO: 24596

SEQ ID NO: 140552 - DNA, 601 bp, Human; identical to SEQ ID NO: 24597

SEQ ID NO: 140553 - DNA, 601 bp, Human; identical to SEQ ID NO: 24598

SEQ ID NO: 140554 - DNA, 601 bp, Human; identical to SEQ ID NO: 24599

SEQ ID NO: 140555 - DNA, 601 bp, Human; identical to SEQ ID NO: 24600

SEQ ID NO: 140556 - DNA, 601 bp, Human; identical to SEQ ID NO: 24601

SEQ ID NO: 140557 - DNA, 601 bp, Human; identical to SEQ ID NO: 24602

SEQ ID NO: 140558 - DNA, 601 bp, Human; identical to SEQ ID NO: 24603

SEQ ID NO: 140559 - DNA, 601 bp, Human; identical to SEQ ID NO: 24604

SEQ ID NO: 140560 - DNA, 601 bp, Human; identical to SEQ ID NO: 24605

SEQ ID NO: 140561 - DNA, 601 bp, Human; identical to SEQ ID NO: 24606

SEQ ID NO: 140562 - DNA, 601 bp, Human; identical to SEQ ID NO: 24607

SEQ ID NO: 140563 - DNA, 601 bp, Human; identical to SEQ ID NO: 24608

SEQ ID NO: 140564 - DNA, 601 bp, Human; identical to SEQ ID NO: 24609

SEQ ID NO: 140565 - DNA, 601 bp, Human; identical to SEQ ID NO: 24610

SEQ ID NO: 140566 - DNA, 601 bp, Human; identical to SEQ ID NO: 24611

SEQ ID NO: 140567 - DNA, 601 bp, Human; identical to SEQ ID NO: 24612

SEQ ID NO: 140568 - DNA, 601 bp, Human; identical to SEQ ID NO: 24613

SEQ ID NO: 140569 - DNA, 601 bp, Human; identical to SEQ ID NO: 24614

SEQ ID NO: 140570 - DNA, 601 bp, Human; identical to SEQ ID NO: 24615

SEQ ID NO: 140571 - DNA, 601 bp, Human; identical to SEQ ID NO: 24616

SEQ ID NO: 140572 - DNA, 601 bp, Human; identical to SEQ ID NO: 24617

SEQ ID NO: 140573 - DNA, 601 bp, Human; identical to SEQ ID NO: 24618

SEQ ID NO: 140574 - DNA, 601 bp, Human; identical to SEQ ID NO: 24619

SEQ ID NO: 140575 - DNA, 601 bp, Human; identical to SEQ ID NO: 24620

SEQ ID NO: 140576 - DNA, 601 bp, Human; identical to SEQ ID NO: 24621

SEQ ID NO: 140577 - DNA, 601 bp, Human; identical to SEQ ID NO: 24622

SEQ ID NO: 140578 - DNA, 601 bp, Human
aatacttaagtgtttcctaaaactttaaaatatgactagataatccattcataaatagcctgtaagaagggctctcctgaaagaaaattctatggcctcatttggaaagccactccaatgatggcaacactcttaggaaggtcttgctgtaaaacatcattcctttctaatttgggccagttcttgagtttcatccccaatgaagagtgagaacacttcatcacatttccaaagaaagcctttgtgtgtactttgaagatcatttctgggtcactcctagctttctttcctttcagcggcraagtacttcatcttctcacctttcctcaaagaagccatttatttgctccctggattcattccaaaacctccatccctcctaaatggtggaagccagaaatcttgtagaccagaaacaaggtcaaagattcctgaggggcttcatgagcagtcctcagagtggaagcaggctctctttctcagtctgcttgttttccagccaattcaaatgttcatgtgtgtgcatgcacacatatgtgcatatatagtctcagaaacactgaaactttttaacaagctcaaagaacaaatattgtcttat

SEQ ID NO: 140579 - DNA, 601 bp, Human
ttcattgaattattgtaacgatcatctgattagcataccttaaaaaatacgaggttccttgttccaaggtagatggttccaacaatggctgcaaccatatcttccattccatatgctctttttttttaatgaaatattattatacattattctgtaacttacttttttcacttgaatgcatttcaaatgaatgtcttaaatgcatttccatatcattacacgcagggtggctttatttttttctttaatggctgaatagtactctgtagtataatatatagtagtccacccttaaccgtgrgggatacattccaagaccccagtggatgcctggaactacagatagtaacaaaccatatatacatttacatatatatacatatatatatataatgttttttcctatacatatatacctaagatgaagtctaatttgtaaattaggcacagtaagagattaataacaactaataataaaacagaacaatgttaacaatatgtcataataaaagttatatgaaatgtagtctctttctcattctcaaaatagctactgtactgtactcacctacattcagacctcagttgaccgcaggtaact

SEQ ID NO: 140580 - DNA, 601 bp, Human
ggaactggtagaagactggagggtggaaggaataatcctacaagaagctaaccaagcaaacaaaaattccatccatgatagaattgggaagaaaccacagtctctaaattcttcaactgatgctatggttcttcacagcaaccacgcagattcagaacgtttccaggatctgagaggaataagctccatatgtccttgcatgtatccacacctgtgtgagtttgtgtgtttggcttgtttattcagggataaagtggattgtggtgaaaaaaacagtagagtctgagccaggatcccttgygtctgttctaccattatctattggtatgacctttatgtccttgggcctatgttttattcatctgaaaaaagagactgaagtattttctttctgcaatctcttcctgttctaaaattctgtgattctaagtttatggataaattttgcatatatacatgcctgtaggcatatgattattcttagagctatgcgcaaagcatataccttctgttgatgaatttgcatttcatcagagaaacatatctataactggtgctcaaattataaccccaagaatttgtttgccaacttgttttattc

SEQ ID NO: 140581 - DNA, 601 bp, Human
agcaaggaaggtctacttacagagcaagtaaaaacttccaactttgcagatgaaaatgattcaatactgtctaccatgcagctaaaatataaaaatggttgtgccccagcttagccaacatggtgaaacctggtctctactaaaaatacaaaaattagccagatgcggtggcatgcacctgtagtcccagctacttgggaggctgaggcaggaccagcctcccaagaacccaggaggcagagcttgcagtgagccgagattgtaccactgcactccagcctgggcaagagtgagactcctyctcaaacaaaaataaacataaacgtaactggttgtgcccctccttggctgtttccctcagatccactcctcccactccgctgctctactttccatctcagagggccactgcctgcagcttgtttcccagaatcccaggtcagtgggcttccagagaggctcagccaatgggaggaactggtagaagactggagggtggaaggaataatcctacaagaagctaaccaagcaaacaaaaattccatccatgatagaattgggaagaaaccacagtctctaaattcttcaactgatgctatgg

SEQ ID NO: 140582 - DNA, 601 bp, Human
tgccttttgtttaaaccttgtttgaaagggcagtctctgcttccttaatatccagggttgaccctgtctggggcagcaggtggagcaattaaggggagagggccaaagccaaagtcattttcagcttacatttccacacagcttcctataattttctagaaaaattaaaacttgaagatgggcgcagtggctcatgcctataatcccagcactttgggaggccgaggcgggcggatcacctgagctcaggagttcgagaccagcctgaccaacatggtcttgtctaaaaatacaaaattasccaggcgtggtgacacatgcctgtaatcccagctacttgggaggctgaggcaggagaattgcttgaacctgggaggcagaggttgcagtgagccaagatcgcgccactgcactccagcctgggcaacaacagcaaaactccatctcaaaaaaaaaaaagaaaaaaagaaagataaaaacttgaatcagaacttacctaagtttcaataaaattgtaccattctaaaactaaaggataaatatttattctacagaaatgaaatttagggttgggcatgatggctcacacctgtaatcctag

SEQ ID NO: 140583 - DNA, 601 bp, Human
aaaaaagccaggcttggtagtgcacacctgtagtcccagctacttgtaggctgaggtgggaggatcccgtgagcacaggaggttgaggctgcagggaacacgaccctgtctcaaaaagaaaaaaagaaagacagaaagcagaggccaaacacagagggtcactgagcagaatgggacctgcatgccccactctccacatgtctgtagagtcttcatgaatgtgagtgagttgcaagctgttcaccctggttaggatttatgctttattctgagtcagagcttcagaaatgagaccaaaaaygggccaagctttgaggaagatgagtatggacaatgccaagaccacacccagaaaagatgggtcagacccagatttgagtggccaaaggaaggccattaaatagcattgccttttgtttaaaccttgtttgaaagggcagtctctgcttccttaatatccagggttgaccctgtctggggcagcaggtggagcaattaaggggagagggccaaagccaaagtcattttcagcttacatttccacacagcttcctataattttctagaaaaattaaaacttgaagatgggcgcagtggctca

SEQ ID NO: 140584 - DNA, 601 bp, Human
aaagccaagcgcagtggctcatgcctgtaatcccaacactttgggaggctgaggtgaaaggactgcttgagcccagcagtttgagaccagcctgggcaatatggtgagaccccatttctactaaaagtaaaaaaaaagaaaaaaaaagccaggcttggtagtgcacacctgtagtcccagctacttgtaggctgaggtgggaggatcccgtgagcacaggaggttgaggctgcagggaacacgaccctgtctcaaaaagaaaaaaagaaagacagaaagcagaggccaaacacagagggtyactgagcagaatgggacctgcatgccccactctccacatgtctgtagagtcttcatgaatgtgagtgagttgcaagctgttcaccctggttaggatttatgctttattctgagtcagagcttcagaaatgagaccaaaaatgggccaagctttgaggaagatgagtatggacaatgccaagaccacacccagaaaagatgggtcagacccagatttgagtggccaaaggaaggccattaaatagcattgccttttgtttaaaccttgtttgaaagggcagtctctgcttccttaatatcc

SEQ ID NO: 140585 - DNA, 601 bp, Human
ggaagacaagaagtccagggtcaggggtttgatttccatgcaggttaaagagttttgtggccgggcgcggtggctcacgcctataatcccaacactttaggaggctgaggtgggcggatcacctgagattgggagttcgagaccagcctgaccaacatggagaaacccacatctctactaaaaaatacaaaattagccgggcatgctggcacatgcctgtaatcccagctactcgggaggctgaggcaggagaattgcttgaactggggaaatggaggttgcggtgagccaagattgcacygttgcacttcagcctgggcaacaagagcaagactctaactgaaaaaataaaaaaaaaaaggctaggcacggtggctcatgcctataatcccagcacttcgggaggccaaggcctgatcacctaggaattcaagaccagcctggtggtttcatcaacatggtgaaaccccttctctactaaaaatacaaaaattagccaggcatggtggcacgtacctgtaatcccagctacttggcaggctgaggcaggagaatcgcttgaacctgggaggcggaggttgcggtgagctgagattgtgca

SEQ ID NO: 140586 - DNA, 601 bp, Human
tagatatagtttaattttcattttgcatgagcaagagaaatatgtatattgtaataaagtaaatgaatacgacaatcaatactacatgaaaaacagagccttccctatcagagtcctcaacaaagaaacagaaagaataaaacacatcctcaaactaaatcacccctcaagctttctgaaattagcaaagaatgtttgcagctgacctatttctctcccacacaactgtgttgataattgacttttgtcccccagggaagtactcaaatataattgagaagcacctgccacatagagagtrcagttttatatacctaataattcccttaaatattgtatttagcttggaactcaagcactccgctttctccttaattgtatttctcaagaaggaaatgttataattaccaaagcagagttactatgaacatctagacaaactaaaggaagcattttgaattgtaagtacccaagatatttctattactagaaattattgaaaacgatgacaataaccatttctattgttcatatacttttctttaatcctgtcgatcacatcctattataaaaaccacccccctctatagatgggagccac

SEQ ID NO: 140587 - DNA, 601 bp, Human
ggtagccaatttgtgctggctttctgtttgcttgcaatgaaaagattcttatcagatacacttcaagaataaagtttgaaatagaccaagtttgatcctcatccacttccctttctgaaagcatcttccacaagtcactctctttctgcccaggcaccagtgccctcctctgtcccaaggatcccattccgatatcctactcaggcctgcactaactttgaaaacgcttcaggccctgacatcaccttctcctttcctcctcctccttttactccctgctccacctccaccacaagtacawatgcataaaacaaaaatattttaaatatataaattactgtgagtatggtgtaactgagcctaaaagaggacgaagagtttgtgtctacatcagttcgtgtgggtcgacatgaatgagtacaaaagtcactgctagaagcaggttttaggtgcagttcggggcagaggctgaatgatgtctgttccccacagagagatgcaggtcatgctgcagaagctggctttacaaaagaatctgggagacactgggcacaagaagagtcactcgaggacccaggggacacagagtgacccagagttg

SEQ ID NO: 140588 - DNA, 601 bp, Human
gctcccagattagtccacaaaatcctatttaggatagatggtggtgatgttggtaggcacgaccatgtgaatgtacttaaatgtcactgaactgtacactaaaaaatggtaaagatggtaaattttctgttatatttattttaccacacttaaaacaatatctaactcatgaagtgactgaaagttgtggtaccagaggaaggaggagcagaaggaagaagttcccatgatcctgcctgggtccaaaattcccttaggaaactgccctccccaatctcagccactgtggggctgacctcartctcatctctaggtagccaactgctgccttaagacagtccccctggccatagtgttggtttatgagccatttcagttcaatgagattcaagaaatgtgtatatgtatgtgtgtgtatgcatatgtgtgtacacatgcacacaagcacgtgtacacatgtgtgtgtgtgctgccagggacagtatttaaagccccattagctgcaaaaagaaagcaagcaaggaaagcaaggaaggaaggaaggaagggaggaaggaagggagggagggaaggagggaaggagggaggaaagaaggcacct

SEQ ID NO: 140589 - DNA, 601 bp, Human
cactgtttagtcagttatttgaaacttgctacatattttcccattaaaataaattgttacaacagaaagctaggctcccagattagtccacaaaatcctatttaggatagatggtggtgatgttggtaggcacgaccatgtgaatgtacttaaatgtcactgaactgtacactaaaaaatggtaaagatggtaaattttctgttatatttattttaccacacttaaaacaatatctaactcatgaagtgactgaaagttgtggtaccagaggaaggaggagcagaaggaagaagttcccaygatcctgcctgggtccaaaattcccttaggaaactgccctccccaatctcagccactgtggggctgacctcaatctcatctctaggtagccaactgctgccttaagacagtccccctggccatagtgttggtttatgagccatttcagttcaatgagattcaagaaatgtgtatatgtatgtgtgtgtatgcatatgtgtgtacacatgcacacaagcacgtgtacacatgtgtgtgtgtgctgccagggacagtatttaaagccccattagctgcaaaaagaaagcaagcaaggaaagc

SEQ ID NO: 140590 - DNA, 601 bp, Human
ggttgcagtaagccaagatcgcgccactgcactccagcctgggcgacagagcaagactctgtttttaaacaaacaaacaaaaaaatacaaaaatgagtcacacgtggtggtgcacacctgtagtcccagctactcgggaggctggaggcaggagaaacgcctgaacctgagaggcggagattgcagtgagccaagattgtgccattgcattctagcctgggcgacagagggacactccctctcaaaaaaagaacataaagaaaacccgagactgagaggagaagggttagtaagctgaaamacgaagatgaagtaagagagtctgacaggagttatatcactgcagagccttggaggccacaataatgaatctagattatattttaaacccaactgaaatccattagagggttttaaaacagaaaaatggcctgatctgatttcctttttaaaaagataactctggcagctgcgtagagaatggacctgctggcatatggacagagggagattctttcagtaggtcagaagagagacggcggtggcgcaagctgagaactagggcagcaggaggagcgatggagggaggtggctgggcttg

SEQ ID NO: 140591 - DNA, 601 bp, Human
tatgcaatcatgaagaaaaggagttaagagtcaccagaaaaagcaacagaagggagagcattccaggtggagaccagccaacctgaaggacacgggcagtgtggactcactgttgctggctctgctgactttcccacgtttgacttggcctgagagcctcaggtctggtcagctgagccatacacccctcagccacacacacagactcctgctaagcctagccttgccctgcctccagctcaaattccagagcccaataagtctttgcctcctgaggaggtctgggactaaaagatctcawctacaggaactcaggcatcgaatactgggccccagaccaaagcatcagccaccagaagattaagagctgaggccaaagtcagtgctgcccacagtctccctggatgctctctattagggtggaaactgtcctgaagcaggtcaaggatgaggcatccaaacaaaacgagagtaaaatatttgctcacctgcatttcaccaaactgtagctaatatccctgaaatcctgtcacctaattcagtgtgtggggtatgcattttgtcataaggtctttttgcaaagtagattaggaaggaactt

SEQ ID NO: 140592 - DNA, 601 bp, Human
cattatcatccttatttcacattattacttgcctaaggtcacacaaatagaaagtgatagaacatggactcagtccattcacctgatgccacaactgattccatcaacagctctgctggtgttgcttctgaagaaaattaagtcacaaccaagtccttgggaggttcactgtcaatgggagagagacctgtaaacatatcactgcaaaacaatgtgagagttactctgagcgtattaagggaggaagaaacaaatcctgcccaggagtgtcagatgaggctgtacagaggctgtgacatayatgcaatcatgaagaaaaggagttaagagtcaccagaaaaagcaacagaagggagagcattccaggtggagaccagccaacctgaaggacacgggcagtgtggactcactgttgctggctctgctgactttcccacgtttgacttggcctgagagcctcaggtctggtcagctgagccatacacccctcagccacacacacagactcctgctaagcctagccttgccctgcctccagctcaaattccagagcccaataagtctttgcctcctgaggaggtctgggactaaaagatctcat

SEQ ID NO: 140593 - DNA, 601 bp, Human
gccatcaccagtattaccatcatcactctaggatgttcccccaacaaacagagaaacgggcagaggctttaaaatgtcagacttcccaccagtctctgaaagtggaaggcaaataccgatacatattatggccaccaccctgcttgaaaagaagagctacagtgagatgtgtttttaaatagaataatttgcatccaatatctatatatattatttcatttttcaaaattctgacaccatcctacaaggcaggcattatcatccttatttcacattattacttgcctaaggtcacacaaayagaaagtgatagaacatggactcagtccattcacctgatgccacaactgattccatcaacagctctgctggtgttgcttctgaagaaaattaagtcacaaccaagtccttgggaggttcactgtcaatgggagagagacctgtaaacatatcactgcaaaacaatgtgagagttactctgagcgtattaagggaggaagaaacaaatcctgcccaggagtgtcagatgaggctgtacagaggctgtgacatatatgcaatcatgaagaaaaggagttaagagtcaccagaaaaagcaaca

SEQ ID NO: 140594 - DNA, 601 bp, Human
atcttcatcatcaccacccctgccctgacacccaggaccatcaacagcaccatcataaccactaatatcaccatgatcaccacaaccaccctcactgccatcaccagtattaccatcatcactctaggatgttcccccaacaaacagagaaacgggcagaggctttaaaatgtcagacttcccaccagtctctgaaagtggaaggcaaataccgatacatattatggccaccaccctgcttgaaaagaagagctacagtgagatgtgtttttaaatagaataatttgcatccaatatctayatatattatttcatttttcaaaattctgacaccatcctacaaggcaggcattatcatccttatttcacattattacttgcctaaggtcacacaaatagaaagtgatagaacatggactcagtccattcacctgatgccacaactgattccatcaacagctctgctggtgttgcttctgaagaaaattaagtcacaaccaagtccttgggaggttcactgtcaatgggagagagacctgtaaacatatcactgcaaaacaatgtgagagttactctgagcgtattaagggaggaagaaaca

SEQ ID NO: 140595 - DNA, 601 bp, Human
ccatcaccatcctacagtcaccactattgccccatcttcatcatcaccacccctgccctgacacccaggaccatcaacagcaccatcataaccactaatatcaccatgatcaccacaaccaccctcactgccatcaccagtattaccatcatcactctaggatgttcccccaacaaacagagaaacgggcagaggctttaaaatgtcagacttcccaccagtctctgaaagtggaaggcaaataccgatacatattatggccaccaccctgcttgaaaagaagagctacagtgagatgtgyttttaaatagaataatttgcatccaatatctatatatattatttcatttttcaaaattctgacaccatcctacaaggcaggcattatcatccttatttcacattattacttgcctaaggtcacacaaatagaaagtgatagaacatggactcagtccattcacctgatgccacaactgattccatcaacagctctgctggtgttgcttctgaagaaaattaagtcacaaccaagtccttgggaggttcactgtcaatgggagagagacctgtaaacatatcactgcaaaacaatgtgaga

SEQ ID NO: 140596 - DNA, 601 bp, Human
actgtcaccacagcataatcactactaccgtccccaccctcctctccaccatcaccatcaccccctcaccattaccacctctaccatcaccatcaccccctcaccattaccacctctaccatcaccatcaccccctcaccattaccacctctatcatcaccatcaccttcacctccacccaacccttaccaagcaccatcaccatcctacagtcaccactattgccccatcttcatcatcaccacccctgccctgacacccaggaccatcaacagcaccatcataaccactaatatcaccrtgatcaccacaaccaccctcactgccatcaccagtattaccatcatcactctaggatgttcccccaacaaacagagaaacgggcagaggctttaaaatgtcagacttcccaccagtctctgaaagtggaaggcaaataccgatacatattatggccaccaccctgcttgaaaagaagagctacagtgagatgtgtttttaaatagaataatttgcatccaatatctatatatattatttcatttttcaaaattctgacaccatcctacaaggcaggcattatcatccttatttcacatta

SEQ ID NO: 140597 - DNA, 601 bp, Human
aaatgcaatcctctagcattaaacgctcttatttgacaacaatgcaacggcctcatctaatgaggaaatgtccctagcttctaggtgaaaagcagtgatgtaggaccagaagaggcaggactgtaagaggcaggggataggggcaggcaggataggatgctgtgctggatccaaagctattgtccagggtcaaaggctgagaatcagctgaagagtcctaggtaagcccatgtgaaggggactgagttcagaataaggcaggcaggcaggggaggaatggcaaaacaaaagaaaacaatgytatgcagtcatcactccaggaggctatgaatcccaacaggcaggctgagcaacagaggtgaggaacccagggtaagaaccaccaacactaccaccatcaccaccaccatcgttgccatctccaccacagctaccatcagcacccccccatttataccaataccaccatcaccattaccaacatcaccaccatcaccgctttaccaccatcgccgccaccagcaccctcaccactaccatcatggcataatcactactaccattcccaccctcctctccgccatcaccaacatcaccatca

SEQ ID NO: 140598 - DNA, 601 bp, Human
gtcatccaaggtccaaacacatctccctctccaaccctcacccatcaccccatgccaaattcaatatacctagaagcatcctcctctttgaagtgaatgctttagctcaatgccattcgcctgtgtagtaaactggcaatcgtgctttgctatgtttacatgagaatttagccaccacccccagattctagtgccatccccaaggctggcataagttagcataagaatgggatgattatgaattggaacaagcagagattgctaagtatttaaataaacaggttaagtaatgttaagggaytggaaaacagtgcaggataatgaaaacaatctacaaaaataattaaaaatacattttaaaaatggaacaaaagagataatggtgggcagatttgtcaatctgctttcactcttaaaagaaagtccattctccactgccagctgtgttctccaagagcagggctctcagaacttggagcattcccttcaataacaaatgcaatcctctagcattaaacgctcttatttgacaacaatgcaacggcctcatctaatgaggaaatgtccctagcttctaggtgaaaagcagtgatgtaggacc

SEQ ID NO: 140599 - DNA, 601 bp, Human
tttcagggagcaatatatcacaaatggcatcaggaagaaatctatatagatttacttgtgcagttggcagagagaataaggtccaggagagcagacggaagtcagctatcagcaaactgaaacatctcaaatccagcataatgatttccttattgaagggagccagtcgagaaggaaagaccatcttccttgtcatccaaggtccaaacacatctccctctccaaccctcacccatcaccccatgccaaattcaatatacctagaagcatcctcctctttgaagtgaatgctttagctcartgccattcgcctgtgtagtaaactggcaatcgtgctttgctatgtttacatgagaatttagccaccacccccagattctagtgccatccccaaggctggcataagttagcataagaatgggatgattatgaattggaacaagcagagattgctaagtatttaaataaacaggttaagtaatgttaagggattggaaaacagtgcaggataatgaaaacaatctacaaaaataattaaaaatacattttaaaaatggaacaaaagagataatggtgggcagatttgtcaatctgctttcac

SEQ ID NO: 140600 - DNA, 601 bp, Human
tgtatttttattagagacagggtttcaccgtgttagccaggatggtctcgatctcctgacctcgtgatccgcccgtcttggcctcccaaagtgctgggattacaggcgtgagccaccacgcctggccaacttcatcaatatttacagctaaacaagcaagaatatgtcatgacttcacaaaaataaacatttaaaagtcaatccaaaaataagaattgatttttctgtgggaggtacaaaccacactgtatcaagaacagggcacttcttaggaaaatgcaagaattttagcaaaccaaayatacccgtctctttaaaatatcttttcatgctttattagtgtacttgccttagagaatcatttatgtattagctggtttggggttgtaattctttatgcatatcaaagatactagaacccaatcaagtcaacatgggctgtggccccatgaagtcatacatgctttttttatagttggcaaaaacactacacttaacacaaaaatgggtgttcacggaaaccacacaagaagaagacaggcttggttttgtctttcacatcgataatgaaataatgcaatgcactattactatgctgttg

SEQ ID NO: 140601 - DNA, 601 bp, Human
gcatgtcagccccaaggcagacagttctgagatatattttatatggctcctcaaaagtgcctgagatcaagtacccagtattctcagcagtggtcagtttgataatgtattcttttttgttttttatagagatgtgtgtgtgtgtgggggggggtgcctctcactgtgttgcccaggctggtcttgaactcctggactcaagcaatcctcccacctcagcttcccaaagtgctgagattacaggtatgagccaatgtgcccagcctgataatgtattcttgtactggctttttctccttcycttttctcttcctaggtcctttactccaattgggatctcatcccaaataaactacctgaatgcaagcaattatctcaggatctgtttttgcagggacttgagctataaaggcaagtggccttagaaagcagcccctctggatcatggagctagatcacccgccctattgctggtggtaagtaggatagcaatcatcgcaggcatacagtagcatcacatctactaaaactcttacctgtggtgaactgggatgaggtacatatggaaagggaaataatgaattaagtggtagttgtggta

SEQ ID NO: 140602 - DNA, 601 bp, Human
aaacccagaatagttccaactttaagagaagttagcactttgggagaccgaggtgggcagatcatttgaggtcaggagttcgataccagcctagctaacatggtgaaaccctgtctctactaacaataccaaaaattagctgggtgtggtgatgcacgcctataatcccaactactcgggaggctgaggcaggagaatcacttgaacccggagccagaggttgcagtgagccaagattgtgccactgcactccaacctgggtggcagagcaagactccatctcaaaagaaaaaaaaaaaaagagagagagagaagttacatgctttttccccagggaacttcacttagggcttggttagatctgctaaagtcacatggatcacccccgcccactgaagtatgagggaaagaaagagtgctgggaagaaaaggttttagcaatgtgctactttgactaggtcttgaaggacttcacacaggacaaattcaggctcttggctatagtgtttaactttcctacattctacttggaaagtaacagcaagcagaaatttacttacatcattgattctctctcttctacactctccacttgtccttt

SEQ ID NO: 140603 - DNA, 601 bp, Human
ccggccctataatgtactttaaagtagtacatacatatgttcttcaaataataaatacaggtaagaaagaaaacagactttttcataattatcacctaagacagttacccaaaaactggtatcaaaatatatccgggcaaagaaactagaccataaaatctaagaaattctgtctagattgtcataaaatccaagaaatcctctccacctgtcatagagagaaactagacccccaatattaaatccagagaagcttgacccttgagttcacaatcagctgctacacagcagcgctcctatraaacttcaagaccagcagaaggaatggctctttagggcaaggactgattcttattcacctttccatgcatactcttgcttgtgtggtaaatgtgatttacttgcatgtctgtcccccaacccaaacccagaatagttccaactttaagagaagttagcactttgggagaccgaggtgggcagatcatttgaggtcaggagttcgataccagcctagctaacatggtgaaaccctgtctctactaacaataccaaaaattagctgggtgtggtgatgcacgcctataatcccaactactcg

SEQ ID NO: 140604 - DNA, 601 bp, Human
cattatgcagataaagaaactgaggcagagagtgattaatgtgcccagggtcccacagttagaaaacagcagagtcagaacctgaacccaggcaatcttgctctagaggctgtttggaaaatcacactgcaccaagccagctccagcctgtgcatgcaatcaagctcctggggttctcagcaaataaaccaggtaaacagcactcctcacagattgaggtttgaagagttttctgcacattacataatttcaagaagcctgtgttaatattaacacttgcaaaatttagaccaaagcaaayaacttaaattctacagaagacacataagtaatataagtgagtgaagcacactggctgtgaggcggggggcagggttaatgaggaccaagagggcagatgcctacctaaaagaggcagccacccatcagctccgaatgtcttcctagaagaatgaaaagccagttttgccattcctcacaatttttccagaaaagttgaaaattcagactcgtgtacaaaatcccccaactttcaaatcttggcagtcattcaaaattatttttttctgaatgatgagccaaacaaaacctatctgccaac

SEQ ID NO: 140605 - DNA, 601 bp, Human
tgcttactatgtgccaagcaatgttattagcctgttattttacatctattcatttattagctccattatgcagataaagaaactgaggcagagagtgattaatgtgcccagggtcccacagttagaaaacagcagagtcagaacctgaacccaggcaatcttgctctagaggctgtttggaaaatcacactgcaccaagccagctccagcctgtgcatgcaatcaagctcctggggttctcagcaaataaaccaggtaaacagcactcctcacagattgaggtttgaagagttttctgcayattacataatttcaagaagcctgtgttaatattaacacttgcaaaatttagaccaaagcaaacaacttaaattctacagaagacacataagtaatataagtgagtgaagcacactggctgtgaggcggggggcagggttaatgaggaccaagagggcagatgcctacctaaaagaggcagccacccatcagctccgaatgtcttcctagaagaatgaaaagccagttttgccattcctcacaatttttccagaaaagttgaaaattcagactcgtgtacaaaatcccccaactttcaaat

SEQ ID NO: 140606 - DNA, 601 bp, Human
agaaaaaaaaactagctagagagtttaggaaaaacagtattcaggcagcaaagactgtgaacatcccctcagccagaggccagtccagtcacaccactgagttgacaccgccattgagttgagaccaacacttcactgaccactcttctaaatcattttatttcatttttgatccagtctctctatgtactgtgtcagttgcataaggatagttgctttaaaccaccagaacaaagaaatttccagaaaaacagcacttctgacagatacatgcattcctaaagcaagccaagggggtacrtacacagaatgggcaagatctctgtggctaagccaaactggaaaccacctagacctaatcacctccccatctcaatagtggaagcagctcttcacggagcactgaacgtggaacggctctctttccaccagctttggagcagctcctggcctctcccatcatggcaagacagagcctttgccaatgacagacgggaagcatttggcagaggacacgggaggagagggaacttccttaaagtctggctttgcacagacctgtgtaatgccaaattaggaaggaaacagagcagaagacaag

SEQ ID NO: 140607 - DNA, 601 bp, Human
tcaaggaaaactactgctctgataaatccaatgttatagcatgctatgaggctcaaaatgtatcaaggactgtaaaaaagcatacaatctacattattagctattccacaactcatgtcaaggggtgagggagcagtgtacattagattttcaacttagaaaacaactgcccaggaactccaactctatacatttatcataagaaaataaaacatcagcatcaagaaaatataagatattggaaaaccaaatctccagcaacaggggcaagttaaatacatcacggtacatctacacatcrgattaacagtgatgaactagatcttattaactggaaaagatgtctacaatacagtcttatatgaaaatatcaaataacaaaacaatacataaatttttgtaaaaaaaagcattgtctatatctatgtgtgcatatacacagaaaatatgaaaagatgtaacaaaatgttaatatatagcagttgccatattataggtgatctttatacttttctgtgtttcacagatgttttgcaatgaacatatatttctttttaatcaaaaatatttaaaactggctgggcaagatagttcatgccta

SEQ ID NO: 140608 - DNA, 601 bp, Human
accatgtgaagaaggtcctcacttccccttcaccttctgccatgtttgtaagtttcctgaggcctcccaagacatgtggaactgtgagtcaattaaacctctttcctttataaattacccagtcttgggtgtttctttatagcagtgtgaaaatggactaatacaatgttatataattaattgcttacacatctatctcccacactagactgtttttcaaggaaaatgacttgagttttattcatctttatagcctttggtgtgtagtaaaaagttaatcaacagttgggattcagtaaakgtttgctgaatgttgattcatttcataccattacattaaaagatttaaaattattaatgcattattaattcacaggagaaccactgctgagctacaagtaaaactatgctataatgaggtcttcagattttttaaattaagcatacctcctttgaataggttcaaggaaaactactgctctgataaatccaatgttatagcatgctatgaggctcaaaatgtatcaaggactgtaaaaaagcatacaatctacattattagctattccacaactcatgtcaaggggtgagggagcagtgt

SEQ ID NO: 140609 - DNA, 601 bp, Human
attggatcttgggggtggttcccccatgctgttctcatgatagtgagtgagttctcaccagatctgatggttttataaggggctcttccctcttcactcctcactcttttctctcctgccaccatgtgaagaaggtcctcacttccccttcaccttctgccatgtttgtaagtttcctgaggcctcccaagacatgtggaactgtgagtcaattaaacctctttcctttataaattacccagtcttgggtgtttctttatagcagtgtgaaaatggactaatacaatgttatataattaaytgcttacacatctatctcccacactagactgtttttcaaggaaaatgacttgagttttattcatctttatagcctttggtgtgtagtaaaaagttaatcaacagttgggattcagtaaatgtttgctgaatgttgattcatttcataccattacattaaaagatttaaaattattaatgcattattaattcacaggagaaccactgctgagctacaagtaaaactatgctataatgaggtcttcagattttttaaattaagcatacctcctttgaataggttcaaggaaaactactgctc

SEQ ID NO: 140610 - DNA, 601 bp, Human
gtcaattaaacctctatcctttataaattacccagtctcaagtatttcttcacagcagtatgaaaacagactaatacagtaaattggtaccgcaaagaggggggtactgctataaagacacccaaaaatgtggaaacaactttggaactgggtaatgggcagaggttggaatagtttggagggctccgaagaagacaggaagatgtggaaagatttgaaacttcctagaaacttgttgaatggttttgacaaaatgctgatagtgatatgggcagtgaagtataggctgaggtggtctcasatgaagatgaagaatttattgggagctagagcaaaggtaactcttgctgtgctttagcaaagagactggcagcattttgcccctgtcctagagatctgtggaactttgaacttgagagagataatctgaaattggaacttatgtttaaaagggaagcagagcataaaagtttggaaaatttgcagcctgatgatgtggtagagaagaaaaacccattttctggggagaaattcaagctggatgcagaaattggcataagtaaccaggagtccagtgttaatatcaacagaatgtggaaaa

SEQ ID NO: 140611 - DNA, 601 bp, Human
tgctcctcactcttctctctcctgccaccatgtaaaaaaggtcctcactttccctttgccttcctccatgactgtaaagtttcctgaggcctcctcagccatgcagaactgtgagtcaattaaacctctatcctttataaattacccagtctcaagtatttcttcacagcagtatgaaaacagactaatacagtaaattggtaccgcaaagaggggggtactgctataaagacacccaaaaatgtggaaacaactttggaactgggtaatgggcagaggttggaatagtttggagggctcygaagaagacaggaagatgtggaaagatttgaaacttcctagaaacttgttgaatggttttgacaaaatgctgatagtgatatgggcagtgaagtataggctgaggtggtctcacatgaagatgaagaatttattgggagctagagcaaaggtaactcttgctgtgctttagcaaagagactggcagcattttgcccctgtcctagagatctgtggaactttgaacttgagagagataatctgaaattggaacttatgtttaaaagggaagcagagcataaaagtttggaaaatttgcagc

SEQ ID NO: 140612 - DNA, 601 bp, Human
ctcagtctctccctctcactccccttctattccatgacacccatttcaggttttaaaatatgtatatacatacacacatgcacacacagaggcatatgcacacgcacagatcttcagcagagactttgaattgaactgacccctgaaaagtcctaatgaggtacactgacaaagtcccattcttctctctagtctctgcctatggcaggcagagggaaggaaacttatttttccaaggacatactataatacaacttaccatgatgtttgatatggtttggctgtgtccccacccaaatcycatcttgaatcgtaatctgcataatccccatgtgtcatgggagggagctggtaggaggtgattagatcatggaggcagtttccttcatgctattctcatgataataagtgagttctcacaaggtctgatggttttataaagggctcttcccactttgctcctcactcttctctctcctgccaccatgtaaaaaaggtcctcactttccctttgccttcctccatgactgtaaagtttcctgaggcctcctcagccatgcagaactgtgagtcaattaaacctctatcctttataaattac

SEQ ID NO: 140613 - DNA, 601 bp, Human
caaaaatcctaaaagcacaaaactgaataccggacatttagtctgtaagaatcctttggccactagattgtattactcagtctctccctctcactccccttctattccatgacacccatttcaggttttaaaatatgtatatacatacacacatgcacacacagaggcatatgcacacgcacagatcttcagcagagactttgaattgaactgacccctgaaaagtcctaatgaggtacactgacaaagtcccattcttctctctagtctctgcctatggcaggcagagggaaggaaacttatttttccaaggacatactataatacaacttaccatgatgtttgatatggtttggctgtgtccccacccaaatctcatcttgaatcgtaatctgcataatccccatgtgtcatgggagggagctggtaggaggtgattagatcatggaggcagtttccttcatgctattctcatgataataagtgagttctcacaaggtctgatggttttataaagggctcttcccactttgctcctcactcttctctctcctgccaccatgtaaaaaaggtcctcactttccctttgccttcctccatg

SEQ ID NO: 140614 - DNA, 601 bp, Human
aaggcagatggatcacgaagtcaggagatcaagaccatcctggctaacacggtgaaaccccgtctctactaaaaatacaaaaaattagccaggcatggtggcagggcctgtagtcccagctacttgggaggctgaggcaggagaatggcatgaacccaggaggcagagcttgcagtgagccaagatcacgccactgcactccagcctgggtgacagagtgagactctgtctcaaaaaaaaaaaaaaagaaattagaaattttcagaaatatcgtgtccccaaatgctttgtcagtttatcygctacaattatctcccatgtttcacacactcaagcctcatcaactttctccaggtttactaaaaccactgcactactagaaactcctttgctctggaaggtaccttccttctgctgctcacacgggaagacctagacatgccaccccctagtgacgtcttcccagctttgctaggcaattaatagactctacctgtgtgtgatgcccttggcattttcttcatagttctattattattataacccagatggcaactggaatcatgctgctctttatgctccagttaccactgcttgcacc

SEQ ID NO: 140615 - DNA, 601 bp, Human
ccctgattctaagaagataattaagaagctattgccaagacaaataacttttttcggaggaactctaacctctgaaattttcaaactttgactactaaggaggaaggagacagaaactgggcaaagtgtgacaaagagcagtcaaggcacagcaagtgagtggcgaccgaagctcagtatgtttatatcctcactcgcctgttactatcatcacctcctcacatggtttctactcaccaccacgcccctgtgactacccaccacactgaagccagaaggaccatatttaaaaatctggttrtaccaattggttcatcaatacccgcaagattttttagaaattagatattttcggctgggcacggtggctcacccctgtaatcccagcactttaggaggccaaggcagatggatcacgaagtcaggagatcaagaccatcctggctaacacggtgaaaccccgtctctactaaaaatacaaaaaattagccaggcatggtggcagggcctgtagtcccagctacttgggaggctgaggcaggagaatggcatgaacccaggaggcagagcttgcagtgagccaagatcacgccactgcact

SEQ ID NO: 140616 - DNA, 601 bp, Human
ccacaggcaatgcaagacatgaatggatttgcacaccccactgagtcctgctgtgctctgattatcactttgattattactgaacactgcaaagtctagataaggcttttaagcttctggagcctttcagaattgttaattaatccttaaaatagctttgaaggctgatttcccccctgattctaagaagataattaagaagctattgccaagacaaataacttttttcggaggaactctaacctctgaaattttcaaactttgactactaaggaggaaggagacagaaactgggcaaagygtgacaaagagcagtcaaggcacagcaagtgagtggcgaccgaagctcagtatgtttatatcctcactcgcctgttactatcatcacctcctcacatggtttctactcaccaccacgcccctgtgactacccaccacactgaagccagaaggaccatatttaaaaatctggttataccaattggttcatcaatacccgcaagattttttagaaattagatattttcggctgggcacggtggctcacccctgtaatcccagcactttaggaggccaaggcagatggatcacgaagtcagga

SEQ ID NO: 140617 - DNA, 601 bp, Human
agataactctatacttaaccttttcagaaactgccaaacttttccatggtagttgcaccattttacattcctaccagcagtgtatgaggattccaatttccccatattcttgccaaaaattatctgtcttttttattatagccatcctagtgggtgtaaagtggcatgtcattgtggttttgaattgcatttcctcctggtgactaatgatacggagcacttttttttatgtgattattggccactggtatgtcttctttggacaaatgtctattcctatccattgcctatttttgaaacrtcttttctactgagtctaaaagttctttatatatcctagacacaagtcccttatcagatataagatttgcaaatatttcctcccagtctgtgggttgtcttcttttttgttttaagacagagccttgctctgtcacccaagctgcaatgcagtggcacgatctcagctcaccgtaaccgctgcctcccaggttcaagggattctcatggtctcagcctcccgaggtagctgggactataggcacatgccaccacacttggctaatttttgtatttttagtagagacagggtttcaccatg

SEQ ID NO: 140618 - DNA, 601 bp, Human
ggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcgtggtggcgcgcgcctgtagtcccagctacacgggaggctgaggcaggagaatggcgtgaacccgggaggcggagcttgcagtgagccgagatcgcgccactgcactccagcctgggcgacaaagcaaaactccgtctcaaaaaaaaaaaaaaaaaaaaatagtattgtgttgagtgactgtatgacagtagaggagaaaaattgtttattttttcttcagaccatattttacttatccactcatcaactgatgaccatttgggttgtttccttttttgtctattacgaataatgctgcaaaaaacattcttgtataggcttttgtgtggacacatgccttcatttatcttgcatatgtacctagtagtggacttgctgggtcataagataactctatacttaaccttttcagaaactgccaaacttttccatggtagttgcaccattttacattcctac

SEQ ID NO: 140619 - DNA, 601 bp, Human
attacaggcatgagccatcacacctggccctgctccagcaaattaactgaacccaaaatgagggtcatgggaatccctcagttagaagtataggtaacaatctattacttgcgattggcatctgaaactgggggagaggtgctgactgagccctcaacatgtgggatctgatcctgtcttcaagtagctagtgtcagaattgagtaaaattataggatacccagtttgcacctgctggaggattgtttggtgtgtggaaaaaaccctctacacttaagaagtattgtgttggccgggcgcsgtggctcacgcctgtaatcccagcactttgggaggccgagacgggcggatcacgaggtcaggagatcgagaccatcctggctaacacggtgaaaccccgtctctactaaaaatacaaaaattagccgggcgtggtggcgcgcgcctgtagtcccagctacacgggaggctgaggcaggagaatggcgtgaacccgggaggcggagcttgcagtgagccgagatcgcgccactgcactccagcctgggcgacaaagcaaaactccgtctcaaaaaaaaaaaaaaaaaaaaatagtattgtg

SEQ ID NO: 140620 - DNA, 601 bp, Human
ccaactcctgggctcaagcaatcctcctgcctcaccctcccaaaagtgctgggattacaggcatgagccatcacacctggccctgctccagcaaattaactgaacccaaaatgagggtcatgggaatccctcagttagaagtataggtaacaatctattacttgcgattggcatctgaaactgggggagaggtgctgactgagccctcaacatgtgggatctgatcctgtcttcaagtagctagtgtcagaattgagtaaaattataggatacccagtttgcacctgctggaggattgttyggtgtgtggaaaaaaccctctacacttaagaagtattgtgttggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcgtggtggcgcgcgcctgtagtcccagctacacgggaggctgaggcaggagaatggcgtgaacccgggaggcggagcttgcagtgagccgagatcgcgccactgcactccagcctggg

SEQ ID NO: 140621 - DNA, 601 bp, Human
ctctctctccctgaccttcttcaccataagaaggaagtaggtcaccagccacagccctagattctgtctccctataatatccgaatctacagaaagaaagaaaggctgtgttctaaagcatgaatcttccacatggagcagcaagggcttacacaggtgcccaggcgacaagctaacttcctcttttaggctatgaattgataaaccaataaaagaaaccattttattccttttagagcgttcaagttaagaccatgttggtttgactggtgactgtcattaacctacagtgaggaacttytactgagggccaaatgtgtcgacttgtctgcaaggcaactgcatctcaaccaaccagaccacagtatggagatgggacacccaaatgttttaatctggtctgcagaatcccagcatgggtcagtctgctgagtggatgtatcttggccaagctggcatttggcatgttgggtgaaagccccaggttttttgtgaaataccattatcacagctgccctggacagatgactttccaaagtgacatagtgtgctgggcccgctgcctgtcacgtaaagacgaggaaagaaagtttccgggttc

SEQ ID NO: 140622 - DNA, 601 bp, Human
ggacctggcctgcacccatgggatggaaactctgccctctagtccagccttgcagtccactggttataggaccttgggcaaatcatttaattttgctggatttctttttcttcagctgtaaagtgaaagagccaaatcttagcccttctctgaggttgcttctagatctaaagtactactattttagggaccaactgttggggagggtaaaagaaagaagagagcagatggaggcagaagaaccaaagaaagcactggaatactctcaggtgactgtatggtgtgcacaagagagggcatragctaggtttttaagagaaatatgcaagctccaggccattggtaacaatcaattgcaatttctaggataaagaaggaagaattcataagcggtagccttgtatgtttttcagcactccctatatctttacccatcataacttgttttcctgttcataccttgataccattctctcccccatttgcattctctcttttttttttttaaacttttttttgttttgagtctcactctgttgcccaggctggagtacagtggcacaatctcggctcactgcaacctccacctcccaggttcaag

SEQ ID NO: 140623 - DNA, 601 bp, Human
agcattcgctgctcaattctctgtttggcaccctgccacaaacgcctaactttctctccctgcaaatcctagtatcagtgtttggatttttgtgcatgctgggtgagaggactcaagttcagttgggtaacactgctgacatcgtggaccagatgactctttgttatggtgggctgtctgtgcattggagaatgtctgacagcatccctggtctctactcactagatgtactactcactagcaccccctagatgtaacaacaaaaaatgcctctagacattaccaaaagttccctggggggcaaaatcaccccagctgagaacccgtgggttaaagtgagattccaccctgctgcccactaccatcagaaacttctatctgaatgctcttcacccatccccacctgcgctattccagataacatgtgttacatccagaaggggccatcagcagacggccaggcagaatccaagggagaaagagaatctgtccaataggaaaccaactggcctccacttcatccccacactaaaagggagagaataaaaagtacctgcaacacttgtctcctgacgatgagagaagttggcagagctagcac

SEQ ID NO: 140624 - DNA, 601 bp, Human
aacaaaacatctcttgcttgtaagctattggagagttcaggtcttaagcattcgctgctcaattctctgtttggcaccctgccacaaacgcctaactttctctccctgcaaatcctagtatcagtgtttggatttttgtgcatgctgggtgagaggactcaagttcagttgggtaacactgctgacatcgtggaccagatgactctttgttatggtgggctgtctgtgcattggagaatgtctgacagcatccctggtctctactcactagatgtactactcactagcaccccctagatgyaacaacaaaaaatgcctctagacattaccaaaagttccctggggggcaaaatcaccccagctgagaacccgtgggttaaagtgagattccaccctgctgcccactaccatcagaaacttctatctgaatgctcttcacccatccccacctgcgctattccagataacatgtgttacatccagaaggggccatcagcagacggccaggcagaatccaagggagaaagagaatctgtccaataggaaaccaactggcctccacttcatccccacactaaaagggagagaataaaaagtacct

SEQ ID NO: 140625 - DNA, 601 bp, Human
caatagaattacaagaaaaaaatccaactaaattactgatgtaaaatatactaaaaacaaaacgtgcttctttctctgaagcatggagaatatctaagattacatcaaacacaaatgcacttcttttaaaacagattttatttatttttatttttattttatttttctgagacggagtcttgctctgtcgcccaggttggagtgcagtggagcaatcttggctcactgcaagctccgcctcccaggttcaagcaattctcctgcctcagtctcctgagtagctgggattacaggtgcgcaycaccatgcatggctgatttttgtattttagtagagatggggtttcaccatgttggtcaggctggtctggaactcctgaccttgtgatccgcctgcctcagcctcccaaagtgctgggattacaggcgtgagccaccgcacccggccttaaagcaaattattaaagggaaattttctatataaaatctacaacacagggtggagaaatcactattactcccaggtagggaatttatcaagcacatcctaataattaaaaacatttaaaggccacatacaaataaaaactacttaaaatgaa

SEQ ID NO: 140626 - DNA, 601 bp, Human
ccacctcaaattcctgggctcagggatcctcccaccttagcctccagaatggctgggactacaggcacacaccaccatacctgcataatttttaaaattttttgtagagatgaggtcttgccatctccaggctggtctcaaactcctggtctcaaatgatcctcctgcctcaacctcccaaagtgctgggattacacgtgtgagccaccgtgcttgtcccagttttttttaccttcacacttaaagtgagagggactatgtgcgtgtatacacgtatacatacatacatacacatatgtayacctactggggttctgtaacatatttgtggcaagatgtctcaaattcacttatttcttttgttaaataaattgactgatagaaaccacttttcaagtattaaattgctcaactgagcaacatcattcttcaaatgttaaactgttaaattgagagggcttcttttccaggcttcacaaacatttgattctatcagatttcagttaattaaaaaaaccaaaagagccgggcttgatggcacattcctatagtcccagttactcaggagactaaggtgagaggatcacttggggcaaggagt

SEQ ID NO: 140627 - DNA, 601 bp, Human
ggccatctgctgatagcagataatcattttaaaaaaagatcaaaaaaagaaaaatggcactttatatcttatgttcccccttctggctgaaagtgttgttaattttatttatttttatttttttagagatgttttcagacgcgtttgaaccagagcaactccatcttgaataggagctgcgtaaaataaggccgagacctactgggctgcattcccaggagattaaggcattcttagttacagggtaagataggaggtcggcacaagatacaggtcacaaagaccttgctgataaaacagyatgcagtaacgaagccggctaaaacccaccaaaaccaagatggagaggagcgtgacctctgctcggtctcacagctcattatatgctaattacaatgcattagcgtgctaaaagacacacccaccagcaccacaacagtttacagatgccatggcaacgtcaggaagttaccctgtatggtctaaaaaaaggaggaaccttcagttcaagggaattgcccactcctttcccagaaaactcatgaataatccaccccttgttcagcatgtaatcaagaagtaacaataagtataagcagct

SEQ ID NO: 140628 - DNA, 601 bp, Human
acccaaatcaccggctaaatgtactacattatttactgctcatattgtgtggccatctgctgatagcagataatcattttaaaaaaagatcaaaaaaagaaaaatggcactttatatcttatgttcccccttctggctgaaagtgttgttaattttatttatttttatttttttagagatgttttcagacgcgtttgaaccagagcaactccatcttgaataggagctgcgtaaaataaggccgagacctactgggctgcattcccaggagattaaggcattcttagttacagggtaagayaggaggtcggcacaagatacaggtcacaaagaccttgctgataaaacagcatgcagtaacgaagccggctaaaacccaccaaaaccaagatggagaggagcgtgacctctgctcggtctcacagctcattatatgctaattacaatgcattagcgtgctaaaagacacacccaccagcaccacaacagtttacagatgccatggcaacgtcaggaagttaccctgtatggtctaaaaaaaggaggaaccttcagttcaagggaattgcccactcctttcccagaaaactcatgaataatc

SEQ ID NO: 140629 - DNA, 601 bp, Human
tcctacagacctggcaagctactcttggaagtcaggttgaagtcaaaacagctagactagcagtaccattgacccaaatcaccggctaaatgtactacattatttactgctcatattgtgtggccatctgctgatagcagataatcattttaaaaaaagatcaaaaaaagaaaaatggcactttatatcttatgttcccccttctggctgaaagtgttgttaattttatttatttttatttttttagagatgttttcagacgcgtttgaaccagagcaactccatcttgaataggagctgygtaaaataaggccgagacctactgggctgcattcccaggagattaaggcattcttagttacagggtaagataggaggtcggcacaagatacaggtcacaaagaccttgctgataaaacagcatgcagtaacgaagccggctaaaacccaccaaaaccaagatggagaggagcgtgacctctgctcggtctcacagctcattatatgctaattacaatgcattagcgtgctaaaagacacacccaccagcaccacaacagtttacagatgccatggcaacgtcaggaagttaccctgtatg

SEQ ID NO: 140630 - DNA, 601 bp, Human
gcaaggcctcaaacagcatcttgctcctcttcccgcataaccctaggaacgctttccaattccatttcctttcatccatctgctccctccccaggtctggttcttatatgtcgtagcttgccagggggttggaccatatttcttggagcctctacttcttcaggctcctgcttaacaaaggtctggacctttcgggcctctgaggatccctgagtgagtcctacagacctggcaagctactcttggaagtcaggttgaagtcaaaacagctagactagcagtaccattgacccaaatcacyggctaaatgtactacattatttactgctcatattgtgtggccatctgctgatagcagataatcattttaaaaaaagatcaaaaaaagaaaaatggcactttatatcttatgttcccccttctggctgaaagtgttgttaattttatttatttttatttttttagagatgttttcagacgcgtttgaaccagagcaactccatcttgaataggagctgcgtaaaataaggccgagacctactgggctgcattcccaggagattaaggcattcttagttacagggtaagataggaggtcggc

SEQ ID NO: 140631 - DNA, 601 bp, Human
tctgttcagtctgccacacttctagccaaacctcaccctaaatgcagagccagaatgggccatgctgggaaacaatactctatctccccagtgcctagggccaggtaaatgactctgtaagggactaagtcccagaagcttccaaactaattgctactaagcatggagagaaagccataatgccattttttaggttcccctactaactaatctagggtcaccagcaaggcctcaaacagcatcttgctcctcttcccgcataaccctaggaacgctttccaattccatttcctttcatccrtctgctccctccccaggtctggttcttatatgtcgtagcttgccagggggttggaccatatttcttggagcctctacttcttcaggctcctgcttaacaaaggtctggacctttcgggcctctgaggatccctgagtgagtcctacagacctggcaagctactcttggaagtcaggttgaagtcaaaacagctagactagcagtaccattgacccaaatcaccggctaaatgtactacattatttactgctcatattgtgtggccatctgctgatagcagataatcattttaaaaaaaga

SEQ ID NO: 140632 - DNA, 601 bp, Human
gattaacccctggctgatattttctgtgaaacaaattggtattttcaagacaatttcctagtgagaaaatgtccacataaacaaaattgcattttgatcaaatccccatgttggtcatcttggcaaagccctcaaagaccatggcaaaacagccacgactgcatcgcctgacctcagccttttgggccctttgggagcagactccccacactccatgggagaaacaccattaggccattaggatttcaacctcggataaagctcttcctcctgtttctccccacaaacttttggcactcartataatgattgtgagacactaagaaagacaaatgatttttctctctctcatttgctaatcccaaagtattactttattcccctttggaacttttcactgcagaatcctttgtgtatagagagatctgtgttcttaagctcaagaatctgtttaataaactatgaatttagaagtcatcatcatgttttagttgcataagctcagtacttatgggaaacatttctggaagaaggtaaagggcaatctgtaatgggggctataaatttctgtttaaatttgccacgagttattaaatccagt

SEQ ID NO: 140633 - DNA, 601 bp, Human
gttgacaaagattaaagtcacttaatggtcttaaggcaatgagtatactttatatccaaaaagaataagaattttaattccaccttctatttctacaaaaattgtactggctgataagtgatggcccccggttttcattgcggctaaatgggaatgtctcatttatgggctattctgaataaattagctgggagtttttttaagtatcaaaaataccaagaggtctaacccatatactagttaaaaagtagaattttatacatctgctgaatctgaaggctcatgattctcctatctcacwgtatttaactcctacattttataaagaattcaatgacatctagaatctttaaatttataaatatctatcattaaatctggctcagataataattgaaccaaagcatataatgccatgtctattcatgccctcacatttcactgatactttcttcagctaattaattttatttatctatttgtattattttattttatttattcatttatttttttgagacacagtcttgctctgtcacccaggctggagtgcagtggcacattctcggctcactgcaacctccgccccctgggttcaagt

SEQ ID NO: 140634 - DNA, 601 bp, Human
aacatgagtgatcactctgtgcatggcaggcaggcaaggcaagggagtagggtgggaccaagcactgatcacagaaatgcaggtattccttccaaccctggaaaagtagagcgaagctcagggaaaactacataagtcctcagaaacatagtcgaaggcatgaagtaagcactgaagcagaccatatggaaaataacatctatttttcaaaagaatttaaaatagagaatgcagaaaaaaagaagaagtttatggcaatatgattcttgtgtacaccgaagacataatttgttgacaaagrttaaagtcacttaatggtcttaaggcaatgagtatactttatatccaaaaagaataagaattttaattccaccttctatttctacaaaaattgtactggctgataagtgatggcccccggttttcattgcggctaaatgggaatgtctcatttatgggctattctgaataaattagctgggagtttttttaagtatcaaaaataccaagaggtctaacccatatactagttaaaaagtagaattttatacatctgctgaatctgaaggctcatgattctcctatctcacagtatttaact

SEQ ID NO: 140635 - DNA, 601 bp, Human
ggacactctggacaggaaatctccccctctcttcccagccctgtatgtccccaccccaagagggtgtgacacttcctcatgttccctgctggcccattggctagagctctggacggatatagaggaaagataatacagtaattcagaactgaggtcattgcttgcttagttaatatagggataattaaacagcatttaaagaaaatggtttagctgtataagcaaacatttccttgtatttaaaaaaaagcaagaaacatagttttctgaggtctctacttaagaatcttattattgggcygagcgcggtggctcacacctgtaatcccagcactctgggaggccgaggccgatggatcacgaggtcaggagttcaagaccagactggccaagatggtgaaaccccatctctactaaaaatacaaaaattagccaggtgtggtggtgggtgcctgtaatcctagctactcgggaggctgaggcagagaactgcttgaacccgggaggcggaggttgcagtgagctgagatctcgacactgcactccagcctgggcgacagagcaagactctgtctcaaaaaaaaaaaaaaagaatcttact

SEQ ID NO: 140636 - DNA, 601 bp, Human
gactcatggcatgtgagattgggaggagggtgaccagctgtggccacacagatggggacagaggccctgactggtgctaggacacgttagtggtggagagggacagttccctcaggccttccacctcccagcccaggacactctggacaggaaatctccccctctcttcccagccctgtatgtccccaccccaagagggtgtgacacttcctcatgttccctgctggcccattggctagagctctggacggatatagaggaaagataatacagtaattcagaactgaggtcattgcttgcktagttaatatagggataattaaacagcatttaaagaaaatggtttagctgtataagcaaacatttccttgtatttaaaaaaaagcaagaaacatagttttctgaggtctctacttaagaatcttattattgggccgagcgcggtggctcacacctgtaatcccagcactctgggaggccgaggccgatggatcacgaggtcaggagttcaagaccagactggccaagatggtgaaaccccatctctactaaaaatacaaaaattagccaggtgtggtggtgggtgcctgtaatcctagct

SEQ ID NO: 140637 - DNA, 601 bp, Human
tttcctctttccacaaaagacatggcaataaaagcaggacaggctgcaaactcagccattttcaaagactcatggcatgtgagattgggaggagggtgaccagctgtggccacacagatggggacagaggccctgactggtgctaggacacgttagtggtggagagggacagttccctcaggccttccacctcccagcccaggacactctggacaggaaatctccccctctcttcccagccctgtatgtccccaccccaagagggtgtgacacttcctcatgttccctgctggcccattgrctagagctctggacggatatagaggaaagataatacagtaattcagaactgaggtcattgcttgcttagttaatatagggataattaaacagcatttaaagaaaatggtttagctgtataagcaaacatttccttgtatttaaaaaaaagcaagaaacatagttttctgaggtctctacttaagaatcttattattgggccgagcgcggtggctcacacctgtaatcccagcactctgggaggccgaggccgatggatcacgaggtcaggagttcaagaccagactggccaagatggtga

SEQ ID NO: 140638 - DNA, 601 bp, Human
gctggctcgtataacagctcattaacagcagaggctgagacttccttttcctctttccacaaaagacatggcaataaaagcaggacaggctgcaaactcagccattttcaaagactcatggcatgtgagattgggaggagggtgaccagctgtggccacacagatggggacagaggccctgactggtgctaggacacgttagtggtggagagggacagttccctcaggccttccacctcccagcccaggacactctggacaggaaatctccccctctcttcccagccctgtatgtccccaycccaagagggtgtgacacttcctcatgttccctgctggcccattggctagagctctggacggatatagaggaaagataatacagtaattcagaactgaggtcattgcttgcttagttaatatagggataattaaacagcatttaaagaaaatggtttagctgtataagcaaacatttccttgtatttaaaaaaaagcaagaaacatagttttctgaggtctctacttaagaatcttattattgggccgagcgcggtggctcacacctgtaatcccagcactctgggaggccgaggccgat

SEQ ID NO: 140639 - DNA, 601 bp, Human
tgtgttcagcagagatgatgagcacctgggacacaggcttctacctcagcaccgagtctggctgggagatggaagaggataggtgtgcgtgagcagctggaggcacagaagaggaaaggcccactactctgctgcagcctgctggctcgtataacagctcattaacagcagaggctgagacttccttttcctctttccacaaaagacatggcaataaaagcaggacaggctgcaaactcagccattttcaaagactcatggcatgtgagattgggaggagggtgaccagctgtggccacayagatggggacagaggccctgactggtgctaggacacgttagtggtggagagggacagttccctcaggccttccacctcccagcccaggacactctggacaggaaatctccccctctcttcccagccctgtatgtccccaccccaagagggtgtgacacttcctcatgttccctgctggcccattggctagagctctggacggatatagaggaaagataatacagtaattcagaactgaggtcattgcttgcttagttaatatagggataattaaacagcatttaaagaaaatggtttagc

SEQ ID NO: 140640 - DNA, 601 bp, Human
gtgagccaagacctcagcaggcctgcagcactgctgctcccccctcatccttggagctgctcaccaactgctacagcagggagctggccgggccccagcctgcagtgaacacagagccaggctgcaacagctggatgcagaagggaaccacccccaaggaggccgtgacaaaacgcagggcccagggaatcttcagcattcatctggccaggaaaactggggaggatcagagggcccccaaagaaatgcatgtcaggaacctactgggatctaccatgctgtatttggaggcaggaggtgrgggtagctttcataaatcctgccaatggcaaagttcctaaattcttcaaagcatcaaggatgctggcctgcaatgggaatgcagaacaaaaagtcttgtaaagtaaggggttggtgagcttgtaattctggggtttggtaactctcacaccagagtgtgcacaagttgctgagaaccacgcaacagccctccccggccttttccaagttctgctgcttgcctttggcctaatgagccaaattcagactgtatatccccaatgcagcttctactgacagacaagggtttggcaagaagctg

SEQ ID NO: 140641 - DNA, 601 bp, Human
tattccatgaacaactgaataatgtgaccttctgactcccagtgagcctaaatttttctcattcttcttgcttagaccaaaagcacatatcccctctcaggtgaaggcacagcatttaggatgacactcttcttttcctaaggatgggagggagagaaagaaatgctctagggagacatggcctccctctgagacctaaagggaggagggaagatttttcttctcccatttggtcaaaagtcagccaggggagccaccgtgagccaagacctcagcaggcctgcagcactgctgctccccsctcatccttggagctgctcaccaactgctacagcagggagctggccgggccccagcctgcagtgaacacagagccaggctgcaacagctggatgcagaagggaaccacccccaaggaggccgtgacaaaacgcagggcccagggaatcttcagcattcatctggccaggaaaactggggaggatcagagggcccccaaagaaatgcatgtcaggaacctactgggatctaccatgctgtatttggaggcaggaggtgggggtagctttcataaatcctgccaatggcaaagttcctaaat

SEQ ID NO: 140642 - DNA, 601 bp, Human
cgtgccgttcttaaatctacttacaccctgcttctgcaaatgcttacgtatctgacttgttttaaggtatttcaaagccaaaagagaggcaagaaataaatgctcacacattttgaagtattccatgaacaactgaataatgtgaccttctgactcccagtgagcctaaatttttctcattcttcttgcttagaccaaaagcacatatcccctctcaggtgaaggcacagcatttaggatgacactcttcttttcctaaggatgggagggagagaaagaaatgctctagggagacatggcytccctctgagacctaaagggaggagggaagatttttcttctcccatttggtcaaaagtcagccaggggagccaccgtgagccaagacctcagcaggcctgcagcactgctgctcccccctcatccttggagctgctcaccaactgctacagcagggagctggccgggccccagcctgcagtgaacacagagccaggctgcaacagctggatgcagaagggaaccacccccaaggaggccgtgacaaaacgcagggcccagggaatcttcagcattcatctggccaggaaaactggggagg

SEQ ID NO: 140643 - DNA, 601 bp, Human
aattttttttaaagtgttaagtgtggtgaaaggcagatttcagtgaggatgtcgacctctagaagcagactttccagagtcttggaagtaatatttctgggttactttaggctactcagaccatgtttagagtattctgtcttattttggacacaacggccttggaccatggctggaggacatgtcagtcttggctatgccttctagtgtaacatagaacaagtatactctgccatgacatgagattccttcgaagagtttcacctgacaaatattaattgagaatcccaggaagtgcacyagatgctagaaagcagctatcatgaacttcagcttcaaaaaggcagtgaacctgagcagaactcttatttgggtgtttctatctccaaacgttcttgatggccttagccacaagatggcgcatgtagaccatttccacacttgcggctcaggccagttgattcttgcgggggcataggttcccaagcacttatgtagggtattcttccctgggcttctgttttgttaccttctcaatgagtgatgtctgagaagcttggtttggttagaaataatataatatcctgcttatctcctttga

SEQ ID NO: 140644 - DNA, 601 bp, Human
attacaggcgcgcgccaccatgcctggctaatttttgtactttaagtagagacaggatttcaccatgttggccaggctggtctcgaactcctgaccttaggtgatctgctctcctagacttccaaagtgctggaattataggcatgaaccactgtgcctggccagtaaattttatgttacatgttttttaccacattaattttttttaaagtgttaagtgtggtgaaaggcagatttcagtgaggatgtcgacctctagaagcagactttccagagtcttggaagtaatatttctgggttactttaggctactcagaccatgtttagagtattctgtcttattttggacacaacggccttggaccatggctggaggacatgtcagtcttggctatgccttctagtgtaacatagaacaagtatactctgccatgacatgagattccttcgaagagtttcacctgacaaatattaattgagaatcccaggaagtgcactagatgctagaaagcagctatcatgaacttcagcttcaaaaaggcagtgaacctgagcagaactcttatttgggtgtttctatctccaaacgttcttgatggcc

SEQ ID NO: 140645 - DNA, 601 bp, Human
tgctaaattttatgttttgttttgttttgagagtcttgctctgtctcccaggcaggagggcagtggcagaatcttggctcactgcaacctctgctttccaggttcaagcaatgctcttgcctccgcctcccaagtagctgggattacaggcgcgcgccaccatgcctggctaatttttgtactttaagtagagacaggatttcaccatgttggccaggctggtctcgaactcctgaccttaggtgatctgctctcctagacttccaaagtgctggaattataggcatgaaccactgtgcckggccagtaaattttatgttacatgttttttaccacattaattttttttaaagtgttaagtgtggtgaaaggcagatttcagtgaggatgtcgacctctagaagcagactttccagagtcttggaagtaatatttctgggttactttaggctactcagaccatgtttagagtattctgtcttattttggacacaacggccttggaccatggctggaggacatgtcagtcttggctatgccttctagtgtaacatagaacaagtatactctgccatgacatgagattccttcgaagagtttc

SEQ ID NO: 140646 - DNA, 601 bp, Human
aaaacttcaagaataaattaaattctccataagatttttaaactccatcatatcattgagaataaaactgttaaatgtgcacactgtgttcaccgcagcattattcacaatagccaagatgtggaagcaacctaaatgtccatctatgcatgaatggataaacaaaatgtggcgtatgcagacaatattattcagccttaaaaaaggaggaaatcctgccatatgtaacgtggatgaaacttgaagacgttaagtgaaataagccagtcacaaaaaagatactgcatgattccacttatayggggtatccaaagcagtaaaactcttagaagtagaaaatataatgtggttgccaagcaccgggaggaggtggtaacaggtagttgttgttcaatggatatagaatttcagttttgcaagatgaaaaagttctagggatctgttgcataatggactgcatatagttaacactgctgtactgtacacttaaaaatggttaaaatgctaaattttatgttttgttttgttttgagagtcttgctctgtctcccaggcaggagggcagtggcagaatcttggctcactgcaacctctgctttcc

SEQ ID NO: 140647 - DNA, 601 bp, Human
gattcaaggcaactttaaaaaatatattcgcaggccgggagcagtggctcatgcctgtaatcccagcactttgggaggccaaggcaggcagtacacctgaggtcgggagttcaagaccaacttggccaacatggagaaaccccatctctactaaaaatacaaaattagccagacatggtggcacatgcctgtaatcccaactactcaggagactgaggcaggagaatcgcttgaacccgggaggcggaggttgcggtgagctgagatcgtgccattgcactccagcctgggcaacagagcraaactccgtctctctctctctttctctctctctctctctccctctctctctctctttctctctctctctctccctccctctccctctctctctctctctctctctctctctctctatatatatatatatatgtatgtatgtattaagatgcacctgatatggattaagattgtccttgttagacaaaccgcaagaatagctcagattaaccaacagacatttctcaagcttttacccctcaagcatttgagtttaaaacttcaagaataaattaaattctccataagatttttaaactcc

SEQ ID NO: 140648 - DNA, 601 bp, Human
tgtgggttttgtttttgttttttgttttcctctctagatgtttgtaatcctgcctttaaaacaccaggggatggcatccgatacagagttgctgctttctacaacagcacccccacagtgctcttttaaacacactaacccctggggtaaggaaaaaaaattatgaggaaaagtgttccctggcttcttagtctctaataagtactgtgtggtgctgcttcactgggatcaactggtttcaactttctattctcagtggcatctacagcaggcttgaggcagaacagttgaccaaaggaaycgtgagtgcagctggagtcctgggaagtccgcggcaaaagtattggcagtggttgatcaagtggcacctgctgttaaatgaacaaattccccatttccagacctaatcacaaattggcaagtgcactttataatccaatgcccttcaaaatcccaaacctccgggcaggagaaggaaagtgacgttcagtgagagacataatgtctgacatcaactccaccatgttacaagcaatagccagatgcttcacagaaagcaagcactttcttaaacggatgattttcttttgtatatttattc

SEQ ID NO: 140649 - DNA, 601 bp, Human
gactccctccttcaactccagcagccacagttgcttagatacccttgtagttcaggtctcctgaggtctccacatggcttccagctgcctttctagcacgtgaagatcctaccctatcatcctctgccatttaaggcgagaggcagattcactgtgatctgggtaaataccatttccaaaaaggaaaccggcacccaaacctcccatctttttataaattctcctgcacagacggtatagtctcaaaggacgtaggagccaaacttggggaaaaaaaattttctcccctatttagaaagtyctaaataatctgacacaacattcagctagtgggggtgtgagaaagtgggaaggaggactttaaggccaaagtcacatgaaataaagagaaaaatgaaaaatgtaagcttttgcccttttgtgaggacttctctaattctcgtggtatttcagatttccctcaatcaaatcattcactccttcagtttgtaggtaacagacatttcccttccttattaacaagatgcaggtagttagcaacataatagaagcaagaactttgtattgcttggtgtgtctgggtcacatactatttttaatt

SEQ ID NO: 140650 - DNA, 601 bp, Human
ttccatcttaaaaagattttttaggcagggtgtggtggctcatgcctataatctcagcactttgggaggttgaggcaggaagattacttcaagaccacccagggcaatatagtgagaccccccatctctacaaaaacaaaaaaattagctgggtatgttggcatacgcctatagtcctggctactcaggagactgaggcaagagaattgattaagccctggagttcaaggctgcagtgagctatgattatgccactgcactccagcccgggcaatagagcaagaccctgtctcttaaaaawaaataaataaataaaaaggtagaaaaatgaactagtttggtgtagacaggttcccctgcagaggttctgcttcaggcctaagtgaggcagtggcagccaggcaaggccctggagaacagcatgccaaacaagaggaacagacagggccaaggtccccaggtggggaagggactggcatgcttgagagcagaaagaagacccaggcggctggttaaataatgaatgaggagaagcggggtgggggaatgaggatgaagaggcatgcttacacgtttttacaaaagggcagcttttgacttg

SEQ ID NO: 140651 - DNA, 601 bp, Human
gactatggtttaaccatatattaccgagacattttaatacaactttatttttaataatagggaattcaaaaaaatctaaatgcttttttgcttaatgcattttctctctccaaagaaagtctcaatatactttatatgtttccatcttaaaaagattttttaggcagggtgtggtggctcatgcctataatctcagcactttgggaggttgaggcaggaagattacttcaagaccacccagggcaatatagtgagaccccccatctctacaaaaacaaaaaaattagctgggtatgttggyatacgcctatagtcctggctactcaggagactgaggcaagagaattgattaagccctggagttcaaggctgcagtgagctatgattatgccactgcactccagcccgggcaatagagcaagaccctgtctcttaaaaaaaaataaataaataaaaaggtagaaaaatgaactagtttggtgtagacaggttcccctgcagaggttctgcttcaggcctaagtgaggcagtggcagccaggcaaggccctggagaacagcatgccaaacaagaggaacagacagggccaaggtccccaggt

SEQ ID NO: 140652 - DNA, 601 bp, Human
ccacaattaattacaaattccttaaaaaacacaaatagagactatggtttaaccatatattaccgagacattttaatacaactttatttttaataatagggaattcaaaaaaatctaaatgcttttttgcttaatgcattttctctctccaaagaaagtctcaatatactttatatgtttccatcttaaaaagattttttaggcagggtgtggtggctcatgcctataatctcagcactttgggaggttgaggcaggaagattacttcaagaccacccagggcaatatagtgagaccccccatctctacaaaaacaaaaaaattagctgggtatgttggcatacgcctatagtcctggctactcaggagactgaggcaagagaattgattaagccctggagttcaaggctgcagtgagctatgattatgccactgcactccagcccgggcaatagagcaagaccctgtctcttaaaaaaaaataaataaataaaaaggtagaaaaatgaactagtttggtgtagacaggttcccctgcagaggttctgcttcaggcctaagtgaggcagtggcagccaggcaaggccctggagaacagcat

SEQ ID NO: 140653 - DNA, 601 bp, Human
ttgaacgaaggctccatcaggggacagcaaactccctcatttcatattcaggcaagagcggagagcaacagagccttgatgattcgagtgtctggatccttctatagtgtggggaaaggatgtggcaaatagagagagagaaaaaaggaataggaggcacatgaccaagtctgattttttcagaccttctgttaaaactgccccacagatggcttcaaaatatagaaccagagactgtggagagctggaaggaatccccttccccccgtccattatctttgctccacggataagaaattgkcctgagaagggaagggactgacccaggccacacagccaggaaggggcaacagccatgtctcctgactctcagtgtaacattttttcccctaaaatacattggaccaaaatctacttagcagcccatggaaatgaacaagtaaattgttaacttgctactaattttagctatcaactattgatggtggcacatctaactcagtcggtcatgattttaagaaagccacaattaattacaaattccttaaaaaacacaaatagagactatggtttaaccatatattaccgagacattttaata

SEQ ID NO: 140654 - DNA, 601 bp, Human
tttacagatgaagaaataacaatttacagagaaacttccttccagaaagaaaaagaggaaccaagagaagaatgaccatcatcctgatgtgcccagaactctttcagttttagcacctaatattgtacatcctgggaaacccctcagtccccaggactgttggtcaccccacaaaggacacttcacaaattattaaatctgaacaagtaacaggtacaagatattatgatgatgacttaatgaccgaataagactctgagggtaaatcaagatttaaattgcagttacgtgttatacaatrcatgtagttcaggctggtaggaggaccttccagaaactggaaacatgggactctgaggatgagagagcacacgcaggtgagcggagacttcttctcctcctaatatcccactgttgacgggtgctgtgttatctgtactgtggcccctctgcagcacaacctgagggaggaaggcaggtcagacacagccaggggcttgctcaaaggcctgggaccaggcagaggaggatccacagatggagctcaggtctcctcatccttaatcctaggctttctcccctgcccatcagcccctcccgg

SEQ ID NO: 140655 - DNA, 601 bp, Human
tttttgaggcaattgtgagcactcttaccttcttttttttttctgattacatttctactcttcactttattcactatttagttgcttctaaaatagtttgaggattatattaacacagtcttgaaaaaataaaattcacacatagtcaaataacactgtaggacatgtttgttaagacaaaagaaacacaacattgaaaatacttggacatttttcatgcttataagacactagatttatgtttacattttttcatcaatattaatagtataattcactatgtatagatgaaattttacamaagatcatcattaatttttacagatatgatctcataattttagaaaattttgtttccattgttattgaaaagaattttatgtatttatttatttttcttatactttaagttctagggtacatgtgcacaacgtgcaggtttgttacatatgtatacatgtgccatgttggtgtgctgcacccattaacttgtcatttacattaggtatatctcctaatgctatccctccccacttgacaggccccagtgtgtgatgttccccttcctgtgtccaagtgttctcattgttcaattcccacc

SEQ ID NO: 140656 - DNA, 601 bp, Human
aatctaccaacaccttgatctcggacttcccagcctctagaactgtgagaaataaattcctgttgtttaagccacctggtctacagtattttgttgtggcatcctgagctgactaatacagtcatgcatcatgataacaagaaaagagcaaattacacaaacaggtgcactgagtagagaatgctgaagtgcaaattcaagaagcctcattttctttttgaggcaattgtgagcactcttaccttcttttttttttctgattacatttctactcttcactttattcactatttagttgctwctaaaatagtttgaggattatattaacacagtcttgaaaaaataaaattcacacatagtcaaataacactgtaggacatgtttgttaagacaaaagaaacacaacattgaaaatacttggacatttttcatgcttataagacactagatttatgtttacattttttcatcaatattaatagtataattcactatgtatagatgaaattttacacaagatcatcattaatttttacagatatgatctcataattttagaaaattttgtttccattgttattgaaaagaattttatgtattt

SEQ ID NO: 140657 - DNA, 601 bp, Human
agtttgctctctctgccacatgaagacacagcaggaagacaaccacctgcagattaggaagagggtctgctatggtctgaatgtttgtgtcccctcaaaattcacagactgaaatcctaacccccacggtgatggtattaggaggtggggcctttaggaggtgcttagggcatgagggcagagcctcatgaaagtgattagtgccttaatgaaagaagccctggattgaccccttgccccttctaccatttgaggacacagtgagaagaaggcaccatccatgaaccagaacgttggcctytggcagacaccaaatctaccaacaccttgatctcggacttcccagcctctagaactgtgagaaataaattcctgttgtttaagccacctggtctacagtattttgttgtggcatcctgagctgactaatacagtcatgcatcatgataacaagaaaagagcaaattacacaaacaggtgcactgagtagagaatgctgaagtgcaaattcaagaagcctcattttctttttgaggcaattgtgagcactcttaccttcttttttttttctgattacatttctactcttcactttattcac

SEQ ID NO: 140658 - DNA, 601 bp, Human
ggaggcagaggttgcagtgagccaagaccacgccactgcactctagcctgggcaacagagcgagactcgatctcaaaaaaaaaaaaaaagaaaagaaaagaaaagaaaagaaaagaaaagaaagagcccagagtttgctctctctgccacatgaagacacagcaggaagacaaccacctgcagattaggaagagggtctgctatggtctgaatgtttgtgtcccctcaaaattcacagactgaaatcctaacccccacggtgatggtattaggaggtggggcctttaggaggtgcttaggkcatgagggcagagcctcatgaaagtgattagtgccttaatgaaagaagccctggattgaccccttgccccttctaccatttgaggacacagtgagaagaaggcaccatccatgaaccagaacgttggcctttggcagacaccaaatctaccaacaccttgatctcggacttcccagcctctagaactgtgagaaataaattcctgttgtttaagccacctggtctacagtattttgttgtggcatcctgagctgactaatacagtcatgcatcatgataacaagaaaagagcaaattaca

SEQ ID NO: 140659 - DNA, 601 bp, Human
taatcccagcactttgggaggctgaggtgggcggatcacgaggtcaggagttcgagaccagcctggccaacatggtgaagccccgtctctactaaaaatacaaaaaattagccaggtgtggtgttgtgcacctgtaatcccagctactcaggaggttgaggcaggagaattgcttgaacccaggaggcagaggttgcagtgagccaagaccacgccactgcactctagcctgggcaacagagcgagactcgatctcaaaaaaaaaaaaaaagaaaagaaaagaaaagaaaagaaaagaaaagaaagagcccagagtttgctctctctgccacatgaagacacagcaggaagacaaccacctgcagattaggaagagggtctgctatggtctgaatgtttgtgtcccctcaaaattcacagactgaaatcctaacccccacggtgatggtattaggaggtggggcctttaggaggtgcttagggcatgagggcagagcctcatgaaagtgattagtgccttaatgaaagaagccctggattgaccccttgccccttctaccatttgaggacacagtgagaagaaggcaccatccatgaacca

SEQ ID NO: 140660 - DNA, 601 bp, Human
gcagtgagtcgagattgttgccactgcactccagcccgggcgacagagtgagactccgtctcaaaaaaaaaaaaaaaaaaaaaaaagccaaagccagttgcccttgaggctctcaagccattttctaacctgcctgagagcctgcccagctctcctcagagagcttcgatttgtgagtaacagatctttttataccttcttagtgcacaggtggcaccctcagcctcaatatcacaactaaattttaggtcagaggttgacacctgctcccttctacaagggcaatcacaagacaaggatygcctgagcagaaacctaatcaaatgaggggatgagggaagagcaaagagggcatgacctacaatcccctctaaactcaaagcaacaatttaggactgggaaccccaggaattcagatgatggatactgaaccaaagggttgtggatttgttcatgattactgccatctccagaccagcaaaggacacaactgggaaaagctgcactacaaaatttaaaatacctaaaatatggaagtggaacatgaacaagtacttcatcagggcccagatttacatgtgccccgaatgagtcaacatga

SEQ ID NO: 140661 - DNA, 601 bp, Human
ttacctgggcttggtggcgcacgcctataattccagctactcaggaggctgaggcaggagaatcgcttgaacccgggaggcggaggttgcagtgagtcgagattgttgccactgcactccagcccgggcgacagagtgagactccgtctcaaaaaaaaaaaaaaaaaaaaaaaagccaaagccagttgcccttgaggctctcaagccattttctaacctgcctgagagcctgcccagctctcctcagagagcttcgatttgtgagtaacagatctttttataccttcttagtgcacaggtrgcaccctcagcctcaatatcacaactaaattttaggtcagaggttgacacctgctcccttctacaagggcaatcacaagacaaggatcgcctgagcagaaacctaatcaaatgaggggatgagggaagagcaaagagggcatgacctacaatcccctctaaactcaaagcaacaatttaggactgggaaccccaggaattcagatgatggatactgaaccaaagggttgtggatttgttcatgattactgccatctccagaccagcaaaggacacaactgggaaaagctgcactacaaaa

SEQ ID NO: 140662 - DNA, 601 bp, Human
ggaacggtggaatgagaaccaagaaagacaacgacattttctctcgaactgtctacttcagacaaccttattccagatatgagcacaaactggactcgctgctagctcacagcctctattgtaagcataagaaagagcagaaataagacaaatatgcattgtgccttaaatgcaaaggaagtggctgtaacactaaaagaatgattgcccaggggccagattaaataaaaaatctaggagtttggaatatctcaaatcatctatgaagtacagaaaatattttgttattgtgacacaacarcctctcttctaaaaggaaaataaacttcaggaaattgaacttcaaagatgccactgtttcagtcatcaaaattggacataccgtactgtgtattttaaaggaatagtgcccccgtgtggtttttgacaagatttcagaaaatgttcagcgttgtctcagaagtcacagttacacttgttatacaagaaacagtgaatttttcttgtgtggatttatttttaaatgtgattacagatgtgtttgcagtatagtagaaaaacgtcagagctgtgaagagctgtgtttgcagcgggagggttg

SEQ ID NO: 140663 - DNA, 601 bp, Human
taaaaagtgtaatagctcaagcttcagaggcgagagctggggaacggtggaatgagaaccaagaaagacaacgacattttctctcgaactgtctacttcagacaaccttattccagatatgagcacaaactggactcgctgctagctcacagcctctattgtaagcataagaaagagcagaaataagacaaatatgcattgtgccttaaatgcaaaggaagtggctgtaacactaaaagaatgattgcccaggggccagattaaataaaaaatctaggagtttggaatatctcaaatcatstatgaagtacagaaaatattttgttattgtgacacaacagcctctcttctaaaaggaaaataaacttcaggaaattgaacttcaaagatgccactgtttcagtcatcaaaattggacataccgtactgtgtattttaaaggaatagtgcccccgtgtggtttttgacaagatttcagaaaatgttcagcgttgtctcagaagtcacagttacacttgttatacaagaaacagtgaatttttcttgtgtggatttatttttaaatgtgattacagatgtgtttgcagtatagtagaaaaac

SEQ ID NO: 140664 - DNA, 601 bp, Human
aaatctgaggcccgatattaactttcaactaatttgtcattttggctaaattatttgcaaatactagcttatctattgctagacagtgagcaaattctattctcctaatcctacactacctctgaaacctcttctttcatatgtgtaaattaagtttgatagctttcctgaaaacaggaaattgttcaaaagacttaattttttctttcctgtcataaaaagtgtaatagctcaagcttcagaggcgagagctggggaacggtggaatgagaaccaagaaagacaacgacattttctctcraactgtctacttcagacaaccttattccagatatgagcacaaactggactcgctgctagctcacagcctctattgtaagcataagaaagagcagaaataagacaaatatgcattgtgccttaaatgcaaaggaagtggctgtaacactaaaagaatgattgcccaggggccagattaaataaaaaatctaggagtttggaatatctcaaatcatctatgaagtacagaaaatattttgttattgtgacacaacagcctctcttctaaaaggaaaataaacttcaggaaattgaacttcaa

SEQ ID NO: 140665 - DNA, 601 bp, Human
gaaacaaagcagtaagaaatacttgccccaatagttgcttactaacatagcataccaactatgatagggatccacagcatcattgtatatttccccacaagcaaatcattacacaatggaaggctgctacacccttagggacttgccattgtttgcaacaatatggtgggcatcacacatttaaatattgcaaaaccagggctaggcgtggtggctcacgcctgtaatcctagcactttgggaagccaaggtgggcagatcacctgaggtcaggagttcaagaccagcctggccaacatgscgacactccatctctactaaaaatacaaaaattagccaggcgtggtggcacgtgcctgtaatcccaggtactcgggaggctgaggcaggagaatcacttgaacctgggaggcaggggttgcagtgagccaagatcacaccactgtactccagcctgggcaacagagtgagactctgtctcaaaaaaataaaaataataaataaattttgcaaaaccagaaatctgaggcccgatattaactttcaactaatttgtcattttggctaaattatttgcaaatactagcttatctattgctag

SEQ ID NO: 140666 - DNA, 601 bp, Human
gaggaggattgcttgaggccaggaggtcaagaccagcctgggtaatataatgagacctgtctctacaaaaaatacaaataaaaattagccaggtatggtgtcacgtgcctgtagtcctagctactcaggaggctgagatggaaggacaaactaagcccaggagtttaaggttgcagtgagctatgaatgcgtgccactgtacctctgtgcctgggcaacagagctgtctcaaaaaaagaactaattgtttaccagttcaaggtaaattgagcaaaatacaaagtggttaaaaaatgaatayatgcagactgattttgtaattatttagctgacaatggctactcttgatcatttctgtttgtctgtttcttttatatttaagtagcttccataaagcctttgcatagacaacaatgtaattttcttattggatagccctaaaaaatggcactaaaagattatgtattactttggctttgaattgtgaaacaaagcagtaagaaatacttgccccaatagttgcttactaacatagcataccaactatgatagggatccacagcatcattgtatatttccccacaagcaaatcattacacaa

SEQ ID NO: 140667 - DNA, 601 bp, Human
caatattcctttcaaagagataccagcatgtcacagatctctatttttaaaatatgcttgatttgcatatacgaaagcatgggctttattttaatgacctgcaatctctacatttgtttcagtcctccatgcaatatgcatgtttacctcctacacttagactcttggtatgatttttccttaatgaaataacataaagcaaagaatcatagaaagcataatattctactgggatccacagcacccccatcacctacaatgttgttgccacaactctcctacttgatcatgtacaggactyaaaactgtaatcattaaaacccagatgatcagggtaaaggaatttagggttgttttgaggttgtttgacaatatttacacttggaaaagttaaggaacatattagtctgttttcacactgctacaaagacatacccaagactgggtaatttataaagaaaagaggtgtcattgactcacagttctgcaagactgggaaaacctcaggaaacttacaatcatggtagaaggggaagaggcatgtcttacatggtgacaggtgcagggggtccatgagggggtgagagaaaggaagggggaa

SEQ ID NO: 140668 - DNA, 601 bp, Human
atccctattgctacaatttttctaaaattccctggttttaagttggacaagaagtgcaatattcctttcaaagagataccagcatgtcacagatctctatttttaaaatatgcttgatttgcatatacgaaagcatgggctttattttaatgacctgcaatctctacatttgtttcagtcctccatgcaatatgcatgtttacctcctacacttagactcttggtatgatttttccttaatgaaataacataaagcaaagaatcatagaaagcataatattctactgggatccacagcacycccatcacctacaatgttgttgccacaactctcctacttgatcatgtacaggactcaaaactgtaatcattaaaacccagatgatcagggtaaaggaatttagggttgttttgaggttgtttgacaatatttacacttggaaaagttaaggaacatattagtctgttttcacactgctacaaagacatacccaagactgggtaatttataaagaaaagaggtgtcattgactcacagttctgcaagactgggaaaacctcaggaaacttacaatcatggtagaaggggaagaggcatgtc

SEQ ID NO: 140669 - DNA, 601 bp, Human
agaagattgctcttttgtgatgtctgatgataaagaaagaaaagaaagatccagcagtaatttgagaaggaaattgtggggagttagtaggtttttgtgtttactattcttttgatttcagaatgggatgtactttggtgccatgaagccaaaggagaagttctcagaggacagggaaagactgaagttgaagagcataaccaacagtgataattaacaggtggcaatgctggtaacggggttagaattgagagcacacccagaggaggaagccggggaaaggaaagcacaaggcattccyttgtctgaaacactgctggaagcaggcaaaaacctaacctcgggcacctaaattgtgctttacataaatgtaaatatttaatatcctccacctgcattcaaggcttatccccaaaatcaacgcttaaaataactcggaaactactagcacagagactgaagaaaaaaataactctagctgggtgcggtggttcacacctgtaatcccagcactttgggaggctgaggcgggtggatcacgaggtcaggagattgagaccatcctggccaacgtggtgaaaccccgtttctactaaaatac

SEQ ID NO: 140670 - DNA, 601 bp, Human
tagagatcctggtccagtcctgtttattgtgggctctaccctttagggaaaggagagcctttgcagactaagaagtacccaacagcatcgatttgagatgctggggccatgacagtttaattgaaagaggctgtcaggcatttctatgtccatttgggttttgatgggatcaagatggtgggtggcattcttcccctattcttccaggatttctcccattaatggctcctgggtgagaactggataagtgccattctctaaaggcttccaatttggcaatgaagttgtgatgatgcttcaragagcatttcagtatagggtgagggggcaagaagccaggtgctcctgtctgagaagtgaattggacgtgaggaaataaaggaaatgggtagaagattgctcttttgtgatgtctgatgataaagaaagaaaagaaagatccagcagtaatttgagaaggaaattgtggggagttagtaggtttttgtgtttactattcttttgatttcagaatgggatgtactttggtgccatgaagccaaaggagaagttctcagaggacagggaaagactgaagttgaagagcataaccaacagtgat

SEQ ID NO: 140671 - DNA, 601 bp, Human
gggaattcacacaccacagtgtgttttgtcctctgctgcttggaaaatgtaggttgcattcacaatggcacagtggccaggctttcatgttgaataaagaccagtattgcattagtgcttgcacctgagagtatttttgacttgtgcacaggcctttcaggacagttacccagatagtaattttcaaccacacttcttttccttcagtaaaattggatgatagaagttatttcagatcatttctgattacctctatgcctcaggaatatgatcttatatataagcatcttttcaatctcasttctacgtttgatggtcagttagcactaattcaaaaagttagatgtatatgagtgtatgatagatgagatagcaaaatgaagggaaattattctcagattttgagctccctatatctggcagtaatggcacatcatagctactcagtacatgtttaattggtgaatgatgggtggatgggtgggtgggcagatggatgaatgagtgggtggatggtggatggatggataagtggatacatgaacaggtggatgactggaaagactaacggaaaaaataagtgaataaaagtgttttctga

SEQ ID NO: 140672 - DNA, 601 bp, Human
aaaggtatcaaatatttgaggaaactttccatttaaataattgatactacaaaaactggagtgctgaaaagctagtatgaggtcattctctcttaggcaagagagctgctaagaaatttattgatgggggtgggtgaagtcaagggggaaaggtttggttagtgattggtatctgggggccaggagaggggaattcacacaccacagtgtgttttgtcctctgctgcttggaaaatgtaggttgcattcacaatggcacagtggccaggctttcatgttgaataaagaccagtattgcatyagtgcttgcacctgagagtatttttgacttgtgcacaggcctttcaggacagttacccagatagtaattttcaaccacacttcttttccttcagtaaaattggatgatagaagttatttcagatcatttctgattacctctatgcctcaggaatatgatcttatatataagcatcttttcaatctcacttctacgtttgatggtcagttagcactaattcaaaaagttagatgtatatgagtgtatgatagatgagatagcaaaatgaagggaaattattctcagattttgagctcccta

SEQ ID NO: 140673 - DNA, 601 bp, Human
gctgcagtgacccataattgcaccactgcactccaccctgggcaacatagtaagaccctgtctcaaaacacacacacacacacacacacacacacacagacaaaggtatcaaatatttgaggaaactttccatttaaataattgatactacaaaaactggagtgctgaaaagctagtatgaggtcattctctcttaggcaagagagctgctaagaaatttattgatgggggtgggtgaagtcaagggggaaaggtttggttagtgattggtatctgggggccaggagaggggaattcacayaccacagtgtgttttgtcctctgctgcttggaaaatgtaggttgcattcacaatggcacagtggccaggctttcatgttgaataaagaccagtattgcattagtgcttgcacctgagagtatttttgacttgtgcacaggcctttcaggacagttacccagatagtaattttcaaccacacttcttttccttcagtaaaattggatgatagaagttatttcagatcatttctgattacctctatgcctcaggaatatgatcttatatataagcatcttttcaatctcacttctacgtttg

SEQ ID NO: 140674 - DNA, 601 bp, Human
taatgaaaatgtatattcctgggtcttccatccagatattctgattcaacgtatctgagaagggacctgtgcacctgcattttaacagcacccctagtggttctgacacaagtagttctgcagaccacatttgaaaaataacaatttattcaaactcagctaatgagtcattgcagatagataaatcaacttcactgatccagagaaaacctgagaaacagaaggaagccttaaaaaaatgagatgggccgggcgcggtggctcacgcctgtaatcccagcactttgggaggctgaggcgrgcggatcccgaggtcaggagatcgagaccatcctggctaagacggtgaaaccccatctctactaaaaatacaaaaaatcagccgggcatggtggcgggtgcctgtagtcccagctacttgggaggctgaggcaggtgaatcacttgaacccaggaggcagaggttgcagtgagccgagatcatgccactgcactccagcctgagtgacagagtgagactccgtctcaacaacaaaaaaaaaaagagaaaagcagaaaataaaagtcctaaaacaataaagctctcatatactgtattcct

SEQ ID NO: 140675 - DNA, 601 bp, Human
tttaatgaaaatgtatattcctgggtcttccatccagatattctgattcaacgtatctgagaagggacctgtgcacctgcattttaacagcacccctagtggttctgacacaagtagttctgcagaccacatttgaaaaataacaatttattcaaactcagctaatgagtcattgcagatagataaatcaacttcactgatccagagaaaacctgagaaacagaaggaagccttaaaaaaatgagatgggccgggcgcggtggctcacgcctgtaatcccagcactttgggaggctgaggygggcggatcccgaggtcaggagatcgagaccatcctggctaagacggtgaaaccccatctctactaaaaatacaaaaaatcagccgggcatggtggcgggtgcctgtagtcccagctacttgggaggctgaggcaggtgaatcacttgaacccaggaggcagaggttgcagtgagccgagatcatgccactgcactccagcctgagtgacagagtgagactccgtctcaacaacaaaaaaaaaaagagaaaagcagaaaataaaagtcctaaaacaataaagctctcatatactgtattc

SEQ ID NO: 140676 - DNA, 601 bp, Human
tgaagaggcttctaacatcctattttgaattcaggttgccatagaaaccagtagacttctgtatgggattccatcaaaattactgtataatttgatgcacacagaagaaccctgtctcactgtctcaacttaaaacaaagccactactctggtttgaatcctttgatgagtctcatcgtttgaggctaaaccaatctattaaaaaaaattaaggctcatgacagtgatattcctttgaatttagacattttgctttccaagagataggagcaatgttgacatgaccatgacccacagtcaygttatctgaagccaggtcacgatacatcactcaccgttccaggcatgcatgtctacgtttgcacgctcaggcacaaatgtggctaggaggatatctttatgtagagccacaataactgtgcttcggataagccacaaaatatatggtacagccactatacaaaaatataatattcatagtaataatagctgccattctgtgtgcttactgttttaaattatttttctatattaatgcaacagccctatgaatcaggctttattatcatcttccttttatacacaggggaaatgaggcaaa

SEQ ID NO: 140677 - DNA, 601 bp, Human
cccacctcagcttcccaaagtgctgggattacaggcgtgagccaccatgcccagccaaaacaattttttttaactaaaaatatatcatctgtaagttctagtgtccccctatggcacatcttcttagcacaactggggacacactgccttgcagagggattctatttacctaaccaatggattcaggcaagacatgggatttgctttggaaaatgaattgtgagcaaaaatgtacgttacttctggatggaagatttaagagtcagtagttgcttcattgcactcttctccctttgccggrcagtgttccagataggggctgttctgtcagcccaggtcccagagcgaagatgacagagagagcaactacagtaaacctgcacgggcagaagcaacaaatgagaaataaactctggttgtcataagccactgagactttccactgtgtttgttaccacagcccaacatagcctttatacttggaactgcccacccagttagtcaatatctgcaacagactttgtcttcaggattacgagatccaattttaaaatacttccagacagatatgtgctaaaaatacatcgtttacaaaaattag

SEQ ID NO: 140678 - DNA, 601 bp, Human
aggcaaggcgctgtaaaccaaggctgaatgtgctctcttgtacaaagtgctcgtttgtcaaaaccatgaaaccaagcttcctaattctagaaagaaaagaatgtaagccccaaaaccttcatgaaccatttcctccagctctaaaattctgtgattccaccattactcccctcaaccagcacctctaaaacaattttttttttttgagatggagtctcgctctgttgcccaggctggagtgcagtggcacgatctcggctcaccgcaacctccgcctccagggttcaagtgattctcctgyctcagcctcctgagtagctgggattacaggcacccgccaccatgcccagctaatttttggatttttagtagagacggggtttcactatgttggccaggctggtctcgaactcctgacctcatgatccacccacctcagcttcccaaagtgctgggattacaggcgtgagccaccatgcccagccaaaacaattttttttaactaaaaatatatcatctgtaagttctagtgtccccctatggcacatcttcttagcacaactggggacacactgccttgcagagggattctatttaccta

SEQ ID NO: 140679 - DNA, 601 bp, Human
agacttcccagctttgctccatatggatgaaatgcttctaggtctccagagccaacacggctctttcacttagcagttccatctgttctgcaggtcagttcactggttaagcaagtcacacctttcctagctggctgggaaaacaatgacactaccctgttacatgatgggatgtagtgagcaacactccatggtccaaaagagtccttcttagcctgatgtggtggctcatgcctgcaatcccagcactttgggagaccgaggcaggaggatcacttacttgagctcaggagtttgaaamcagcctggccaacatggtgaaaccccatctctactaaaattacaaaaatcagctgggcatggtgacggacacctgtaatcccagctactccagaggctgagacaggagaatcactcaaacccaggggacagagattgtagtgagccaagatcacaccactgcgctccagcctgggtgacaaagtgagactccatctcaaaaacaaaaacaaaagagtcattcttggtccagtacaggcctctttctaaagctttcttcttacagataatttgcgtagaatctaaagaatcataatttttg

SEQ ID NO: 140680 - DNA, 601 bp, Human
tagcctgtgtccttgtgagtcccatgatggaatcctggggttcacatagcagagaggctctgcagaggggatacgcagggggccaaattgagcacgagatcctgcacaaaagcatgccccgtgcaaaggacccttcccccaggatatagagaggtcctctttgaacctcttcatgcaaccattaccaaggaatcagcaagaatgtgagagctgttgtgttataatcgcaaagccctggtaactctggtaaggaggctcactctgctactactcattatgggatgggatagtgccttccttyggaagaatgtaatcttcccagcataccttttacagacttcccagctttgctccatatggatgaaatgcttctaggtctccagagccaacacggctctttcacttagcagttccatctgttctgcaggtcagttcactggttaagcaagtcacacctttcctagctggctgggaaaacaatgacactaccctgttacatgatgggatgtagtgagcaacactccatggtccaaaagagtccttcttagcctgatgtggtggctcatgcctgcaatcccagcactttgggagaccgaggcag

SEQ ID NO: 140681 - DNA, 601 bp, Human
aacaggctataccacatagcctaagtgtgtggtaggctacaccatctaggtttgtgtaagtgcattttgtgatgttcacacaatgaccaaatcacctataatgatgtgtttttcagaacgtctccccatcactaagtggtacatgactgtacagagttttatcacataactcatttggacagaatatacacaggccatatgaggattacacaatttcaagacagcaaattataaacatgtctaattcacaccaaacatacagaagtctttgtcagcacttcaaggatatcattatgaatasggaatgtcatcaagcagcaggtacacagaaatgcccatgacagagagtactaggttgctcggagggagggcaggagaggtgcctttagacctgctggagcccattagcctgtgtccttgtgagtcccatgatggaatcctggggttcacatagcagagaggctctgcagaggggatacgcagggggccaaattgagcacgagatcctgcacaaaagcatgccccgtgcaaaggacccttcccccaggatatagagaggtcctctttgaacctcttcatgcaaccattaccaaggaatcag

SEQ ID NO: 140682 - DNA, 601 bp, Human
atatttacacagaagtataatgtgtttgtgttttaagctaagtgttattccaaaacagtcaaaaggttaaaaagaagttaaagtttataaagtaaaaaagttatactaagctaaggttgatttattattgaagaaaaaattcttaaaaatgtagtgtagcctaattgtacagggataaagtctacagtagtggacagtaatgtccctggcattcacgttcactcaggactcactcactgactcacccagagcaacttccaatcctgcaagctccatttgcaataagtgccctagacaagtrtaccattttaatctcttacaccatacttttactgtaccttttctatgtgtagatacatttaaatatacaaacacttactattgtgttacaattggctacaatatccagtagctcacatgctgcacaggtttgtagctaggagcaacaggctataccacatagcctaagtgtgtggtaggctacaccatctaggtttgtgtaagtgcattttgtgatgttcacacaatgaccaaatcacctataatgatgtgtttttcagaacgtctccccatcactaagtggtacatgactgtacagagt

SEQ ID NO: 140683 - DNA, 601 bp, Human
ttaattaaaaggcgtggtggctcacacctgtaatcccagcactttgggaggccgaggcaggtggagcgcctgaagtcaggagttccagaccagcctgaccaacatggtgaaacgcagcctctactaaaaatacaaaaattagccaggcgtggcggcgggcacctgtattcccagctactcaggaggctgaggctggagaattgcttgaacccgggaggcggaggttgcagtgagccaagatcgtgtcactgtgctgcagcctggaagacagagcgacactccatctcaaaaaaaaaaaaaagtgtaaaaagtaaaagaaaaaagttcatataaggataaatagaaaatatatttacacagaagtataatgtgtttgtgttttaagctaagtgttattccaaaacagtcaaaaggttaaaaagaagttaaagtttataaagtaaaaaagttatactaagctaaggttgatttattattgaagaaaaaattcttaaaaatgtagtgtagcctaattgtacagggataaagtctacagtagtggacagtaatgtccctggcattcacgttcactcaggactcactcactgactcacccagagca

SEQ ID NO: 140684 - DNA, 601 bp, Human
aagaaggcatcattgtcatagcagatgacagctccaggtgggttactgcccctgagatccttccagtgcgaaaagatgtggagatggaagacagcgagactgatgagcctcactctgtggagacctaggctaatgtgcatgcttatgtgttagtttttaattaaaaggcgtggtggctcacacctgtaatcccagcactttgggaggccgaggcaggtggagcgcctgaagtcaggagttccagaccagcctgaccaacatggtgaaacgcagcctctactaaaaatacaaaaattagccrggcgtggcggcgggcacctgtattcccagctactcaggaggctgaggctggagaattgcttgaacccgggaggcggaggttgcagtgagccaagatcgtgtcactgtgctgcagcctggaagacagagcgacactccatctcaaaaaaaaaaaaaagtgtaaaaagtaaaagaaaaaagttcatataaggataaatagaaaatatatttacacagaagtataatgtgtttgtgttttaagctaagtgttattccaaaacagtcaaaaggttaaaaagaagttaaagtttataaagtaaaa

SEQ ID NO: 140685 - DNA, 601 bp, Human
catcatattgacaataaacaactgtgtttctggtttatatatttactaaactaggctttttatttttattttagagtatactccttctatttattaaaaaaaaaaaaaagttaactgtaaaacagcctcaggcaggtccttctggaggtatcccagaagaaggcatcattgtcatagcagatgacagctccaggtgggttactgcccctgagatccttccagtgcgaaaagatgtggagatggaagacagcgagactgatgagcctcactctgtggagacctaggctaatgtgcatgcttrtgtgttagtttttaattaaaaggcgtggtggctcacacctgtaatcccagcactttgggaggccgaggcaggtggagcgcctgaagtcaggagttccagaccagcctgaccaacatggtgaaacgcagcctctactaaaaatacaaaaattagccaggcgtggcggcgggcacctgtattcccagctactcaggaggctgaggctggagaattgcttgaacccgggaggcggaggttgcagtgagccaagatcgtgtcactgtgctgcagcctggaagacagagcgacactccatctcaa

SEQ ID NO: 140686 - DNA, 601 bp, Human
cacattttggctattgtgaagaatgctgctgtgaacacagttgtacagatatctgttcaaattcctgctttcagtccttatgggcatatattcagaagtggaattgctggatcatatggtaattctacgtaatttttttttttttttgagacggagtctcgctctgtcacccaggctggagtgcagtggcaccatcttggcttactgcaacctccacctcccgggttcaagtggttctcctgcttcagtctcctgagcagctaggattacaggcacctgccaccatgcccagctaattttygtatttttagtagagacagggtttcaccatgttggccaggctggtcttgaactcctggcctcaagtgatctgcccgcctcagcctcccaaagtgctgggattaggtgccagccaccatgccctgccaattctacataattttctgaggaactcctgtactcttttccacagtggctgcaccattttacatttccacaagcaatgcataagagttcccatttctccacatcctttctaacacttgttctttttttttttaagccatcacagtggtgtgaactgtctactgtctattgtctt

SEQ ID NO: 140687 - DNA, 601 bp, Human
cttatttcacttagcgtaatgtcttcaaggttcacctatgttgcagcacgagtcaaacttttccctcattttcaaggctggatagtattctgttgtatgtgtatcctacattttctttagccatccgtctgtggatggacacttgggttacttccacattttggctattgtgaagaatgctgctgtgaacacagttgtacagatatctgttcaaattcctgctttcagtccttatgggcatatattcagaagtggaattgctggatcatatggtaattctacgtaatttttttttttttttgagacggagtctcgctctgtcacccaggctggagtgcagtggcaccatcttggcttactgcaacctccacctcccgggttcaagtggttctcctgcttcagtctcctgagcagctaggattacaggcacctgccaccatgcccagctaatttttgtatttttagtagagacagggtttcaccatgttggccaggctggtcttgaactcctggcctcaagtgatctgcccgcctcagcctcccaaagtgctgggattaggtgccagccaccatgccctgccaattctacataattttctga

SEQ ID NO: 140688 - DNA, 601 bp, Human
ctggcaaccactattagaatttgtgtctctgaagttgactactctagatatttcatataagtggaaccataaaacattcttcctttggggcctggcttatttcacttagcgtaatgtcttcaaggttcacctatgttgcagcacgagtcaaacttttccctcattttcaaggctggatagtattctgttgtatgtgtatcctacattttctttagccatccgtctgtggatggacacttgggttacttccacattttggctattgtgaagaatgctgctgtgaacacagttgtacagatayctgttcaaattcctgctttcagtccttatgggcatatattcagaagtggaattgctggatcatatggtaattctacgtaatttttttttttttttgagacggagtctcgctctgtcacccaggctggagtgcagtggcaccatcttggcttactgcaacctccacctcccgggttcaagtggttctcctgcttcagtctcctgagcagctaggattacaggcacctgccaccatgcccagctaatttttgtatttttagtagagacagggtttcaccatgttggccaggctggtcttgaa

SEQ ID NO: 140689 - DNA, 601 bp, Human
atttaacactaactctccattctgtcctcccccaaaccctggcaaccactattagaatttgtgtctctgaagttgactactctagatatttcatataagtggaaccataaaacattcttcctttggggcctggcttatttcacttagcgtaatgtcttcaaggttcacctatgttgcagcacgagtcaaacttttccctcattttcaaggctggatagtattctgttgtatgtgtatcctacattttctttagccatccgtctgtggatggacacttgggttacttccacattttggctaytgtgaagaatgctgctgtgaacacagttgtacagatatctgttcaaattcctgctttcagtccttatgggcatatattcagaagtggaattgctggatcatatggtaattctacgtaatttttttttttttttgagacggagtctcgctctgtcacccaggctggagtgcagtggcaccatcttggcttactgcaacctccacctcccgggttcaagtggttctcctgcttcagtctcctgagcagctaggattacaggcacctgccaccatgcccagctaatttttgtatttttagtag

SEQ ID NO: 140690 - DNA, 601 bp, Human
aagttagatgagttaataagtactttgtgccggcaagtcacacctggtctgtcaataaggccttactgttaccattttatccctctccgctgacaactctaccacctattgtatttttgtgtatgtgccttttttttaaccatttttcaaatcatgggaaaatatgcataacaaaatgtagcattttaaccatccgtaagtgtgcagttcagtgatattaactacattcaaattgatgtgcaaccatcatcactatccatctctagaacttttccatcttccatttcaacttttcaaaaaraaactctgtacccatttaacactaactctccattctgtcctcccccaaaccctggcaaccactattagaatttgtgtctctgaagttgactactctagatatttcatataagtggaaccataaaacattcttcctttggggcctggcttatttcacttagcgtaatgtcttcaaggttcacctatgttgcagcacgagtcaaacttttccctcattttcaaggctggatagtattctgttgtatgtgtatcctacattttctttagccatccgtctgtggatggacacttgggttacttc

SEQ ID NO: 140691 - DNA, 601 bp, Human
tgacatggtggccaggcgggtttcaaactcctgacctcaagtgatccacctgccttggcctcccaaagtgctgggattacaggcatgagacaccacgcctggccctatatctcttactctgggattgaaagcctttcattatctgccctggtagtcacgtttcattcatacgaaccctacataccaaccatcgtcatggcagctgaatatttaagttcccaccagtttctggatctttccttagccagctcctatctatctagaatacctcctatcctctttccaccccaatcctgcctcycctccaaggtccaccttcaattacacggctaccttagaaacttcccattgactagtagagccttaagtaatcttccctttctcagttgtgtcatctataaagcagggctaataagtacctgtttcagagggttgctggagatgagcaataagttagatgagttaataagtactttgtgccggcaagtcacacctggtctgtcaataaggccttactgttaccattttatccctctccgctgacaactctaccacctattgtatttttgtgtatgtgccttttttttaaccatttttcaaa

SEQ ID NO: 140692 - DNA, 601 bp, Human
tcccagcactttgggaggctgaggcaggcagattgcctgaggtcaggagttcaagaccagtctggccaatatggtgaaaccctgtctctattaaaaatacaaaaaaaattagccgggcctggtggcatgcacctataatcccagctacttgggaggctgaggcaggggaattgcttcaaccagggaggtggaggttgcagtgagccaagattgtgccactgcactccagcctgggcgacagaccaagattccatctaaaaaaaaaaaaaaaatctctacagctgttctcataacttacacrgccccatttttcaaaacagctcttgatgcgcttattatattttgacctcctctccaaaagaaaggagacacatttcagtgaaagctttaaggtttttctgcggcagttccctcctcccccttctctgctctattttggtatgggttacctttcacagtgttctagagaaacctctcttcgttttccagcctcaaggtaactggataaaaatgtaattcatcattgtattgactatatttagatatacagaattcttgaaatatttacagtaaagaaggaagatttttaagttagttgagg

SEQ ID NO: 140693 - DNA, 601 bp, Human
cacacctgtaatcccagcactttgggaggctgaggcaggcagattgcctgaggtcaggagttcaagaccagtctggccaatatggtgaaaccctgtctctattaaaaatacaaaaaaaattagccgggcctggtggcatgcacctataatcccagctacttgggaggctgaggcaggggaattgcttcaaccagggaggtggaggttgcagtgagccaagattgtgccactgcactccagcctgggcgacagaccaagattccatctaaaaaaaaaaaaaaaatctctacagctgttctcrtaacttacacagccccatttttcaaaacagctcttgatgcgcttattatattttgacctcctctccaaaagaaaggagacacatttcagtgaaagctttaaggtttttctgcggcagttccctcctcccccttctctgctctattttggtatgggttacctttcacagtgttctagagaaacctctcttcgttttccagcctcaaggtaactggataaaaatgtaattcatcattgtattgactatatttagatatacagaattcttgaaatatttacagtaaagaaggaagatttttaa

SEQ ID NO: 140694 - DNA, 601 bp, Human
tggctcttatgggctgtggaatagaatgtaaataagtgtaaatggtcagcaagagctatcctcatcaggaggatgccaatgcaaaaatagcagggaggtgcgggagaggtagtcattttagaaagctggcttctgccattctgccagcaaaaacctaactgtgctaacaacgagcatttctccaaggagtgatccacagcacaccaaagtcttcacatgccacacacccctacaagagggactgctcacaacctttccgtgtgtgcttcaggcatgatcatggatatgaacagcaatgccrcacctccacgatctgcaagtcccaggagattttaaaacaaaagccatctcagagtttcagcagtggctgacttgcagtacagcaacatttttaaagagaagaggctttttttgttcctctgtcctctttcgtcctcttacttgaaacacacacacacatacatatacacacacatgtgatggcacttcttgattcaatgaattgggaatatgatttttttaggaagacaatttttttaataccaaatcatgtggagctgatataaatcaaagatgtatctgtgtgggtctttctctgttc

SEQ ID NO: 140695 - DNA, 601 bp, Human
ggcagcaagaatggggcctgagactcaggccctgccctctggaaattcacactaaaggcagggagatgaaatgtgtatgtacctgaataaaaccaccatctggcagggtagcgtccatcagttaaagaacgagtcggccaggcacggtggcgcatgcctgtaatcccagcactttaggaggccaagacaggtggatcacctgaggtcaggagttcgagaccagcctgaccaacatggtgaaaccccatctctactaaaaaaaaaaaaaaaaaaaaaaaaaaaaaatacaaaattagccggrcatggtggcacatggctataatcccaactactcaggaggctgaggcaggagaatcgcttgaatctgggaggcggaggttgcagtgagctgagatcatgccactgcacttcagcctgggcaacaagagcaaaactctgtctcgaaagaaaaaaaaaaaaaaagagaatgagttttacgggtaacaagtgcttccggaggatgatgtttacatgagtctgggatgtcagggaaggagcttaggaaagctggctcttatgggctgtggaatagaatgtaaataagtgtaaatggtcagcaaga

SEQ ID NO: 140696 - DNA, 601 bp, Human
ctccctgccaaggcttcaccacacctacatgtccagacctatcctcccagaaacgagatggagggtctgtgtagagtagcagcaaaatgtgggggctatctgggaccagactacctgggtcccaatctctgcaccatctcttgttagcagtgtggccttacacaagtaactaaagcaccctgcatctagtcttctcatctgtaaaatgggaataagaattgtacctccttcataaggttgttgtgagaataagtggattcaaacctgtgaagggcttggaacagacactggaacatgatawtccatatatgttctctgttgtcattacaactggatggctccatctagatgcatcccggatcctgcaaacccaagacgtctgtaactaaattcattaccagcccctctaaacctgttccaactcttggttcctttctcagttaacagcatccatgtcaacccagttgtccaaactggaaacctgaaaggaatccttaactccccatttacttttcgtatatccaattagccaccaaatcctccctcccagtgacagcactctgtacctactctcccctcccagcactcacacgcccctgac

SEQ ID NO: 140697 - DNA, 601 bp, Human
tccatggcctactcatgacctccactagatggcgcaggtggtgcttcttcccagctccagcccagaacggtgctccccttggacagttcatgtccgccccctctgggttttttgctctatcttttaaaatccagtccccagtcccatctgctggtaccttcgggacaatcctcagaatttctttccagttgatggtaccttattctgtctgcccgccctgttatggtttttttttttttcttcttataccctttgggggaatcatttcagtgagattctgggatgaaaaggaaataaatayttatgtcattccagcatcttgacaaaggagcacctatttttaaaatgcacaacaacagccccagtccactcctttacctctaacccaatttacccaatggaaatttgcagaggtggggcctaagaatgcagtttcttaaagccccttgggtgattctgacgcacagccagagccgagagccaatgtgttaatcctcttcttggtataattaaggcagcttgtagagtaaaaataaatcattagcagccatttcattttgtttaggtaccaaggctatgccacccaaaaagttaattgaaa

SEQ ID NO: 140698 - DNA, 601 bp, Human
tccaccaaagtgtgaaaagctttcccctggagcttggtgagcttcaccctcacgaagatgcaaaagtaccttctgcttctctgtcaccttggtgccaatgtagggactcacaccccggggctgagcctgaattttatttggagaacagttcttgcagctttagcctgagaacaaatgcggctgtcagctgcttggcataaggaatcagtaggaacagggtgtcttttaattaattatccagacaatcaatcactcactccatggcctactcatgacctccactagatggcgcaggtggtgyttcttcccagctccagcccagaacggtgctccccttggacagttcatgtccgccccctctgggttttttgctctatcttttaaaatccagtccccagtcccatctgctggtaccttcgggacaatcctcagaatttctttccagttgatggtaccttattctgtctgcccgccctgttatggtttttttttttttcttcttataccctttgggggaatcatttcagtgagattctgggatgaaaaggaaataaatatttatgtcattccagcatcttgacaaaggagcacctatttttaa

SEQ ID NO: 140699 - DNA, 601 bp, Human
tcatcccacatctgcatcattggaatgctgtattcagcacaccccccagaaaatctattttcacagtgagcctctcccctgcgttcgagggctgtctaccctagtctatgagaatagggacatcggtgggcagccaggtctcccaatggatgtctgagcagtgagcaagagggtgacccacctctccaccaaagtgtgaaaagctttcccctggagcttggtgagcttcaccctcacgaagatgcaaaagtaccttctgcttctctgtcaccttggtgccaatgtagggactcacaccccrgggctgagcctgaattttatttggagaacagttcttgcagctttagcctgagaacaaatgcggctgtcagctgcttggcataaggaatcagtaggaacagggtgtcttttaattaattatccagacaatcaatcactcactccatggcctactcatgacctccactagatggcgcaggtggtgcttcttcccagctccagcccagaacggtgctccccttggacagttcatgtccgccccctctgggttttttgctctatcttttaaaatccagtccccagtcccatctgctggtacctt

SEQ ID NO: 140700 - DNA, 601 bp, Human
cttattatccttcctctcagtattctgtctcccctccacgggggcactaagtccatctagcaggaccagcaatgcatacagccaataataggctggtcatcccacatctgcatcattggaatgctgtattcagcacaccccccagaaaatctattttcacagtgagcctctcccctgcgttcgagggctgtctaccctagtctatgagaatagggacatcggtgggcagccaggtctcccaatggatgtctgagcagtgagcaagagggtgacccacctctccaccaaagtgtgaaaagcyttcccctggagcttggtgagcttcaccctcacgaagatgcaaaagtaccttctgcttctctgtcaccttggtgccaatgtagggactcacaccccggggctgagcctgaattttatttggagaacagttcttgcagctttagcctgagaacaaatgcggctgtcagctgcttggcataaggaatcagtaggaacagggtgtcttttaattaattatccagacaatcaatcactcactccatggcctactcatgacctccactagatggcgcaggtggtgcttcttcccagctccagccca

SEQ ID NO: 140701 - DNA, 601 bp, Human
ccaatggcaagtgtccttataagagacaaagggggccaggcgcagtggctcacgcctgtaatcccagcactttgggaggctgaggcaggcggatcacgaggtcaggagatcgagaccatcctggccaacacggtgaaaccccgtctctactaaaaatacaaaaaattaggcaggcgtggtggcgggcgcctctagtcccagctgctcaggaggctgaggcaggagaatggcgtgaacccaggaggcagagcttgcagtgagctgagatcgcgccactgcactccagcctgggagacagagwgagactctgtctcaaaaaaaaagagacgaaggggacaaaggggagaagacacagaggacaaggtgacatgaagatgaatgctgagattggagtgatgtaaccatgagccaagaagtcacggaatgctaacggccaccagacgctggaaggtcaaggaacgaaattctcccccagagccttccaaggaaggcaaccctgctgacaccttgatttccaacttctgacccctacaactgtgagaaaataaatgtgtgctattttacaccaccggctttgtagtactttgttgcagcaacctca

SEQ ID NO: 140702 - DNA, 601 bp, Human
taaatacaccctgtagtgagctgagtgatgaccccacaccaaaagatacatctgcattcaaatccctggaacctctaaatgtgacctcatttggaaaaagggtctttgcaaatttaagttaaggatgttgcaatgagatcatcctggattacttgaatgggtcctaaatccaatggcaagtgtccttataagagacaaagggggccaggcgcagtggctcacgcctgtaatcccagcactttgggaggctgaggcaggcggatcacgaggtcaggagatcgagaccatcctggccaacacrgtgaaaccccgtctctactaaaaatacaaaaaattaggcaggcgtggtggcgggcgcctctagtcccagctgctcaggaggctgaggcaggagaatggcgtgaacccaggaggcagagcttgcagtgagctgagatcgcgccactgcactccagcctgggagacagagtgagactctgtctcaaaaaaaaagagacgaaggggacaaaggggagaagacacagaggacaaggtgacatgaagatgaatgctgagattggagtgatgtaaccatgagccaagaagtcacggaatgctaacg

SEQ ID NO: 140703 - DNA, 601 bp, Human
gtgtaagatttatggctcacagcctttcagtcatgtgcttagcacaaaaagaagcagaatacattagatttaataggcattagccaaaaaaataaggaagtaagttcatacacaaaatgattcaaagcataatatcacttaacagacatgctttattaaagtctgtaccatcctggctaacacagtgaaaccccgtctctactaaaaatgcaaaaacaattagcctggcatggtggcgggcacctgtagtcccagctactcgggaggctgaggcaggagagtggcgtgaacccagaaggtrgagcttgcagtgagccgagatcacgccactgcaccccagcctgggtgacaaagcgagactccgtctcaaaaataaaataaaataaaataaagtctgtcatttagaagtctgcagagcctaccaacattgcctggcagttgggccctatgttgggaaactacctaccagtacctggtaaagctatcaacttctcctgagacaaggcaaactgctctttgggctggtttacttcaatatttactccagctctccaaatagctttcattctcctgaactagtggagggctgaccttgcaaaca

SEQ ID NO: 140704 - DNA, 601 bp, Human
gccaccacacccagctcattttgtatttttagtagagacggggtttcagcatgttgccgggctggtctcaaactcctggcctcaagtgatctgcccaccttggcctcccaaagtgctgagattacaggcgtgagccaccattcccagccaaaagggtccccccttttttttttgaggcacagtctcactctgtcgcccaggctggagtgcagtggtacaatcttggctcactgcaacctccacctcctgggttcaagcaattctcgtgcctcagcttcccaaggagctgggattagaggcrcctgtcccttttctacaggctgcctcataggctccttaagcaaatatgactgcctgccccacctacatctaggagatacatcatttaggccaggttttccttttagcctcctgatttctattagccttgcaaatgcatttttcttttctttctttctttttttctttagagacagagtcttgcccatgctggtcttgaactcctggcctcaagtgatccttctgcctcagcctcccaaagtactgagatcacaagtgtgagccaccatatctagctgccttgtcaattcttgcaataatt

SEQ ID NO: 140705 - DNA, 601 bp, Human
agccatgtcactaaagatgctttggaaatattccgcttcctaaattgcaaatagttctgcaagcaatgcaaacagaacatttaagttctcaggactgtcaaaatgacaccttcatcagcttccaaatctggtaattattgtcttcctcacacccacgaaaaggactgaaattgagtggatctcacaaggttctcagctctggtgtcttttttggtaggtgtgggaagaagggacaagaaaacatcttgaataaggtcagagtcagagacagtaagccacgttttttgttttttttttttttaaacatcttttttactatcaaggcttttacccacaagctttcctccttgtttggaagcacatttttgatcactaactatatctagaaacactccttgagacaaagtaatttgtagataccatttttgtttgacccaagaagcccagacctactttcagggacaggaaataggagcctggggcccaggagaaatgatattcatggtagccaatgaaagtggaactggacgagaaggtacacagggcaaagtgccaaagcaaggatgaaacacacagcagtgagaattcataggccagatga

SEQ ID NO: 140706 - DNA, 601 bp, Human
agctgagtatttcacatcctttgactgactcttactcctccaaagtcaaggttaagccatgtcactaaagatgctttggaaatattccgcttcctaaattgcaaatagttctgcaagcaatgcaaacagaacatttaagttctcaggactgtcaaaatgacaccttcatcagcttccaaatctggtaattattgtcttcctcacacccacgaaaaggactgaaattgagtggatctcacaaggttctcagctctggtgtcttttttggtaggtgtgggaagaagggacaagaaaacatctkgaataaggtcagagtcagagacagtaagccacgttttttgttttttttttttttaaacatcttttttactatcaaggcttttacccacaagctttcctccttgtttggaagcacatttttgatcactaactatatctagaaacactccttgagacaaagtaatttgtagataccatttttgtttgacccaagaagcccagacctactttcagggacaggaaataggagcctggggcccaggagaaatgatattcatggtagccaatgaaagtggaactggacgagaaggtacacagggca

SEQ ID NO: 140707 - DNA, 601 bp, Human
gctgttgcatgtcattatgacagttgctgagatatgtgaatgcaaaccagcacccgggggagcagagcaaatttaagtttctgggaaagctacaagctagccaccattgcaatcaggaagcaatccttagtcccatttctcacctcattccaactgggacccattcagtcacccctagagaaacttgatgctatgagcacttagccaatgtaagctgagtatttcacatcctttgactgactcttactcctccaaagtcaaggttaagccatgtcactaaagatgctttggaaatattcckcttcctaaattgcaaatagttctgcaagcaatgcaaacagaacatttaagttctcaggactgtcaaaatgacaccttcatcagcttccaaatctggtaattattgtcttcctcacacccacgaaaaggactgaaattgagtggatctcacaaggttctcagctctggtgtcttttttggtaggtgtgggaagaagggacaagaaaacatcttgaataaggtcagagtcagagacagtaagccacgttttttgttttttttttttttaaacatcttttttactatcaaggcttttacccac

SEQ ID NO: 140708 - DNA, 601 bp, Human
taaccactggaaggaacaactaagtgtatacctatgctggagggcttttacttaccaacacagagttctagctttttctgtaaatggcgtggctgttgcatgtcattatgacagttgctgagatatgtgaatgcaaaccagcacccgggggagcagagcaaatttaagtttctgggaaagctacaagctagccaccattgcaatcaggaagcaatccttagtcccatttctcacctcattccaactgggacccattcagtcacccctagagaaacttgatgctatgagcacttagccaatktaagctgagtatttcacatcctttgactgactcttactcctccaaagtcaaggttaagccatgtcactaaagatgctttggaaatattccgcttcctaaattgcaaatagttctgcaagcaatgcaaacagaacatttaagttctcaggactgtcaaaatgacaccttcatcagcttccaaatctggtaattattgtcttcctcacacccacgaaaaggactgaaattgagtggatctcacaaggttctcagctctggtgtcttttttggtaggtgtgggaagaagggacaagaaaacat

SEQ ID NO: 140709 - DNA, 601 bp, Human
gaatccaggaaggaggaaaagtcaatgaagaatacataactgatttccgattgcagagaggtaactgggactcagtccactgagaacttctaagcgagagtaaaatgctctccagaatggcccccctgaaggacaatgagctagagtacttaatcctcgaccccccttcaccattggtggagagggcattaagtttcctctatttggagacaggcctggatggagtaaactccttcaagggagaaccgtgaggcagaagagagaaggcaaacaggctggatgcataagcactgtccaccasagctgcagctgaagtctacagtgggtcagggagatgcatgcagcctggcacccaaaaagtgccagccagagttatgtgtgggtataagacaatgcagcatggcaagctacacctacttttcaaaaagcacgatttccttcagtttatcccgtgtcccggggattttaattaataaacagtgcacatttactccctgtattattagtttatcttacaagaattaagaacaaaatgcaagagcaactatagctttgggacgttgttagcatgtaactatggcaagaaaagaagtatgataac

SEQ ID NO: 140710 - DNA, 601 bp, Human
gagactctcccaaggaatgagagaatattcaaaaattagtttaataagatgacagataagcccattcaaaaccttgctaatatctgtttgaaaggtcattttaaaatgttgtcttctgattgggagatggtgaattgtgtggctatataaaatggcattatccagcaggaacaaatttgcagtgtgttacatatggaatacaaattatactaaatttctttcaacaaaaattgcatgtctaagtcctatttatcttagacctttggttacatttgaaaatatctcagaggagcctgctccygatgaagctcagattctctctagcatgctcccatcaagctagcagtgatgaactctctttagagagaaggcttggactctgaacactggaggtgagcagctcatcaccttctaactcagagttcggctccagactagtcttaggactctgagtacagtagttccattttggagatccaatttagttcttattaatcaataacatttaatccaaaatccaaattctggaacccatcctgaagaaccagttttcccagaagctggtctgcacagttctgctaagctcactgtgaaatctctt

SEQ ID NO: 140711 - DNA, 601 bp, Human
tagagagaggaggctctggtttctcctcttcttctataaggacactaatcccatcatgggggctccaccctcctggcccaatcacctcccaaaggccccacctcccactaccatcactttgggccttaagatttcaacctatgaactggggagagggaggcataaacatgtagttgatagcaattgcccagcaccccttccatatctattatgagttttttccctcaatccacaaaagtcttcaccaatcgcctcaagactcttacctcatctctcttcttttaccattagcagaggtgamtagagcaactgacaattcctcaatatcctgttccaccccacaaatacctcttttcattccatttcagtggaagaaagtatcccttcttcttctaagattgatcttctcacctgtgtttggaatcccaatttctctggcctcagtacgaatctggttccatatgctctcttgactataacttcaacccacacctctctttgagctgttagccttaacacacaaacacttcaaagaataacaacacttccctggccttgcctcttccagctatcaacttacttctatctgtccttcatagcc

SEQ ID NO: 140712 - DNA, 601 bp, Human
agttagctggagctgctataaaaaaaatcaagcactgagtggcttaaacaacaaagatttatttctctgaattttggaggctgagaagtccaagaccaaggtagtagagtcggggtctggggaggtcccagttcctggtttgcagaaggccacctccctgccatatccttgagtggtagagagaggaggctctggtttctcctcttcttctataaggacactaatcccatcatgggggctccaccctcctggcccaatcacctcccaaaggccccacctcccactaccatcactttgggcmttaagatttcaacctatgaactggggagagggaggcataaacatgtagttgatagcaattgcccagcaccccttccatatctattatgagttttttccctcaatccacaaaagtcttcaccaatcgcctcaagactcttacctcatctctcttcttttaccattagcagaggtgaatagagcaactgacaattcctcaatatcctgttccaccccacaaatacctcttttcattccatttcagtggaagaaagtatcccttcttcttctaagattgatcttctcacctgtgtttggaatc

SEQ ID NO: 140713 - DNA, 601 bp, Human
acccttctggaaggaagagatggaggaacaccaagtgctgacaaccagtgcgctgttgggtcaaatgcaaagaggaaactgaattcctcaacaaatccattagtgggaaattcattccaattttccaacatgaaaagtaagggatggattttcaaaattaggtaaagtatgaatccaaatgaattattctatttgctctgcagacaacctccgcaacatatgagcactactacaccaaccaccttgagctcttggtacaaattaattgacaatgatggataggctacctgaacttcaaaamgtaagtcttaatatggcaatgatattctttacagtatactcccgtagctcagtggggggcagcactacaatctctgggcttggttgagttcagagaacactctgttccattctgtttctctctctccatgggctattttgcctgcctttggatggtctctaccgcagacatcatcctcaaaaaagcctcaggacagaaaagcctggacattcctgagcataataaatcgggatgatggatccaaaagaaaggcactttgttgatgttttgaattaagtcaaagaaaaaagcattaacaag

SEQ ID NO: 140714 - DNA, 601 bp, Human
ctggtggatgaaaaagctactacatgcacttccttaggcatatgaagaagagcattattccctaagctatcatcttgttctacggtactgaccttacatcaaaataaagcacttatttaccttgtgtgatctactttcacaaggtggcacaatagtgcccattgctgttagtctcatttctaagaatgctcttgtttcatatgaaaaaaaagtaatctaaacactgatatgccttttacttatatacccaacacctggaggaaatatttatacagtagacagaataagcatctggtttgartttccaaaatggctccttccaactcaagaagagcctctgtctgtattttatgggtcagtgataagtgttcatattatttaccgatttatgatgaggtttaccaagatgtgaaatctcagctaacccttcaacccactcccaatcccactcccatctctaagccaccaattattccactccacattattaagcaccatactagaatcatctatagctattgatattggggtcacatttagcatactcatcaacctcatataacctggacttaggaagtacccttgatttactttcagagct

SEQ ID NO: 140715 - DNA, 601 bp, Human
agattattttcttgggctagattcccatatattcttgggtcaaagtatatgaatgcttttaagcctcttgatcacattgccaaaggttgtacagaaaaactctgccaatttacatacctattagctcaatgtgaagtaccaactctcagctttatcaccaacaatacgacaaacagggacctaagggtctaattttttaatctgttaatttgatatgccaatagtagaaatccaccgctgccttaattttctttttttttttttgccaatgagcaagaatgtgagtatatataatgctacrtattttcataagtatacttaacctactgtctctgagtgaggaatgtccatccacatctaaataacagagactgtggtgttcatgtctctaatctctttttggaaagtcttatgacattggcacctaaggtaatggctctcaacaacggcagaaaatctgaatcatctctggagcttttgaaaaatccatttacactccagaaactcaagctcagtaaaggttctagtatctacattttctaaaaattccaaagtcgttctattaggcaaatgaatgagacgactgagctaagactaccct

SEQ ID NO: 140716 - DNA, 601 bp, Human
ctcatgtaaataatgctggaattctattagtctgcaattcagattattttcttgggctagattcccatatattcttgggtcaaagtatatgaatgcttttaagcctcttgatcacattgccaaaggttgtacagaaaaactctgccaatttacatacctattagctcaatgtgaagtaccaactctcagctttatcaccaacaatacgacaaacagggacctaagggtctaattttttaatctgttaatttgatatgccaatagtagaaatccaccgctgccttaattttctttttttttttttgccaatgagcaagaatgtgagtatatataatgctacgtattttcataagtatacttaacctactgtctctgagtgaggaatgtccatccacatctaaataacagagactgtggtgttcatgtctctaatctctttttggaaagtcttatgacattggcacctaaggtaatggctctcaacaacggcagaaaatctgaatcatctctggagcttttgaaaaatccatttacactccagaaactcaagctcagtaaaggttctagtatctacattttctaaaaattccaaagtcgttct

SEQ ID NO: 140717 - DNA, 601 bp, Human
aattagctttaaataaatgtgcaataccacaagataggaaagtaataaccagtcggtccagagctctatcgaatcataatgccccctgaatttactgggctcccctaaccagccatttaaacctacgaattgcttgaacatggagcaattgttttaacatgctttggaaatgttgacatgcaacgaaagagatactaacaaacacaaacagtccattccaaaaacccagggaaaattcataaatacattgttatggctcttagtaggctttaggaaaagggctattgtcagtaaatgatcrgatttacctaacttaatgagaaattatgagcttttctcaaccaggtacctttagagctttccatcaaagtattgactaaaaaagacaatgtcagacagatggcctgtgagcctcaactaatacaggttcacttttgaaagagatatcttctagaatactaacatattaaacaaccagcaactttgggaatcattatcctatccccaaccaagcctatcaacttcttaaagtttggggagaagaacaaaaggcctagaagaagaaagtcatttcagaaccagtagagtcatctgcttcctt

SEQ ID NO: 140718 - DNA, 601 bp, Human
taaatctttcgcagccatgtatctcacggcacccctatagtcactggatttctgaactttgcgtgggagagcaagctataaatactacctgaccctctggtcttgtgtacttcagaaatccattctcttttaaactaagaaaggcaatagtatcataattttcaaaaacattagttttaaaaaaattatttctaatagcttgttactcttttaatatcaaattagctttaaataaatgtgcaataccacaagataggaaagtaataaccagtcggtccagagctctatcgaatcataatgycccctgaatttactgggctcccctaaccagccatttaaacctacgaattgcttgaacatggagcaattgttttaacatgctttggaaatgttgacatgcaacgaaagagatactaacaaacacaaacagtccattccaaaaacccagggaaaattcataaatacattgttatggctcttagtaggctttaggaaaagggctattgtcagtaaatgatcagatttacctaacttaatgagaaattatgagcttttctcaaccaggtacctttagagctttccatcaaagtattgactaaaa

SEQ ID NO: 140719 - DNA, 601 bp, Human
cctttccccaagaggcgcaaatggaaacaaactgaattacttgatctaaatgccaattctcagaagtgattcttgcatcaaatatttaaggaaaataacattcatctacatagaaaacagtataaatttggagccaaataataaaaataatgtacattggtactgatagaaagtagaggagaatgtaaaaaaaatcaaggacctcttatatttgtaggtatgtctcgtaagtccaaaagtataaaaaagccataaactttggtcacacacacacacacacacacacacacacacacacacacacagggctttgcaagttatttagtaatgcatttttcttcataacagaaaatgaactctcaaatttttaagatagattgaaaaatttaaaatagcaagatccaaataaatctttcgcagccatgtatctcacggcacccctatagtcactggatttctgaactttgcgtgggagagcaagctataaatactacctgaccctctggtcttgtgtacttcagaaatccattctcttttaaactaagaaaggcaatagtatcataattttcaaaaacattagttttaaaaaaattatttctaa

SEQ ID NO: 140720 - DNA, 601 bp, Human
ttggatggaaaattagttggagcactaagtccaaagcctttccccaagaggcgcaaatggaaacaaactgaattacttgatctaaatgccaattctcagaagtgattcttgcatcaaatatttaaggaaaataacattcatctacatagaaaacagtataaatttggagccaaataataaaaataatgtacattggtactgatagaaagtagaggagaatgtaaaaaaaatcaaggacctcttatatttgtaggtatgtctcgtaagtccaaaagtataaaaaagccataaactttggtcwcacacacacacacacacacacacacacacacacacacacagggctttgcaagttatttagtaatgcatttttcttcataacagaaaatgaactctcaaatttttaagatagattgaaaaatttaaaatagcaagatccaaataaatctttcgcagccatgtatctcacggcacccctatagtcactggatttctgaactttgcgtgggagagcaagctataaatactacctgaccctctggtcttgtgtacttcagaaatccattctcttttaaactaagaaaggcaatagtatcataat

SEQ ID NO: 140721 - DNA, 601 bp, Human
ttctaattctcctttcatgaaatgctgacaagcccaagatggtagtcagtgactgcaaatctccacctaaacccatcatccccattaaaaacacaacagtgctatgcacatgttagcctgcttactttctgaaaccaaagactatgggccaaaacaaaatgtttgtgagctaaaaacacatacacagataaattgccaattttacacagctttttcaaagcccaaatgaattcaaagaaaaatcttcaactctattgagtttttgagcttaagtagatcattacaaagagaaaaatatccrccaccttttagccaagtccataagtaattcctcatgaagatttggatttttgatataatttctcttagttctcagtctgattggtcatttcctttgcagtattggatggaaaattagttggagcactaagtccaaagcctttccccaagaggcgcaaatggaaacaaactgaattacttgatctaaatgccaattctcagaagtgattcttgcatcaaatatttaaggaaaataacattcatctacatagaaaacagtataaatttggagccaaataataaaaataatgtacattggtac

SEQ ID NO: 140722 - DNA, 601 bp, Human
aggctaaaatttagcaaggttcttcaactagaaattatacctcacagcctcccttgcaactagatgtgactgtgttcttgccaatacaataggagtgaaagtcatgtgtccaacttacacattacacccttaaaaagatactgactgccagccgggcacagtggctcacacctgtaatcccagcactttgggaggccaaggcgggcagatcacgaggtcaggagatttagaccatcctggctaacacagtgaaaccctgtctctactaaaaatacaaaaaaatcagccaggcgtggtggckggcgcctgtagtcccagctacttgggaggctgaggcaggagaatggcctgaacctggaggcggagcttgcagtgagctgagattgcaccactgcactccagcctggacgacagagcgagactccgtctcaaaaaaaaaaaaaaaaaaaagatactgactgccttcccattcctttggatgtggtgctgatgaaacaacttccagcatacagatgaggaactcaccttagggaagaaaagttaataggataaagaagcttctgcattgttagatgaaagagaaaggcatttccatcttatt

SEQ ID NO: 140723 - DNA, 601 bp, Human
cattccatagaagatcctcaacaaatattggttaaggaactgaacagcaaacatgaaaacaaaattcacactgtgagccttgatgtcgttgcctccatcataatgcagcctagtctagtagacatttgaggccttaaagtcagtcagtgagccaaggaaatctgtgaggtcaatttcagagccgctgcagatttagaaaacaaatacaaaatggaaactgatgtcaggaattcaggtctgagcggaactcctgtcggtggtaggggctcttcttgggtggaatctatgggaagaggggatrttggtagataatggatagatggtagcaataaggtcctgaggtattttcctcagaacatatttttggagaaacacttatttacctttgaaaaagtgtgccagagcatgtatcccttaaaggcaggaactatgttttactcatcttgttgatatacccctcttttgatgcagtgcctattacaacttaaaaatagttaaagtttaataactacattgcaaaaagccaactaagctggtataatatagataatcttcacagtagagcattcactgaaggaaccacatgtctcaagcaccaggc

SEQ ID NO: 140724 - DNA, 601 bp, Human
cactaacttctccaaccccctcagacattagccagtccttctcccatacttccataacactctatctcccacacctctaccagtgggcgaatcacataatagtgtaattctttcattacaagatgaacagctcaagagcaagaaccatgtcttactcagcttcacaccccacatgcttcattccatagaagatcctcaacaaatattggttaaggaactgaacagcaaacatgaaaacaaaattcacactgtgagccttgatgtcgttgcctccatcataatgcagcctagtctagtagayatttgaggccttaaagtcagtcagtgagccaaggaaatctgtgaggtcaatttcagagccgctgcagatttagaaaacaaatacaaaatggaaactgatgtcaggaattcaggtctgagcggaactcctgtcggtggtaggggctcttcttgggtggaatctatgggaagaggggatattggtagataatggatagatggtagcaataaggtcctgaggtattttcctcagaacatatttttggagaaacacttatttacctttgaaaaagtgtgccagagcatgtatcccttaaaggca

SEQ ID NO: 140725 - DNA, 601 bp, Human
ggtcaaatgtaaatgtcactaacttctccaaccccctcagacattagccagtccttctcccatacttccataacactctatctcccacacctctaccagtgggcgaatcacataatagtgtaattctttcattacaagatgaacagctcaagagcaagaaccatgtcttactcagcttcacaccccacatgcttcattccatagaagatcctcaacaaatattggttaaggaactgaacagcaaacatgaaaacaaaattcacactgtgagccttgatgtcgttgcctccatcataatgcggcctagtctagtagacatttgaggccttaaagtcagtcagtgagccaaggaaatctgtgaggtcaatttcagagccgctgcagatttagaaaacaaatacaaaatggaaactgatgtcaggaattcaggtctgagcggaactcctgtcggtggtaggggctcttcttgggtggaatctatgggaagaggggatattggtagataatggatagatggtagcaataaggtcctgaggtattttcctcagaacatatttttggagaaacacttatttacctttgaaaaagtgtgccagagcat

SEQ ID NO: 140726 - DNA, 601 bp, Human
atttcaagggaaacatcatttatagtgcgttgatggagtttttggttttggttcttggttttttagtgttgaggacaagaacccatgatctttcacacttcaccctttgcacaagatgtcccctctgtcagggaggccaccttcactctgtcccctaccccgactgcttctatttggtgaactcattccttctttaaggtcaaatgtaaatgtcactaacttctccaaccccctcagacattagccagtccttctcccatacttccataacactctatctcccacacctctaccagtgggygaatcacataatagtgtaattctttcattacaagatgaacagctcaagagcaagaaccatgtcttactcagcttcacaccccacatgcttcattccatagaagatcctcaacaaatattggttaaggaactgaacagcaaacatgaaaacaaaattcacactgtgagccttgatgtcgttgcctccatcataatgcagcctagtctagtagacatttgaggccttaaagtcagtcagtgagccaaggaaatctgtgaggtcaatttcagagccgctgcagatttagaaaacaaatacaaa

SEQ ID NO: 140727 - DNA, 601 bp, Human
gttcagattcagattcttacgaactaaataatctaggtgtgacatagagttgttttaacagagtctttatttcaagggaaacatcatttatagtgcgttgatggagtttttggttttggttcttggttttttagtgttgaggacaagaacccatgatctttcacacttcaccctttgcacaagatgtcccctctgtcagggaggccaccttcactctgtcccctaccccgactgcttctatttggtgaactcattccttctttaaggtcaaatgtaaatgtcactaacttctccaaccccctcagacattagccagtccttctcccatacttccataacactctatctcccacacctctaccagtgggcgaatcacataatagtgtaattctttcattacaagatgaacagctcaagagcaagaaccatgtcttactcagcttcacaccccacatgcttcattccatagaagatcctcaacaaatattggttaaggaactgaacagcaaacatgaaaacaaaattcacactgtgagccttgatgtcgttgcctccatcataatgcagcctagtctagtagacatttgaggccttaaagtca

SEQ ID NO: 140728 - DNA, 601 bp, Human
tcctgttcagattcagattcttacgaactaaataatctaggtgtgacatagagttgttttaacagagtctttatttcaagggaaacatcatttatagtgcgttgatggagtttttggttttggttcttggttttttagtgttgaggacaagaacccatgatctttcacacttcaccctttgcacaagatgtcccctctgtcagggaggccaccttcactctgtcccctaccccgactgcttctatttggtgaactcattccttctttaaggtcaaatgtaaatgtcactaacttctccaaycccctcagacattagccagtccttctcccatacttccataacactctatctcccacacctctaccagtgggcgaatcacataatagtgtaattctttcattacaagatgaacagctcaagagcaagaaccatgtcttactcagcttcacaccccacatgcttcattccatagaagatcctcaacaaatattggttaaggaactgaacagcaaacatgaaaacaaaattcacactgtgagccttgatgtcgttgcctccatcataatgcagcctagtctagtagacatttgaggccttaaa

SEQ ID NO: 140729 - DNA, 601 bp, Human
ccccttcactctctccaagttggccttcttggacacatcacaccccttcccaccactgggctttgttgcttctgagccccttgcctagagccccacacctcctctcaatctgcccccattagtttgcattagtgcaattggtgaattaatagctgtcttttaaatgtgagttctgtgggaagacagaccaggatatctttttacacaccattatatccccactgcctagcacataggctttccacaaatacgtgaatagttaatgatggccctgagctccttggctacctttgcactttgsttgacaaaacagtgcagtgactggcaaaagagctcacaaagtgaaatatgggtattttttagagctaagaaaacccagaacatgagcatccctaaagggtccttaccaaactgtcttcatgtcctgattgggacacaatggtcctgttcagattcagattcttacgaactaaataatctaggtgtgacatagagttgttttaacagagtctttatttcaagggaaacatcatttatagtgcgttgatggagtttttggttttggttcttggttttttagtgttgaggacaagaacccatg

SEQ ID NO: 140730 - DNA, 601 bp, Human
aaagagtaaacaaaactgtttaacgtaaaattagtaaaactttattttctattttgttactgcttttaggtaacaatttatgtttttgcctcccaggagtttttctctttgatttgataacacgattaataataagcatccataaatgcttgtttagcacctaatatttcctctaaacaaaaatcagtcagctccatttcaaaatctttcggtggcttcccatcgaaaaacccaaatccttaacaaggtctagtgtgtagtgtggccccaacacttctcttctgacagccctcattttgcragcctttccccttcactctctccaagttggccttcttggacacatcacaccccttcccaccactgggctttgttgcttctgagccccttgcctagagccccacacctcctctcaatctgcccccattagtttgcattagtgcaattggtgaattaatagctgtcttttaaatgtgagttctgtgggaagacagaccaggatatctttttacacaccattatatccccactgcctagcacataggctttccacaaatacgtgaatagttaatgatggccctgagctccttggctacctttg

SEQ ID NO: 140731 - DNA, 601 bp, Human
caattacagcttcgaattgttgactggtccacactactggagagactggaatgtgaagatcaatgagaaatgatggcatctccctggggacagacagggatggcgtggcagcaacactgaagatcctgaagacagaaattgaaccaaggagatggttgcaatcaaagctctcacattttgagaagctctgatgagagccagagagtaatttgattccttatctgcaaagcttcagcaggagtgggaggcaggaaagggggaaggaaaggaacagtgtcactcatggagcagggcagaaatraatcagccaccaacttactactcagccttgcgcaaaccacctccctaaaaggtgggactccttcagttccatgattccagatttgctataaagagtaaacaaaactgtttaacgtaaaattagtaaaactttattttctattttgttactgcttttaggtaacaatttatgtttttgcctcccaggagtttttctctttgatttgataacacgattaataataagcatccataaatgcttgtttagcacctaatatttcctctaaacaaaaatcagtcagctccatttcaaaatctttcg

SEQ ID NO: 140732 - DNA, 601 bp, Human
tttgactttaacagttctccagctgaatgatggtcaagaagatgaaagagaaaccaccccgtttctggcctacttctcccacctgaggttacagtgagaacaagtttgaaaaccttggggctcatcttgtgctggtgcttcccaggaacccacctacctctcattactgagtagcctccaaaactgcatagcctcaaggaggctgcctctgattctgagaatgccctgttaaatgtgtttctgactcaactcttttccagttatctctcattatgatcaacagttcaaagtcaaaaaaagmcctatgaaaaagcatcatctctatgattctgtttataaatgccacgtgattcatgatggggaaggtatccttgcaatttgacaaatgcctccactgagctaaattaagtggaggaaatggcatgtccctcaacaaattaggacagctctattttgtatcacaaggacacattattttcagttctttttcatgggcttcaaacttagggatattaagtcccttttccttacccgtgctgggctttatcatagagtgaacccatgaaattgacagtagagtacaaaggacaggtatttctgt

SEQ ID NO: 140733 - DNA, 601 bp, Human
ctcaacttttagatgtgaaatgtttaatgctctttagttgaatgtttttaaatcaactttaagcaacagccaatgtcttcacgtaaattcttcatccccttcccatgcacaaatctttaataatcctgaagtggcattggtcttttccccaaaacccaaatagaaacgtcagactccctccgcctgctgctccacaccgcaactcaggtgacctaggacaggtcccacattgcagcagcctgggatgagtttctctaggtacttagaactttctggtcaaccaaaaaaaaaaaaaaaaaaagctgcagctttgaaacaggagagctttatggcccactctaaaagtagccagctaaattcaggaggacaaagaagctggtgaggagcacagaacatattttagagaagctgcatgactgactgggtaagtaatgacccagaaactcagaggctctaagtcccctgtatcagctttgccactaattggtcagatgactctggaccagtcagtcaccatcttgatgggctctggtttcttcacccgccaaaatgaggtaagaaataacttagggaaagaactctgcaaatctaaagtgcaaca

SEQ ID NO: 140734 - DNA, 601 bp, Human
ctctctgcctcactggcaagaaaagagctctgtgtcccaactggtgaagtttgaaaaggaagccaaaaacttctcaacttttagatgtgaaatgtttaatgctctttagttgaatgtttttaaatcaactttaagcaacagccaatgtcttcacgtaaattcttcatccccttcccatgcacaaatctttaataatcctgaagtggcattggtcttttccccaaaacccaaatagaaacgtcagactccctccgcctgctgctccacaccgcaactcaggtgacctaggacaggtcccacmttgcagcagcctgggatgagtttctctaggtacttagaactttctggtcaaccaaaaaaaaaaaaaaaaaaagctgcagctttgaaacaggagagctttatggcccactctaaaagtagccagctaaattcaggaggacaaagaagctggtgaggagcacagaacatattttagagaagctgcatgactgactgggtaagtaatgacccagaaactcagaggctctaagtcccctgtatcagctttgccactaattggtcagatgactctggaccagtcagtcaccatcttgatgggctc

SEQ ID NO: 140735 - DNA, 601 bp, Human
ttttcaatattctcgttgaagtctctctgcctcactggcaagaaaagagctctgtgtcccaactggtgaagtttgaaaaggaagccaaaaacttctcaacttttagatgtgaaatgtttaatgctctttagttgaatgtttttaaatcaactttaagcaacagccaatgtcttcacgtaaattcttcatccccttcccatgcacaaatctttaataatcctgaagtggcattggtcttttccccaaaacccaaatagaaacgtcagactccctccgcctgctgctccacaccgcaactcargtgacctaggacaggtcccacattgcagcagcctgggatgagtttctctaggtacttagaactttctggtcaaccaaaaaaaaaaaaaaaaaaagctgcagctttgaaacaggagagctttatggcccactctaaaagtagccagctaaattcaggaggacaaagaagctggtgaggagcacagaacatattttagagaagctgcatgactgactgggtaagtaatgacccagaaactcagaggctctaagtcccctgtatcagctttgccactaattggtcagatgactctggaccagt

SEQ ID NO: 140736 - DNA, 601 bp, Human
gagaaaagcctttccacgcctatccaccagacctgttccgagagctctgcttccatctggacaaccccccacacttacagccataaatgcattggcactgagaaagactgctgaggaggtggcactccaggtgtggctttatgtgtcacttcaccaggtcagctatttaggcctagtcttctccattggcttgaagctctgttcacaccatcttgggtaacacatcacattattcttccttataaaaacaaataaactcaaatgagcattcagagtcagttcacccctccgaacatctctstcttcccctgatttatgtgacacggtttcaatcccgcccacctgaaagcctcccatactctcaactgaggattggccagatgcccaactccactcctcatgtttcccaccttcctcacctccacagatgtgcacagcccggaggatctcagcctgctggccaccactgagtcaccaggagtacagcactgcagtacctagcactacccgccatcaactactgccaccgagtcaagtcactgcactcttcacttcccatcttacagaaaaactcagctgtcctgtgacactggacccaaag

SEQ ID NO: 140737 - DNA, 601 bp, Human
tccactggaaccagcctgggctaggtatgggttcatctggaagcacacactccatcatctatgtcaaggtaatacaagaagtaaggtgacgttctgtgtgaaatctcctattcggaagtggggccctgctgtggggcactgaatgatcttttgcacttccttgtaatccagattcttaactaccctcctggacaccaaagcagaagttaatggacttgcccaaaaaggctccacaggactcaagaatctaaaatgtccagcctgggcgacagagcgagactccgtctcaaaaaaaaaaaawaaaagaatctaaaatgcctgactcaagtgtgtttcggcatgtttctttttcctctctcttcacatatagagtatgtgaaacacggaggttacaaactaaaatctagggcactgggagcataacatctacttttggaccaaactcttaagaaagccttgcatcacagtaccaacatctctctcctactgtggggatgtgaggtgctaacagtgtataataatggtttactcttattcggaataaaattgtccctaggcaagatgatcttattacaagcttactgtgtgaaaacattgaaaa

SEQ ID NO: 140738 - DNA, 601 bp, Human
tcagatattgttatacatacatattaagtttgtaaaatttactttgctgtaacttttacatacataaaatttctaacagtattaatcaatatattatgattcctttctatgattgaaaacacttaaagactatattttcctctctggaaattgccctgaatgatgatctgatcatctttttcacaggaaaagatcaggtccctctttctaaatgctttagaatttaagcatttggaaatggaagcaattgtgtcagagaaatgaactattactcctatgtgcaactaaccccggcatcacygtacaatataccctaagaatccgtatttcaagctactcacaattccagaaggtccatgtaggagctttaaattttgcaaagtgtctcctgtgcaggccagttctagtcctagtatgctcaacattttctcaagtaagaacagcatttgacagaatagggtgcaacacacagtagcaggttgagactgacctatttacatatatgtggattgatcatctgaaagggtgtgtagcaatatattaacaatgactatttctgggtggtaggtttttggtaactttctctgctgcgtccatggat

SEQ ID NO: 140739 - DNA, 601 bp, Human
ttatccgcctccctagcaagcacaaggatatatcttcatatttaaaataactttactatatctttgaaaggagcaatcctttattctcttgaggctgctttgcctttcaactctcttgggtatctttgttcacatcaaaagcagctaattttccatctccaaaagctccacagtagacatctcccacttagcattaaccatcaattagcgatgcatggaacatatctgtatatgaatgtaggtgaaggtaccagggtgaacagtacgcatgcatgcagaggtgcacagacattgagacaarcatacatagttccacagcttatagaaaataaatagtttaacacaaagctattcttataataatgtgtacgtacatgtaaatttaagtatgtgcttttatatatacactcagatattgttatacatacatattaagtttgtaaaatttactttgctgtaacttttacatacataaaatttctaacagtattaatcaatatattatgattcctttctatgattgaaaacacttaaagactatattttcctctctggaaattgccctgaatgatgatctgatcatctttttcacaggaaaaga

SEQ ID NO: 140740 - DNA, 601 bp, Human
cagctgagtaaaacaacttgatttttctcagtcaaattccctacacaaaccaggagcaacatttggttttcttctgtggtcagagatgccaacatccagtccttggattctcttacagatcagtcctcattctctataaataggccagaaagactttttgactccagaagagatgctctgatccaccaaaccatagagacctctggccttcttgtttccaaaagaaatctaatccttaaatccctaaagtgtcttctgaaggcccctaaacatataaatccttctgtctgaagtttatccrcctccctagcaagcacaaggatatatcttcatatttaaaataactttactatatctttgaaaggagcaatcctttattctcttgaggctgctttgcctttcaactctcttgggtatctttgttcacatcaaaagcagctaattttccatctccaaaagctccacagtagacatctcccacttagcattaaccatcaattagcgatgcatggaacatatctgtatatgaatgtaggtgaaggtaccagggtgaacagtacgcatgcatgcagaggtgcacagacattgagacaaacataca

SEQ ID NO: 140741 - DNA, 601 bp, Human
gattgatccgaattcttgcctctgtgactcaaaaatagaaaattaacaagaaagcagcaagattgacaagctggaacagcaaattcatgggatctgatcgattcaaggaatttctctctttggctccatgccaattatatctagaaataatttcaatatatattttagaaaaccatcattgctgattgaagagaaagccctgtttgtcatttacttaacacacccctagccaaacaccaacacagctcagctgagtaaaacaacttgatttttctcagtcaaattccctacacaaaccagragcaacatttggttttcttctgtggtcagagatgccaacatccagtccttggattctcttacagatcagtcctcattctctataaataggccagaaagactttttgactccagaagagatgctctgatccaccaaaccatagagacctctggccttcttgtttccaaaagaaatctaatccttaaatccctaaagtgtcttctgaaggcccctaaacatataaatccttctgtctgaagtttatccgcctccctagcaagcacaaggatatatcttcatatttaaaataactttactata

SEQ ID NO: 140742 - DNA, 601 bp, Human
taccaatacatgctgtaaaaatagccacacagttttatcttagactcacgcccttcaaagtcttaaaaagctcaaagttgtcattattttatatgaactgtaagctcctttaggttttacacactaagttgttctgagggcagggcgctagctttacacggcagtgccccagcctcctgtgagaactcggggatccacccaatgaatgtattttttctagtgtggcaggttacagctgttgctgttttcacagccgccagagcctgatgcaaacacatgaaaggcccctaaatcagccgaygtagatgagaacacagagcctatatctgtagcgcttccttggtacaatttttaacttaatgttatggatatctgagttcatggcttcatgattattttaaaggacaagtgggagagggaagagaagagaatgaacgatgataaccagtccagttatatcctcttgtcctccttaagtggccttgttcacctgggtaagagacggtaaaggggagacagtgaccagaatgggagaactgttgacatagaaataaggtccaagctgaaccccacagaaagagaagagctaaggtaatgggaa

SEQ ID NO: 140743 - DNA, 601 bp, Human
ataaaatgtagagcaagagcaagtattggtctatttagatgtcaaaaattgtcacgtgagctatctgggctaccttcttttggcataccaatacatgctgtaaaaatagccacacagttttatcttagactcacgcccttcaaagtcttaaaaagctcaaagttgtcattattttatatgaactgtaagctcctttaggttttacacactaagttgttctgagggcagggcgctagctttacacggcagtgccccagcctcctgtgagaactcggggatccacccaatgaatgtattttttctagtgtggcaggttacagctgttgctgttttcacagccgccagagcctgatgcaaacacatgaaaggcccctaaatcagccgatgtagatgagaacacagagcctatatctgtagcgcttccttggtacaatttttaacttaatgttatggatatctgagttcatggcttcatgattattttaaaggacaagtgggagagggaagagaagagaatgaacgatgataaccagtccagttatatcctcttgtcctccttaagtggccttgttcacctgggtaagagacggtaaaggggaga

SEQ ID NO: 140744 - DNA, 601 bp, Human
gataccttggatcaactcctctgaatgaaaaggctaaaagcaaattcaaaacatcctgttttaaatataagacttttcaatatttctcatgacagacacaaaagaaaaaaaaggacacaggaagtactgataatgtggcaccatttaaaaagagaggaaaatatttataactaaaactatatagttatgttataaaagaatataaaatgtagagcaagagcaagtattggtctatttagatgtcaaaaattgtcacgtgagctatctgggctaccttcttttggcataccaatacatgctrtaaaaatagccacacagttttatcttagactcacgcccttcaaagtcttaaaaagctcaaagttgtcattattttatatgaactgtaagctcctttaggttttacacactaagttgttctgagggcagggcgctagctttacacggcagtgccccagcctcctgtgagaactcggggatccacccaatgaatgtattttttctagtgtggcaggttacagctgttgctgttttcacagccgccagagcctgatgcaaacacatgaaaggcccctaaatcagccgatgtagatgagaacac

SEQ ID NO: 140745 - DNA, 601 bp, Human
gagtggataccttggatcaactcctctgaatgaaaaggctaaaagcaaattcaaaacatcctgttttaaatataagacttttcaatatttctcatgacagacacaaaagaaaaaaaaggacacaggaagtactgataatgtggcaccatttaaaaagagaggaaaatatttataactaaaactatatagttatgttataaaagaatataaaatgtagagcaagagcaagtattggtctatttagatgtcaaaaattgtcacgtgagctatctgggctaccttcttttggcataccaatacrtgctgtaaaaatagccacacagttttatcttagactcacgcccttcaaagtcttaaaaagctcaaagttgtcattattttatatgaactgtaagctcctttaggttttacacactaagttgttctgagggcagggcgctagctttacacggcagtgccccagcctcctgtgagaactcggggatccacccaatgaatgtattttttctagtgtggcaggttacagctgttgctgttttcacagccgccagagcctgatgcaaacacatgaaaggcccctaaatcagccgatgtagatgag

SEQ ID NO: 140746 - DNA, 601 bp, Human
aaaaagtaaaatagaaattttcctggctgatagatatgcccaatagaaggcaaaattttttaagtcttatggagatttaaaaagatctagaaacaatttcaactacaaccttatcactcaccaaacttttcaacaaagctgccaatagagtaataacgtagaaggtcagaatctttttcctatatgatgctcaggctaaaaagaaaagagagattaaggaataacaggcataagaaaggcaaaataagagaactgttgtttttttttttccacaaactacacagacaagctcctgagtaaytgacagttgccaatctccatgtctgagtggataccttggatcaactcctctgaatgaaaaggctaaaagcaaattcaaaacatcctgttttaaatataagacttttcaatatttctcatgacagacacaaaagaaaaaaaaggacacaggaagtactgataatgtggcaccatttaaaaagagaggaaaatatttataactaaaactatatagttatgttataaaagaatataaaatgtagagcaagagcaagtattggtctatttagatgtcaaaaattgtcacgtgagctatctgggc

SEQ ID NO: 140747 - DNA, 601 bp, Human
atactacaacattttttcataatacaaagtacaaaaagtaaaatagaaattttcctggctgatagatatgcccaatagaaggcaaaattttttaagtcttatggagatttaaaaagatctagaaacaatttcaactacaaccttatcactcaccaaacttttcaacaaagctgccaatagagtaataacgtagaaggtcagaatctttttcctatatgatgctcaggctaaaaagaaaagagagattaaggaataacaggcataagaaaggcaaaataagagaactgttgtttttttttttccacaaactacacagacaagctcctgagtaattgacagttgccaatctccatgtctgagtggataccttggatcaactcctctgaatgaaaaggctaaaagcaaattcaaaacatcctgttttaaatataagacttttcaatatttctcatgacagacacaaaagaaaaaaaaggacacaggaagtactgataatgtggcaccatttaaaaagagaggaaaatatttataactaaaactatatagttatgttataaaagaatataaaatgtagagcaagagcaagtattggtctatttag

SEQ ID NO: 140748 - DNA, 601 bp, Human
ttcaaaaccacccaaaaagtaagttctatcattattgacagggatgaggaaaccaaggcacagaaagtttaagaaatatgcccatggccacaaagtaggaaagggaaagtcaggattcaacccctggcaatatggcgctgtctccacattttttttttttttttttttttttttgagacagggtctcattctgtcaccaagcctgaagtgcagtggcatgatcaggcctcactgaagcctcaacctcctgggctcaagcgatcctcctgcctcagcttcctgagtagctaggactacaggyacatgccaccatgccccactaattttttttatttttatttttttgcaaagatggggttttgccatgttgcccagactggtctcaaactcctgagctcaagcaatctgcccatctgtgcctcctaaagtgctgagattacaggtgtgagccaccgcgcctggtctgtctccactttcaatcatgacactattatactacaacattttttcataatacaaagtacaaaaagtaaaatagaaattttcctggctgatagatatgcccaatagaaggcaaaattttttaagtcttatggagatt

SEQ ID NO: 140749 - DNA, 601 bp, Human
tgacctcacgatccacccacctcagccttccaaagtgctgggattacaggtgtgagccactgcgcccagcctcccagcattatttcaattacactttaccacatgcttttctaaaacaaaatacaatgaactaatcataaggcctttggggattactgaattctttcacctgtcaaccactataagattgttggaaatcactgtcaaaaaccatgcaagggctctgaaaataaaccaaaaaacttggtgggactatcagaacctatagaaggaggagcatatttagttactgaaactgtargtatattcattatatgtataacaataatggcagataatatatatctgattttaagggctttatacacattaactaacttaatcttcaaaaccacccaaaaagtaagttctatcattattgacagggatgaggaaaccaaggcacagaaagtttaagaaatatgcccatggccacaaagtaggaaagggaaagtcaggattcaacccctggcaatatggcgctgtctccacattttttttttttttttttttttttttgagacagggtctcattctgtcaccaagcctgaagtgcagtggc

SEQ ID NO: 140750 - DNA, 601 bp, Human
acaggttcttaattctatcacttggatcaatagaaccattgaatcaagtaaaccccaagacattaatctccaggacatcatttgaagttagatgatattaagctatcaataataactctttggaaataagctagggaactaatctgtttatgcactaaccattttagcatgacattcgccatagttttctagcttgacaaatacttgcctccagcccttacttcatgcgaacattatttaaagggatgtttgagagattgggctcaagtcaggactgactttttctctctcatctttgcaycctttcactttatcatagagggaacttaaccaggtgaggcacaattattccttttaaaagtaatgaatgacttttaaaattaatgactgtctcctagaattgattgtattcctggggtttttcaactgatgaattattggttttaggacatcccaaaggataataataatgagctgaagaaaattctgtaaagcaagaaaacactgaacaacaaatattcttgatgattaagcaggataatcacaaaacaataatttaaaatatttttatatcaatactctggtagtgtagagctcagat

SEQ ID NO: 140751 - DNA, 601 bp, Human
actatcatgtggtcttttctttttgaaatctaatgtctacccagccttccttgatctgtgtgctttcattccttaccctgctctgcaatatcctagcacttcacaaagggccctgtgcatcataattaaattttctgtgctcccctaccttatcaacttcaccttggttccgttcctatattcgaagcgttaacaacatgatcaagtgagatgatttgaaaatttgatcaacaggttcttaattctatcacttggatcaatagaaccattgaatcaagtaaaccccaagacattaatctcsaggacatcatttgaagttagatgatattaagctatcaataataactctttggaaataagctagggaactaatctgtttatgcactaaccattttagcatgacattcgccatagttttctagcttgacaaatacttgcctccagcccttacttcatgcgaacattatttaaagggatgtttgagagattgggctcaagtcaggactgactttttctctctcatctttgcatcctttcactttatcatagagggaacttaaccaggtgaggcacaattattccttttaaaagtaatgaatga

SEQ ID NO: 140752 - DNA, 601 bp, Human
caataaagtacaaaatatgactttagggatatgacaatacagaaaaataccgccattggcactctaggaatatgcattatgttttacgtaccaaatttttgggttttagttaactaaatatgaaatgtgactatcatgtggtcttttctttttgaaatctaatgtctacccagccttccttgatctgtgtgctttcattccttaccctgctctgcaatatcctagcacttcacaaagggccctgtgcatcataattaaattttctgtgctcccctaccttatcaacttcaccttggttccrttcctatattcgaagcgttaacaacatgatcaagtgagatgatttgaaaatttgatcaacaggttcttaattctatcacttggatcaatagaaccattgaatcaagtaaaccccaagacattaatctccaggacatcatttgaagttagatgatattaagctatcaataataactctttggaaataagctagggaactaatctgtttatgcactaaccattttagcatgacattcgccatagttttctagcttgacaaatacttgcctccagcccttacttcatgcgaacattatttaaa

SEQ ID NO: 140753 - DNA, 601 bp, Human
tgggcgcggtggctcacgtctgtaatcccagtactttgggaggccaatgcgggcagatcacaaggtcaggagatcgagaccatcctggctaacacagtgaaaccctgtctctactaaaaatacaaaaaattagccaggcgtggtgacgggcacctgtagtcccagctacatgggaggctgaggcaggagaatggcgtgaacctgggagacggagcttgtagtgagccgagattgcgccactgcactccagcctgggtgacagagaaagacaccgtctcaaaaaaaaaaaaaaaaaaaaaaatgtgaggaaggctctaggtccacttctactacagattgcgtcattctaaacaagtggcctaatctctctgggcctcaactgtttcatctttgatatgatgagggcatatggaacttcccaagtttttgtgtgttatttttaaaccaaaacaaattatcacaacagagagtaaataaattcttcctatagaatctggaggtcatatcctaaagttgctctccacaatcaagaaacttctttgaagtcttacatttcaagttaaaaaggttgaactaaattggtttttttctgaaccaaaaa

SEQ ID NO: 140754 - DNA, 601 bp, Human
atgacaatggagcacatctaagacacaagttggtctcattcgcactttcctttatcttctcagtctccacagagacctctgggtatttgaaggcagtcatggaagccctcttagcttagcttctcaagctttctccacaaaactaacatttaaatcttttatttgctcctattgctagacattttgttgaagtgctgaaggtcttcgtcaaagcaacagtacaggaattaaaacccaggagactgattgcagtgaaactattcccacatatgaaagccaacacacatctccaaaggaagaygaccaacaacagctccttcagagcctcaccagcatcttcagaggtgtgctttaagaatggcttcaggctgagcgcagtggcttatggctgtaatcttagcactttgggaagccgaggcaggaggactgcttgagcccaggagtacgagatcagcctgggcaacacagtgagaccctacctctacaaaaaaataaaaaattagccaggcatgatggcatgcacctgtagtcccagctactcaagagaatgaggtgggaggatcacttcagcccaggaggtccaaggctgcagtgagccatg

SEQ ID NO: 140755 - DNA, 601 bp, Human
cactgagaacagcctggctttgaccctgcagacactgctaaaagcaaggagaaaatctacttcccccgagttcgccttatcttaagaatcatggctattcagagaggggaggtatctgctggctgggcacataaccaccaccattgcgatcggtcccagggagggcagtgaagcaaaaggccaccatgaacatcaccaatgagagcaccttctgttccagagactggaggggcatgctcttaccatatcccagtgatgggttacatgtcccaatccttggccaactggtccaccagtcaasggttagtgctctttctgcactcaggattccagcatctagtgagggcatgaatctactcccttccacattttgtaagtcttagcaatggaaagtaagggccttcattatatccatcctaatcctgatcacagctttcagaattccattagtttcacttgtttccccaaaagacactcccaaaatttctaattaaagtataacacatgtatagaaatgtgcacatatcatacatgtagatcaatggattttcacatattttacacaccataaaaccagtagccaaagttgatttttaaatac

SEQ ID NO: 140756 - DNA, 601 bp, Human
tataaaaattagaaatcaattttaagtagattattttaagtccttaaactgtgaaaatgaaacaatccaagcagtcttcatgtaacatgtatgctagcttagctttcagaaagccccttaagtatatttaaagacatatgcagtacctctctagtgagtgtctctgtataccatatgccaggcacacacccttccaggagtaaacatctgaaccttagaatcttatcaaaataaaccacaactgagactcatggcaatcattttattccttattgctggaattgactctctcttgtggccrctggcacagttctgtaagcataaggaccagctctcaccactgagaacagcctggctttgaccctgcagacactgctaaaagcaaggagaaaatctacttcccccgagttcgccttatcttaagaatcatggctattcagagaggggaggtatctgctggctgggcacataaccaccaccattgcgatcggtcccagggagggcagtgaagcaaaaggccaccatgaacatcaccaatgagagcaccttctgttccagagactggaggggcatgctcttaccatatcccagtgatgggtta

SEQ ID NO: 140757 - DNA, 601 bp, Human
tagagacagggtttcactgtgttagccaggatggtctcgatctcctgaccttgtgatccgcccacctcagcctcccaaagtgctgggattacaggcgtgagccaccggtgcccagccaacaagtcagcaacttttaaataagcacctcacaatttcagagctgcacctggtttaattaattacactcgtcatttcctcactggttggtgcaaaccattcccatcttactatgcactgagaacatcaatatcatagagctatagcattcatccactcattcaatattaacttattgtgtatyattgtgctatgtcttttttaattcattctctacccttgcatagttggagttgagggaaggaaggcagaaaagaatggtaagacttgatccttgccctctagagtcctatgtttgcagaaataagatgcagacacatgaaatggtgaagaagccatccaagactgcaggtggctaatgcccaagtgaatggggcagatgctgctatgggaattcagaagaggctggaaaagcagaggaacctcatagaagaagtggaataagagttggactttgattgggtgcagtggctcacatctgtaa

SEQ ID NO: 140758 - DNA, 601 bp, Human
atcatcagtaggaattcaaaaaggaaatggaggcagtaatgtgagaccaacatgttctcaggattctgccagtgcaaaggaagctccctcctgcctacgggatctgtccaatacctgctggtgtgggtcccacggccatgtccgacaccagcaggtccccatccttactcgtgtgcccgtaccttgtttgctccttctcttgttctgtttcctcattcagcctgccatgctctcctttcaagccctccaactcctcccttccctgttttaggaagacagtctagagtaggacacttgggtwcaaatcctggcttgtcttctagctgtatgaccctggacgaatcatatgactttttttatgcctagaaaatgtgtgacaaaaatatctacatcataaggtcattgtgaaaattaagggaaagaatttgtgtggagcacaattgtccaaatccaaacagttagtaaacggaaagcattgtaagtccagttctttttacaaacacaaagtccatcctcttactctatgctccctcctggtggtttcaaatgcacagatctcctcctgatttcactctaagaatttttctactaggaatatttt

SEQ ID NO: 140759 - DNA, 601 bp, Human
cagaggccggcccacaggcttcaaggaaaggcatcttgaaagatgcctgcagactgcagcagttggcttctgccacagatgcacctctgtttcttcctaacataaaagactaacgaggaagctggagtcctctgcacaaggaagctgattaaacctccttcctctggtcttcaagaaggaggctttctgagagaactttctagtaaacaaagctgcaaaaaaattccttaggcatactgagaactgaaaaagggctttgtagggcttggaaagtagcaaggcataattgaatggcctggargctctgggtatgaacatcaattctgccatagactgtgtgtcatttaccttctctgtgcctcagtttcctcaactgtaaaacagggataataacacctacctcaactactcttttgagaattaaatgatatatgtatatacaccatctagggtattcagaatagtgaagggcactattcacattatttaataactactgtgatacaaatatcaactaatcagagtaaacaacgatctaaaccatccactcagaatggaatcagccacgtcctacctacgagatgtataaataacatacaaa

SEQ ID NO: 140760 - DNA, 601 bp, Human
ctgacctcaagtgatccacccacctcagcctcccaaagtgctaggattacaagcatgggccactgcatcctgcctgaactgttcattttaaaatggttaattgcatggtttgtgaatctcacctgaatttctaaaaattaaaaaaaaaaacaactaataaccaaatgtcaccctcttctttcccctacccaattccccctctaatcgatctctgatgactcaagtgctagatggctgacattgactgaggaagccctccagagccagcacacagccccagacgaccacattttccaatttmttttaaggatgctaagaatttaaaggagccagcagcatcagaaagatcagtgagaataggtttcggtgtgctcctttgagtgatggaacctgatagtttaagagaatgagatatatcataagtcagggcaataagatgaggtccaggcaaggggagacatggaaagaaagcttagctcccactgcagcttagctcccatcacagaggccggcccacaggcttcaaggaaaggcatcttgaaagatgcctgcagactgcagcagttggcttctgccacagatgcacctctgtttcttccta

SEQ ID NO: 140761 - DNA, 601 bp, Human
aaaaataaataaataaaaaataaaataaaaatagaaaatagtcttctgagaggaaaccaccccaagagaaggactggaaagaaagggacaaggccagagagatagagatgaaagaagagattatttccatcatcctagtgggagatggacctggggagacattaaaaaaaacctctgcccctacacatacagagccatatttttatttctcaataaaggcatcctaatgtacatttttagccttgttccaagatgcacagagtttctatagagacagtcatatgtcctttcctgacttcaytgatgtctgctctaaagatctctatcaaaactaatggcccatgcttcaggccctatggaaagtcttctggcagtttcacaaaaagttaaacagagaacaaccatatgtcccagccacttgactcctaggtatatccccaaaataactgaaaacaggaactcaaacgaatacttgtccatgaatgttcccagcagcactattcacaatcaccaaaaggttgaacaaacctagatgctcatcagcagatgaatgtgggctatctaaccataaatggaatattattcagtcataaaaaaggaa

SEQ ID NO: 140762 - DNA, 601 bp, Human
aaacagagtaagcatccctgcccttacggagcctagtaaaagatacagagaagcaaacaaggagttaaagtgcagaggaaagtaccaaaagttcagactagggaattatgagaggcttctggcaggatgtgatgttgagtcaggccttgaaggagatggaacagttagttcggtagccaaaagaagacacatatgcaaaggcaagaaggtataaaacagcatggtccgttcagggacctaccaagtaggtgatgtggctgatatgcaaggatggctgtgagaaagagggagaagccgaggytgaggtcctagcaagggccatgatgtcaaggtcctgatgtgccaaggaaaggcatctgcaatgggttctgaaggccatggaggactactgaagggtttcatataggtaaataacatgatcagatttgcattttaaagagacagtattctggccaggtgcggtagctcacacctgtaatactggcactttgggaggctgaggcggtggatcacttaaggtcaggagttcgagaccaacatggccaacatggagaaactctgtttctactaaaaatacaaaaattagcctggcatggtggca

SEQ ID NO: 140763 - DNA, 601 bp, Human
tttcctcttcttctcttcctaccttttctccctgacttcctccttctttgtcccttcctctttccttccatactttaattcaattaacacgtatgatacctattgctttcaaataggtatcaaaataaataggtaacaaaaaaaaaaaagtgccatcctgacctaagaggactgacactcagttcagtcaacaactactttgtgagtttctttttgccaagcaaggctgcaggtatttcagacacatgatggactaaacagagtaagcatccctgcccttacggagcctagtaaaagatamagagaagcaaacaaggagttaaagtgcagaggaaagtaccaaaagttcagactagggaattatgagaggcttctggcaggatgtgatgttgagtcaggccttgaaggagatggaacagttagttcggtagccaaaagaagacacatatgcaaaggcaagaaggtataaaacagcatggtccgttcagggacctaccaagtaggtgatgtggctgatatgcaaggatggctgtgagaaagagggagaagccgaggctgaggtcctagcaagggccatgatgtcaaggtcctgatgtgccaa

SEQ ID NO: 140764 - DNA, 601 bp, Human
gagaataaattgaatgatagtacatttgtttaaaggtagatgtcattggtatctacttcctgtctttcccagtttcattcattcccctacctctttctgcttgctctcttttttggtttttggtctttttctttgcctgacctgctttcttctttcctcttcttctcttcctaccttttctccctgacttcctccttctttgtcccttcctctttccttccatactttaattcaattaacacgtatgatacctattgctttcaaataggtatcaaaataaataggtaacaaaaaaaaaaaagtgccatcctgacctaagaggactgacactcagttcagtcaacaactactttgtgagtttctttttgccaagcaaggctgcaggtatttcagacacatgatggactaaacagagtaagcatccctgcccttacggagcctagtaaaagatacagagaagcaaacaaggagttaaagtgcagaggaaagtaccaaaagttcagactagggaattatgagaggcttctggcaggatgtgatgttgagtcaggccttgaaggagatggaacagttagttcggtagccaaaagaagacacatat

SEQ ID NO: 140765 - DNA, 601 bp, Human
actgcactccagcctgggcaacagagtgagatcctgtcaaaaaaaaaaagaaaaaaagtctaaaatgacagatgtaatggaagcagcagttcctgccaagtgccctgtacccttgggtattttgaaactactagttcccctgcccctggccacagtacagagtgtaagtggaataaggtgggactgggaggcattcattcctgggatttaagccctccacttctccagcttctctcctccacccttctactctgcaagcacacagtttaatgtagtaattatgagatctagagaataaatkgaatgatagtacatttgtttaaaggtagatgtcattggtatctacttcctgtctttcccagtttcattcattcccctacctctttctgcttgctctcttttttggtttttggtctttttctttgcctgacctgctttcttctttcctcttcttctcttcctaccttttctccctgacttcctccttctttgtcccttcctctttccttccatactttaattcaattaacacgtatgatacctattgctttcaaataggtatcaaaataaataggtaacaaaaaaaaaaaagtgccatcct

SEQ ID NO: 140766 - DNA, 601 bp, Human
aggctgcagtgagccaagatcgtgccactgcactccagcctgggcaacagagtgagatcctgtcaaaaaaaaaaagaaaaaaagtctaaaatgacagatgtaatggaagcagcagttcctgccaagtgccctgtacccttgggtattttgaaactactagttcccctgcccctggccacagtacagagtgtaagtggaataaggtgggactgggaggcattcattcctgggatttaagccctccacttctccagcttctctcctccacccttctactctgcaagcacacagtttaatgtartaattatgagatctagagaataaattgaatgatagtacatttgtttaaaggtagatgtcattggtatctacttcctgtctttcccagtttcattcattcccctacctctttctgcttgctctcttttttggtttttggtctttttctttgcctgacctgctttcttctttcctcttcttctcttcctaccttttctccctgacttcctccttctttgtcccttcctctttccttccatactttaattcaattaacacgtatgatacctattgctttcaaataggtatcaaaataaatagg

SEQ ID NO: 140767 - DNA, 601 bp, Human
tccgcatcacacatagaataagtaacttcagaaacaggtcccaagtggcctgagaatgtctatgcacttttcaaaagcgctgccagaaacgtttactgcacggctcccttggtagggagaaggttctttcatttgcaaaaagctgcgaggtcgtccgggtctggcagcaaggcttctatttgggaatggacactgccagttccacttgcctcttctgagaccacccagcacttcctgcaggcacctgccccggagcccagcagaaagagagataagatcagatttcactcactattatgaraatgtctatttgttggctaataagtccctggtttataaaaaacaagcagcagtagcttaaaaagggaagagaaagcaaaccagagtgcagaaatggcatactgaggagtcttggctgaggctgccggaggtaggcgagggcattctggtgctccactgaggagctcaggccttcaagaagccaatgactcacttggcggctttcttgggctttcagtttttggcatgcataaggcaatgtgggtatggatgatagtgtcattggtgtatttattgcatttggattggttgccttaaaatc

SEQ ID NO: 140768 - DNA, 601 bp, Human
ttaaatatactgctccctgctgcccctagcggattctgagtggagttctagaaactgcattcctaaccagtttccctaggcagggggagtgggggacgggattctattgcagagtggcctgtggaccacactttaagagtcgctgctataagaattccgcatcacacatagaataagtaacttcagaaacaggtcccaagtggcctgagaatgtctatgcacttttcaaaagcgctgccagaaacgtttactgcacggctcccttggtagggagaaggttctttcatttgcaaaaagctgygaggtcgtccgggtctggcagcaaggcttctatttgggaatggacactgccagttccacttgcctcttctgagaccacccagcacttcctgcaggcacctgccccggagcccagcagaaagagagataagatcagatttcactcactattatgagaatgtctatttgttggctaataagtccctggtttataaaaaacaagcagcagtagcttaaaaagggaagagaaagcaaaccagagtgcagaaatggcatactgaggagtcttggctgaggctgccggaggtaggcgagggcattc

SEQ ID NO: 140769 - DNA, 601 bp, Human
gagtaaaactctgtcgcaaaaaaaaaaaaaggctcccaatgaggcttcagtgaccaaccttcctgtttgcctgggacttcagtgtttcccaggacacaggacagtcccaggcaaaccctgatggctagtcacctaaggggcctcaaaatcctacattactcactccactaaaggttgttactgagatgcaaatgttatcagaaggctgttggatgcactttaaaccattagcattccttaacaatatataatgagatcatcaatttagcaaaattctgagaacgtgagccacatgacagayacattctgatggacaaccagcagagaaagatcagagcttcagggtgtgtcctgagcaccccagggctccagcagggcacaaggcacctggtacaatggggtggaaagcagggccagcatgtcccatggggaggagagaaagaaaaaagaaaacaccgtcccagggatataagctgtttctctcttataatttcatcaaatttcatacaaatttcagtgatgaaatttcatcaatacaatttcatcaatctcttcaatagatccttatggaaggaatattatgactctgaaggacggtgat

SEQ ID NO: 140770 - DNA, 601 bp, Human
attgggccaatattaataagaataggaagaaaatggcataatacattaacataacataaaatgtcaggatttcctcattagctattcacaggagatggggtaggggtgtaagcttcgcttgcagtctgggtttctctgttctcagtagaacttccagtaaatattgaacttagtcccaataagtgactgagacactcggtgtctcaatgtatttgtttgttaaaatgatttccaaacaaacaaaaagttcatcaaaaggaaagctatctgggatagtggaaaatactcaggttttgaagayagttttatcccaggactacctcttgcacagcagccttacacacaggtagaacaggcagactcctgccaactttagaaattccagaaatcctcctctcctgcctgcacttgcccaggggtgtctctatttctgtttcctcatcttaacaatggggataggccgggcatgatggctcatgcctgtaatcccagcactttgagaggctgaggtggggactgcttgagcccgggagttcaaggtggtgaaaccttgtctctacaaaaattataaagattagctgggtgtggtggtgtgtgccat

SEQ ID NO: 140771 - DNA, 601 bp, Human
cctgccaccatgcctggctaatttttgtatttttagtagagacagggtttcaccatgttgaccaggctggtcttgaactcctgacctcaggtgatccgcctacctcagcctcccaaagtgctgggattacaggcatgagccaccgtgcccaacttcgtctcaatttttgaaaagggaaaaaaaaaaagaattgtaagactagcatctcccctcaagaatcttattgctatggtctgatcaagatgataagacttaccttcattcatccaacaggtatttaccaagtgtgcatttcatcctrgacatacacataataccaagtaatgtacaaacaatgcaaagcaccttaaggttatgtgctaaattgtgttatgtaccaaaaattaatgcctagaattaatggaaaggagtgagtgctggcttcttgaaggagatacagctgttctggccatggaagataatactatgattgtaaataaaaaatgaaaaaaagagagcctttagacagaaaggatgaaaaaaggccccaaagtaaccctaacatggaggggatgctaggcagcaaggactccaccatgatttcaatgctcttcttttctaa

SEQ ID NO: 140772 - DNA, 601 bp, Human
ctacaacttagagtttctaaaagtaaaaaactggctatgtttataaatccatttcaaaggatctgggtaattagttattagttactatctagtcacagcatgctatggaggaaccatcaggtaattgttagcaaatgcctatttgagcatcttctgtccagttgtcatgcattgtgtaaaagtttaaattataagcactgaattgttcagtttaaaatggttaatttttttttttttttttttttttttagcttgcgtctcgctctgtcgtccaggctgaaatgtagtggtgtgatcttgrcttactgcaacttcagcctcctgggttcaagcaattctcctgcctcagcaacccgagtagctgggattacagatgcctgccaccatgcctggctaatttttgtatttttagtagagacagggtttcaccatgttgaccaggctggtcttgaactcctgacctcaggtgatccgcctacctcagcctcccaaagtgctgggattacaggcatgagccaccgtgcccaacttcgtctcaatttttgaaaagggaaaaaaaaaaagaattgtaagactagcatctcccctcaagaatcttatt

SEQ ID NO: 140773 - DNA, 601 bp, Human
gtctctatggcatgggagtgtctaatactttcagaataaggcttcctagagtctacaacttagagtttctaaaagtaaaaaactggctatgtttataaatccatttcaaaggatctgggtaattagttattagttactatctagtcacagcatgctatggaggaaccatcaggtaattgttagcaaatgcctatttgagcatcttctgtccagttgtcatgcattgtgtaaaagtttaaattataagcactgaattgttcagtttaaaatggttaatttttttttttttttttttttttttagcttgcgtctcgctctgtcgtccaggctgaaatgtagtggtgtgatcttggcttactgcaacttcagcctcctgggttcaagcaattctcctgcctcagcaacccgagtagctgggattacagatgcctgccaccatgcctggctaatttttgtatttttagtagagacagggtttcaccatgttgaccaggctggtcttgaactcctgacctcaggtgatccgcctacctcagcctcccaaagtgctgggattacaggcatgagccaccgtgcccaacttcgtctcaatttttgaaaa

SEQ ID NO: 140774 - DNA, 601 bp, Human
ggtgaagatcttttgtcaactataaggcattaaggaatacaagggagggttatgtgatattaactgtctatggtgggcaaacatacctttgccaaatggtggtatgattataaaggatcttggaatagagatgcatgaatatattgtcaccagggctatagtgctcttcttttaggctgtccaaatagactaggaaaacagccgaaacagagtatctcttgtccaactcagtcctggtctggctgggttcatttttgacatttccttgcaggtagtaaatgggaatgtaccttctaagtgytacttcctcatccagaagaactctctgtctctatggcatgggagtgtctaatactttcagaataaggcttcctagagtctacaacttagagtttctaaaagtaaaaaactggctatgtttataaatccatttcaaaggatctgggtaattagttattagttactatctagtcacagcatgctatggaggaaccatcaggtaattgttagcaaatgcctatttgagcatcttctgtccagttgtcatgcattgtgtaaaagtttaaattataagcactgaattgttcagtttaaaatggtt

SEQ ID NO: 140775 - DNA, 601 bp, Human
agcaaaaacaaaagctacacaaatggaaggaattaagaaacaaatatggaaaaaaatgatttcatatttcttaaagaaaaaaaaacctagcctctttggcttttataagagcctggctgagaagtatataaaattttatatccaaaaatctgcctaatttctaaattttactcgttagttttgaaatcaatctaaaaaaattgttctagcctaataaaatttgcccaaataatgattcttagtttatctacatgattggcaagtgttaacataaatatatgtgcacaagcaaaaagcagaytaataataatggaatcaagttttcttaagaggtatggctctttctagttaatgtaacatttataaacagatcatgttctgagtccttactctatatactggagacatgaggtacaaggtgctaacttcaaaccaaacagcatgacacaggagcctccttgaatttctagaatctcccccaaagaggaacctctgaacttcagtaggatttatacagaaaatgggtaagtggtaccagaagagagaaatgacatgagcaaaggtaaaaaggcaggaaagggttaagtgttgaggaaataga

SEQ ID NO: 140776 - DNA, 601 bp, Human
caggatattctctgcttgttctgtggacacatgccatctcttcaaaagacagtaaggcatcctgaccatgtctcactttacaatgagctagtattttgattatttactaaataatcaacattgagctgtacatgcattattttatatatgcctcaccacaacctttgagggtgttggttttattgtaactgtcatccctcttgtaacagatagaaaaactgtggctcaaaaagaccaagcaatgcattcaagatcacacaactagaagcctggactcaaagctgggtctgagcaacatcargtcttctgtgtgaaccaccagaccctactacttctactcaggctccccctcacaggcccagaaggtggtgccatggtcagtaaagcacagttttgcaatattttcattctttaatcaagttgtactggcacttgatatcaaactccatatattttgagggttttaaaaaaaattgtagggtcacattaaagaaactattgaagcaattttttaaatgatggataagattttctaaggcagctattcctaagacatagcaactcaatatataaaatttcagtgatcaaattcattaaagca

SEQ ID NO: 140777 - DNA, 601 bp, Human
gttattaacaggatattctctgcttgttctgtggacacatgccatctcttcaaaagacagtaaggcatcctgaccatgtctcactttacaatgagctagtattttgattatttactaaataatcaacattgagctgtacatgcattattttatatatgcctcaccacaacctttgagggtgttggttttattgtaactgtcatccctcttgtaacagatagaaaaactgtggctcaaaaagaccaagcaatgcattcaagatcacacaactagaagcctggactcaaagctgggtctgagyaacatcaagtcttctgtgtgaaccaccagaccctactacttctactcaggctccccctcacaggcccagaaggtggtgccatggtcagtaaagcacagttttgcaatattttcattctttaatcaagttgtactggcacttgatatcaaactccatatattttgagggttttaaaaaaaattgtagggtcacattaaagaaactattgaagcaattttttaaatgatggataagattttctaaggcagctattcctaagacatagcaactcaatatataaaatttcagtgatcaaattca

SEQ ID NO: 140778 - DNA, 601 bp, Human
caagctaagtatgaatatgacacaataccattttctgtaaaaataaacaaccaaaaatatgacaagaggtatttgcacatgattgagcatgaagaaacatacagaaggagagacaccaggctgttaatgttgactttaatattggagaagataaaaatggaaggaagctggggagagacagctaacttttgcttttatatatcactgagttgttacaataagcacataaaatataaaaacattttaaataacttttataaattgtaataaaatatatattttaaaatataactaaaattamaaattataagagtgggggaactcagtaaaatgggccactgagaaagtaacacatcttggaagaaagaatctgtgccaggatgacaaatttttaccagatctcaaggctacagatgaaacatgacccataaactctgaaatatccagttaatagcagtcgatataccccacaagagggaaggagcttcaccagtggagctcgaggttatagacaatgctagagaacacatatctgatatgagttgaattatgtcccctgaaaaagatatgttgaagtcctaacctccagtatctcagatgt

SEQ ID NO: 140779 - DNA, 601 bp, Human
ggctcacaaaaggaacatggcaacatcaaattcatgacattcagacatcattaaattacaggctcaaagaagctcccaaagcacatttggaagctcccccttggtcccaggaactctctgtcatttttatgaaggcataaggcaaccaagtggcaatgggggggtgacctctttcatcactctaggaaatccttctagatattcctgtaactgttaagaactgacatttcaggattttttttctttaaaaataatattgttcaagttgcacagtaagcaaacaaaaaagatgagttctacytcttctcaacatttcatacagctcaaaatggaaaaatggcaatctaaatttccattagtaagttaacgactaaaaaactatagtataccagtatattatgcaactattaaagagagataactctccctctattgatgtggaagcaagctaagtatgaatatgacacaataccattttctgtaaaaataaacaaccaaaaatatgacaagaggtatttgcacatgattgagcatgaagaaacatacagaaggagagacaccaggctgttaatgttgactttaatattggagaagataaaaa

SEQ ID NO: 140780 - DNA, 601 bp, Human
ttagctttaaaatccagggtctgtttactgtgttctaattatttttcctgaatggcctgcttatccagtctagttggcaacagcatgtgtagtatgtgacacataaaggcttactttcaggctcacaaaaggaacatggcaacatcaaattcatgacattcagacatcattaaattacaggctcaaagaagctcccaaagcacatttggaagctcccccttggtcccaggaactctctgtcatttttatgaaggcataaggcaaccaagtggcaatgggggggtgacctctttcatcactytaggaaatccttctagatattcctgtaactgttaagaactgacatttcaggattttttttctttaaaaataatattgttcaagttgcacagtaagcaaacaaaaaagatgagttctacctcttctcaacatttcatacagctcaaaatggaaaaatggcaatctaaatttccattagtaagttaacgactaaaaaactatagtataccagtatattatgcaactattaaagagagataactctccctctattgatgtggaagcaagctaagtatgaatatgacacaataccattttctgt

SEQ ID NO: 140781 - DNA, 601 bp, Human
tttctatagacaaactaagccccgaagttgccctaaagtggcaagtaacatttagttaagcttagctttaaaatccagggtctgtttactgtgttctaattatttttcctgaatggcctgcttatccagtctagttggcaacagcatgtgtagtatgtgacacataaaggcttactttcaggctcacaaaaggaacatggcaacatcaaattcatgacattcagacatcattaaattacaggctcaaagaagctcccaaagcacatttggaagctcccccttggtcccaggaactctctgkcatttttatgaaggcataaggcaaccaagtggcaatgggggggtgacctctttcatcactctaggaaatccttctagatattcctgtaactgttaagaactgacatttcaggattttttttctttaaaaataatattgttcaagttgcacagtaagcaaacaaaaaagatgagttctacctcttctcaacatttcatacagctcaaaatggaaaaatggcaatctaaatttccattagtaagttaacgactaaaaaactatagtataccagtatattatgcaactattaaagagagataa

SEQ ID NO: 140782 - DNA, 601 bp, Human
ttaaaaaactctggtcataatataccagaaggctttaatgacccacaaatgggttataacctgcagtttgaaatcattagcctatgtgaattaggaaacaaaagataccattgtctttgttctgtaatagcacacaacatttatcaacatggaaaataaatctccatagtggaaaggaaggggcaacaattaccattatttgcagataatatgactgtatacctgggaattccaagagcatcaactaaaaaaactaagaactgcataaattgattactacattaatatgttaaaactaatmgtttccttttatccaactaataacctgacagaggacaaagagaaaaaaacagcaaccatttaggataaaaacaaaatatgtagaatacttggggagaaatttccaggctctatatgaagaaaaacaaatctcccctgataatcataaaataattgaatagaaggtcatgctttgttctagggtgagaagactcaatataataaaaatataatctttcccatattaaatttaatataatcataatcaaaatacaaacaagatttggggaacattttcacaaaatcatacacagatttatac

SEQ ID NO: 140783 - DNA, 601 bp, Human
ttacatctgtattttgactcctccctaatgcagcattttcttcaactaataatataatagcagcatctgttacttcatagcctatagaaattgtggatattttcatattacattatagttgttacatatatctcaaaacatcatgctcattactatttcaaatttacagtaattactgtacccatcactaggtctcatgtgactgtgctcttctgctctacaagtgctccgatggaaggaaacttcttatactgaagagtgacaggttttggaatcagaaaccttgatttaaatccttgamtgctacttactaactttgcctttgggtgtctaactctctaagcctcagtttcttcatttgtaacatgctaccgtatcacaacagtggaaagttattttgatcagtatattaatatcctgtgtttcttttttagccttatgtttcactttaagcactttaaaacattattctgagaaggagtccacggcttcaccagaccattaaaggtctttatggcacaaaaaagttaggaatttttttggaaatgtttctgaaaatgtaaggcagaaatggataggagaaggagaaagaaacatccac

SEQ ID NO: 140784 - DNA, 601 bp, Human
ccatcccatcttggtctttatttatgtgctggatctctcacctgctagcttggctttcaacacattgctgtctagacttgaacttccgtgctttgctccccagtcttggcagcaggcccatgaccccgtgtagccccttgctgagcacatgacttgctgttatagaaactaggtgcagggagctggaggaagcctgggtggaggcccggatggcatctagctgacattccattcttcaagtacaaaatatcagtcttggccagataatttcagactggcctacagaattctaatgggaaaygtttttgctaagcatcagccaataaaagctcatttacaaaatgcaagaagaaccataagactaaggaaacttggattctattcctaaccctcttgcagattggctgggtaaccctaggaaagttcctcacctctaaaaattgatctgtttcctcacgactaaaatgtggaagactgggaaattgtttcctgatttcatggacccaacactaagtaaagtaaaattaaagcaaggtaatactttcacatactcaggcagtataattcggtaatttctagtaattctccatgagtttccatc

SEQ ID NO: 140785 - DNA, 601 bp, Human
actgataagtaaatttacctttttatttattttatttttgagatgggggtctccctctattgcctaggttagagtcaatgacatgatcatagctcattgcagcctcatcctcctgggctcaagggatcttctcacctctgcatcctaagtaactgggactataggcgtgtgctgccttggctggctaattttataattttttgtagggatggagtcttgctgtgttgcccaggctggtctcgaactcctggcctcaagcaatcctgctggctccacctcccaaagtgctgggattaaaagmgtgaactatgatacccagttaataagcaactttaactcccatttctcatgaaacccaacatattcacagattccagggattagtatgtggacatctttgggcagccattgttctgcccagcatgaggagtttagatgaaatttgccctgtgtgaggcaggggcttatatgattcatgacatttccagtatcagatctttggcatgtatagtctgaagttttctgacaatcagaactttccaaaagatatttaccaagacagttgcagtttgtggactccagcagctggtaaaactcacaa

SEQ ID NO: 140786 - DNA, 601 bp, Human
ctagtcatgcctcactgacctttcttcatctaagagtttattacttacctattgctgctgtaagaatgaccacaaacttaatggcttaagccaacacaagtttaatattttgtagttctggatgtcagaagtccaaaatgtatctcactggcctaaaatcaaggtgtcagcaggactgtgttccttctggaggctctaagggaggatctgtttcctggccttttccagcttctaaagccagccacctcccttggctcataggccccttcctccatatttgatatggtttggctctgtttcyctacccaaatttcatgttgaattgttattcccagtgttgggggagggttctggtggagggcgattggattatggggctgatttttcccttgctgttcttgtgatagtgagttctcacgagatctggttatttaaaagtgtgtggcacttcgcccttttctctctctctcctgctccaccacggttaagatgtgcctgcctccccttccccttcgccttccgccatgattctaagtttcctgaggcctcccagccatgcttcctgtacagccttcagaactgtgagtcaaacctcttttct

SEQ ID NO: 140787 - DNA, 601 bp, Human
gcctgtatgaggattctgaggacaaaacatgctttccaagctacaggcaggcttatatccctcattacagccatcaccagccatgctgtcacctccagggtgagattgaggcaagagaggtctaagatgcaaaatgtaacagggcactcctacctcactcttaagggggcactccccctcagggtcctgcaagtacagggatggcttgtgatagtccagagagagagcgcctcctcaaatgtctacttaggctcctcactgcctcgccatactcccagccctgtttacctctccttttttkcctccctcctaccttgacgccccccttaatttgtacatcattcctccatgtacacttttaataaccaggatctagccatgccaaaagaaatcattaagactggatccaccttaaaagaggtatgacttaagtgcaagtttggaaaacaaacaaacaaacaacaacaacaacaacaaaacctgaattatttcctcacacaaaaactagaatatatcttggaaagttcagacgagactcacttcctaaatagctcatttttcttcctgtccatgacaaccacaaaagccaactataaagcca

SEQ ID NO: 140788 - DNA, 601 bp, Human
ctggccaggtgcagtggctcatgcctgtaatctcagcactttgggaggctgaggcaggtggatcacctgaggtcaggagttcgagaccagcctggccaacatggtgaaaccccatctctactaaaaatacaaaattagcaaggcatggtggcaggtgcctgtaatcccaactacttgggaggctgaggcaggagaattgcttgaacccaggaggtggaagtgcagtgagctgagattgcaccactgcactccagcctaggcgacaaagtgagacactgtctcaaaaaaaaaaaaaaaaaaagaacatttctgaaatgaacactgtagtttacccctaaacttctccttccatatgctttggctatgcactactagaaaggcattaaggagaaagttggctggaaaccccaatgcactgacaactaaaggaggtcttttatcttaactccccctctcaatatggcagaaacaaatgttttgaaacaaaagtgaaaaaggctgggggggaaaagggtgctactgagttccacattaagatacaacagccaccctcaaccatatgtactggtttgttatctgccaaaatatgtagttggccatt

SEQ ID NO: 140789 - DNA, 601 bp, Human
gtataaaaccactaggtctccttaatatgcggtttgctttttcaaaattaaatggatatatttagaaacatgtttgtgtttttctcattaacaagaaactatttaccaaccaaacaaatatagctttcctttaaaacaaatgcttcaataagaaggcagctaggatgtgggggtattaatacaatgttaaacaatatgtataaactgagtttgggtcatatgccccttgaatatcatatccctgctatgaaagactgaaatcataatggataaaaagatgactgccaatttggaaggcacygggaaaactcaagcaaaacctgtttggctcttagtataatccctatataagacaggttctggagtataaggaatagaaaacaaacacctggaaggactcttcccaaggtgagctcgggtctagacatgtgggttaataaagcgtactgccacacaggattgtggactaagtaaggcaatccacataaagagctccgcacagggcagacccagtaaatgtttaaaaatatatttgctacagtgaggatgatgatgaataccagatatacacaagatttctggccaggtgcagtggctcatg

SEQ ID NO: 140790 - DNA, 601 bp, Human
cttggccccacccctattcctggatcctttcttaaggtttttcaggcctctttaaatgattatattctcttatctccttttttatgcataaaattagagacttatggtcctcttgtgtgtgatttcctgataaaacccctctctttgttatagagaaaacaaataaatacatgagatatcaaaaaagatataaattgaaccagtttactctgtatttacataaacacttggaagaatgaaagtgcttgaggcataaaattattcatgcctattttaaaaggtttccatttatgaaaaaaaagagaatgtcatagtggaataaagtatcaccagttttaaaatagtcgactgaaaaatgttaaatcttatcttgattacaaattgttgaagggaaggaattatgcatatttatattgatataaggactgtgaagtacttgatcacccacatagaaagccaaaatattgaaactacgtacaatacctgactgcagagccacaagaggaaacatcagactactattctggtgcaaagcaaagctttttaaactatgggtttagaacagtggttcccagctggaggcaattttattcccccaagg

SEQ ID NO: 140791 - DNA, 601 bp, Human
taattggggcatttagcccatttacacttaaggttagtattgctatgtgtgaatctgatcctgtcatcatgatgctatttggttattttgcacaatagttgatgcagtttcttcataatgtcattggtctttatattttggtgtgtttttgcagtgcctggtactggtttttcctttccatatttagtgcttctctcaggaactcttacagggcaggactgggggtaacaaaacccctcagcatttgcttgtctgagaaggattttatttctccttcgcttatgaaccttagtttggctgratatgaaattctgggttgaaaattcttttaagaatattgaataggccaggtgtggtggctcacgcctgtaatcccaggactttgggaggcagaggagggtggatcatgaggtcaggagatcgagaccatcctggctgacatggtgaaaacccatctctactaaaaaatgcaaaaaaatcgccgggggtggtgatgggtatctgtagtcccagctactcaggaggctgaggcaggcgaatggcatgaacccaggaggcggagcttgcagtgagccgagatcacgccactgcactccagcct

SEQ ID NO: 140792 - DNA, 601 bp, Human
tttgctgaagtgttttacttccaattatgtggtcaattttagaataaatgccaggtggcactgagaagaatatatattctgttgatttggagtagagagttctgtagatgtctactaggtccacttgatccagagctgagttcaagtcctgaatatccttgttaattttctgtctcgttgatctgtctaataatactgacagtggggtgttaaagtctcccactattattgtgtgggagtctaagcctctttgtaggtctctaagaacttgttttatgaatctgggtgctcctgtactggrtgcatatatatttagaatagttagctcttcttgttgaattgttccctttaccattatgtaatgtccttctttgtcttttttgatctttgttggtttaaagtctgttttgtcagagactagaattgcaacccctgctttttttttctttccatttgattggtaaatttttctccatccttttattttgagctttacatgtctttgcatgtaagatggatctcctgaatacagcacaccaatgggtcttgactttatccaatttgccacactgtgtcttttaattggggcatttagcccatt

SEQ ID NO: 140793 - DNA, 601 bp, Human
aagttccttgtaaattctggacattagacctttgtcacatgggtagattgcaacaattttctcccattctgtaggttgcctgttcactctcatgatagtttcttttgttgtgcagaagctctttaattacctatgcctatgtcctgaatggaactgcctaggttttcttctagggtttttatggttttgggttttacatttatgtctttaatccatcttgagttaatttttgtgtaaggcataaggaaggggtccagtgtcagttttctgcatatggctagctagttttcccagcaccacktactgaataggagatcctttccccattgcttgtttttgtcaggtttgttgaagatcagatggttgtagatgtgtggtgttatttctgaggttcttgccccattagtctatacgtctgttttggtaccagtaccatgctgttttggttactgtagccttgtagtatagtttgaagtcaggtagcatgatgcctccagctttgttctttttgcttaagattgtcttggctatatggggtcttctttgattccatatgaaatttaaaatagtttttttctaattctgtgatgaatgtcaatgg

SEQ ID NO: 140794 - DNA, 601 bp, Human
cgtggggtttttcttgtaaatatgtttaagttccttgtaaattctggacattagacctttgtcacatgggtagattgcaacaattttctcccattctgtaggttgcctgttcactctcatgatagtttcttttgttgtgcagaagctctttaattacctatgcctatgtcctgaatggaactgcctaggttttcttctagggtttttatggttttgggttttacatttatgtctttaatccatcttgagttaatttttgtgtaaggcataaggaaggggtccagtgtcagttttctgcatrtggctagctagttttcccagcaccacttactgaataggagatcctttccccattgcttgtttttgtcaggtttgttgaagatcagatggttgtagatgtgtggtgttatttctgaggttcttgccccattagtctatacgtctgttttggtaccagtaccatgctgttttggttactgtagccttgtagtatagtttgaagtcaggtagcatgatgcctccagctttgttctttttgcttaagattgtcttggctatatggggtcttctttgattccatatgaaatttaaaatagttttt

SEQ ID NO: 140795 - DNA, 601 bp, Human
tctgactggcatgagatggtatctcactgtggttttgatttgcatctctctgatgatcagtgatgttgtgttttttttcatatgtttgttggccgcataaatgtccttttgagaagtgtctgttcctatcctttgcccactttttcgtggggtttttcttgtaaatatgtttaagttccttgtaaattctggacattagacctttgtcacatgggtagattgcaacaattttctcccattctgtaggttgcctgttcactctcatgatagtttcttttgttgtgcagaagctctttaattwcctatgcctatgtcctgaatggaactgcctaggttttcttctagggtttttatggttttgggttttacatttatgtctttaatccatcttgagttaatttttgtgtaaggcataaggaaggggtccagtgtcagttttctgcatatggctagctagttttcccagcaccacttactgaataggagatcctttccccattgcttgtttttgtcaggtttgttgaagatcagatggttgtagatgtgtggtgttatttctgaggttcttgccccattagtctatacgtctgttttggtacca

SEQ ID NO: 140796 - DNA, 601 bp, Human
taaacatacatgtgcatgtgtctttatagtagaatgatttattttggggggtatatcaaatggtatttctggttctagatccttgaggaatcgccatactgtcttccacaatggttgaactaatttacattcccaccaacagtgtaaaagcgttcctatttctccacagcctcgccagcatctgttgtttcctaactttttaataattgccattctgactggcatgagatggtatctcactgtggttttgatttgcatctctctgatgatcagtgatgttgtgttttttttcatatgtttkttggccgcataaatgtccttttgagaagtgtctgttcctatcctttgcccactttttcgtggggtttttcttgtaaatatgtttaagttccttgtaaattctggacattagacctttgtcacatgggtagattgcaacaattttctcccattctgtaggttgcctgttcactctcatgatagtttcttttgttgtgcagaagctctttaattacctatgcctatgtcctgaatggaactgcctaggttttcttctagggtttttatggttttgggttttacatttatgtctttaatccat

SEQ ID NO: 140797 - DNA, 601 bp, Human
tctaagatccctcccctcactccccaacccccagcaggccctgtgtgtgttgttcccattcccccttctgtgtccatgtgttctcaatgttcaactcccacttgtgagtgcaaacgtggtgtttggttttcgttcttgtgttagtttgctgaggatgatggcttctagcttcaaggatatgatctcattcctttttatggctgcatagtatcccatggtggatacgtaccacattttcttttatccagtctatgattgatgggcatttgggttggttccatgtctttgctattgtaaatcrtgctgcaataaacatacatgtgcatgtgtctttatagtagaatgatttattttggggggtatatcaaatggtatttctggttctagatccttgaggaatcgccatactgtcttccacaatggttgaactaatttacattcccaccaacagtgtaaaagcgttcctatttctccacagcctcgccagcatctgttgtttcctaactttttaataattgccattctgactggcatgagatggtatctcactgtggttttgatttgcatctctctgatgatcagtgatgttgtgttttttttc

SEQ ID NO: 140798 - DNA, 601 bp, Human
acctgtaatcccagttactcgggaggctgaggcagggagaattgcttgaacccgggaggtggaagttgcagtgagccgagatcatgccactgcactccagcctgggcgacacagcgagactccatctcagggaggaaaaaaacaaaaaaaaaaacaaaaaatgggatacaagtgcagattatgcaggttcgttacacaggtatatgtgtgccatggtggtttgctgcacctactgacccaccctctaagatccctcccctcactccccaacccccagcaggccctgtgtgtgttgttcccrttcccccttctgtgtccatgtgttctcaatgttcaactcccacttgtgagtgcaaacgtggtgtttggttttcgttcttgtgttagtttgctgaggatgatggcttctagcttcaaggatatgatctcattcctttttatggctgcatagtatcccatggtggatacgtaccacattttcttttatccagtctatgattgatgggcatttgggttggttccatgtctttgctattgtaaatcgtgctgcaataaacatacatgtgcatgtgtctttatagtagaatgatttattttgggg

SEQ ID NO: 140799 - DNA, 601 bp, Human
gctcacgcctgtattcccagcactttgggaggccaagggtaggcggatcacctgaggtcaggagttcaagaccagcctggccaacgtggtgaaaccctgtctctattaaaaatacaaaaaaatatcagcggggcatggtggcgggcacctgtaatcccagttactcgggaggctgaggcagggagaattgcttgaacccgggaggtggaagttgcagtgagccgagatcatgccactgcactccagcctgggcgacacagcgagactccatctcagggaggaaaaaaacaaaaaaaaaaamaaaaaatgggatacaagtgcagattatgcaggttcgttacacaggtatatgtgtgccatggtggtttgctgcacctactgacccaccctctaagatccctcccctcactccccaacccccagcaggccctgtgtgtgttgttcccattcccccttctgtgtccatgtgttctcaatgttcaactcccacttgtgagtgcaaacgtggtgtttggttttcgttcttgtgttagtttgctgaggatgatggcttctagcttcaaggatatgatctcattcctttttatggctgcatagtatc

SEQ ID NO: 140800 - DNA, 601 bp, Human
atcccatgccctaagtgttttctcaaattcccttcatttggggcatatttaaatggaagtaagctggtattttagatatttccgcattttctttgaggtgcaaaggtgacaaaggatttaatttttttttaaagaaagggaacaggtgttatgcttgaaaaatattaattggataaatttagaaagaaaaaaaaactttaggtaagtttttaccattgactatccctgaatcctatctatatataaatatatttataaatatatatatttatatatatataatttcttctttaaaaaagarggggctggtgggcacagtggctcacgcctgtattcccagcactttgggaggccaagggtaggcggatcacctgaggtcaggagttcaagaccagcctggccaacgtggtgaaaccctgtctctattaaaaatacaaaaaaatatcagcggggcatggtggcgggcacctgtaatcccagttactcgggaggctgaggcagggagaattgcttgaacccgggaggtggaagttgcagtgagccgagatcatgccactgcactccagcctgggcgacacagcgagactccatctcagggagg

SEQ ID NO: 140801 - DNA, 601 bp, Human
ctatatgtttattccccactagcttgtgtactctgaggtgaaaaccacattttatccatctcttttttttttccttgagttaaactcagtacctagttttataaatgtttactgaatgagaaaacatggaaatgagtaaataatttacaggtaatcagagaacagaggtagggaaaacagaacaagcaaggaccctaatatatgttcaggtattttcatttagggacctagatcagctagctatagacttaaccattcttttctgcatacaaaagctttagtttatgttcatattttttcytgaatcaggtccttaatatactaaccagtaaagaaatagaggtgaataacccaaattactggaaagaaaaaatataggctatcttttaaaataatcttattttggaataattttagatttacagaaaagttgcaaagatagtacagagttcccatatacccttcacccagtttcccctaatgttaacaccttacataaccaaggtgcatttgtcataaataagaaagtaacactggcacgttattattaataaaacgccagtctttatcagatttcactggttttctactaatgtccttt

SEQ ID NO: 140802 - DNA, 601 bp, Human
agaaaatattcatttactttgaggccgggcatggtggctcacacctgtaatcccagcactttggggggctgaggcgggtggataactggagggctggagttccagaccagcttggccaacacagcaaaaccgcatctctactaaaaatccaaaaaaaaaattagccggatgtggtggtgcacgcctgtaatcccagctacacaggaggctaaagcaggagaatcacttgaacccaagaggtggaggctgcagtgagccaagactgcgccacagcactccagcctgagcagcagagagagaytgtcttaaaaaaaaaattcatttactttgaaaagaagaataaaaccgggaatgacactattaaagtgacatttgaaattgtccctgtcaatctccaggcccatcttttatctttctcctcccacatgctctggccaataacatgcttctcacacttttccaaacatatctcatccacactgtgtggcacatagtaggcacccaggtaaaatacttgttgtataaggtaggtacatactctgaaagctccctgctcttgcacaggagactgactcttatttaaaaagccccttttctcctt

SEQ ID NO: 140803 - DNA, 601 bp, Human
tggaagcactttattaacccactggcaaagtcccctagcgaaaatgttcctcaaaacatggaaggctgagtctacttatacctaaacaactaaatgaaaaagggctcttcacgattattagaatttttcattatggataataaaaattaaatcatatctgtcttgacatattctctatgaacaatgaggagcctatgattaattatattttggtttttacatcagccaccaggaagatcagagctcagttctagctttcttcttggtataagattttctgtcttaatttatattttctctgatcttgatattttgctggttactaacttttttgtggcttcatatagtcttctaagctgcctgaaaaacttgtggaatgagttgaggatagaaattaaaaaaaaaaaatccacctagttttcatcaaattgtaccctattgtgtgcaatgaatgaaaatttcctccattatacagatgtctatacagaattcttttgaaccctgggttgctactatcgggttaaaataattgctaatagtttctgttttcagacaggaagttttcaatctctctcgaaggattgctcgccaatttctccta

SEQ ID NO: 140804 - DNA, 601 bp, Human
cattagtaaccttaatattttgtggaaaggttcttcaccaattttagctatgcaggtccaagacaatacaataccatctacaatactacaaaattacaattagaaaaaaaacaaaacaaacaaacaaaaaaaacctccttactagaaaagatcacgaaggagtttttaaaaatgtgcattccgttttgaaaattgctattgaaatgtggtctggtgcttgttccagaagttatttataaccaaagaacataaaaattgacaatgatgggcaagcacaatgcctccctgggtagaggttgargcttatattgagaatgagaatttgaaaaacaagcctttcccattttaagcaatcattgttttaccaaagaattccagagaacttggttttactgcaaattctattacttcattacaaaattggaatacaatggaatctatcaccttgcagaacaaactgccagaaaaataagtctttttgagttattgtcaaagaaggacagtccttgtgagaataagtagatgcagctgaagttggcaacgttctccctagtgggtaacacaacatcaccttttttttttttttttttttttgacaaga

SEQ ID NO: 140805 - DNA, 601 bp, Human
ccttcctccagtgaattagctcatcaatagatccaaggcggtcaaagagagaagccacgtctgctcatcaatttgttggaaacttttttggaccaaacaaatagaaaaaaaagtaactagatgaaaccttgatttaaataagtctgacagagaagctataagttaatttattctgatcattaccttgattcttcattagggaatataaggagaggaggtggttactcatacgagagctggcgtacaataagcagttttgagtggtgccatgaagcttgactacctgggctggaattctagrgctgctccttactagacatttgctttcaagcacaatacttattctttctgggctcagtttcctttctgaaagtgagtataataacctaactcatggagctgccatgaagattatgcactcagaatgtgcaagcactcagccaaggaatcacacaatgcaggttaatgagaacacttcagtatatggaattgtcctggccctttgttttttgggtgaggccaatttgctgttgtaatccctctcttcaaaaagggatagaaatataaaacttaattaattcaagtgagtaggaattaaatg

SEQ ID NO: 140806 - DNA, 601 bp, Human
cacaataaaaacttaagagatagatttcattatccacactgaagtaaacaaggcttagagacactaaataagatgcccaaggtcatgcagctggtaaagtgtggtgaaccctggttggactggctctaaagcccttgctaattaactaataatcatgcccagcagaagtgttggtaggcactgttggatgagcagatcactgaggttgaagacattaaaaaaagaatctctctttctgtctctgcatttagattgaactaaaaattactgagaatgctaggttctctccagcacattatcytgatttctctccaaagctctttcgaggtcctatgagagaagtcaggccacatgctcaaagtcactgggccatgatccactggcgaagctgagacttgcatttcaagcaagaacatctcttggatgatctctaagattcctctgaggtctgttgttaaagatgtcagcctagtgccaggaattaggtcttcaagtgcttggtgatggaatcggtcatttgaattgacatcaaaacacatacaatcaactattactaaagcagtgactaccaaaccttggattttctcttcccttcctccag

SEQ ID NO: 140807 - DNA, 601 bp, Human
tagtcacaataaaaacttaagagatagatttcattatccacactgaagtaaacaaggcttagagacactaaataagatgcccaaggtcatgcagctggtaaagtgtggtgaaccctggttggactggctctaaagcccttgctaattaactaataatcatgcccagcagaagtgttggtaggcactgttggatgagcagatcactgaggttgaagacattaaaaaaagaatctctctttctgtctctgcatttagattgaactaaaaattactgagaatgctaggttctctccagcacatyatcttgatttctctccaaagctctttcgaggtcctatgagagaagtcaggccacatgctcaaagtcactgggccatgatccactggcgaagctgagacttgcatttcaagcaagaacatctcttggatgatctctaagattcctctgaggtctgttgttaaagatgtcagcctagtgccaggaattaggtcttcaagtgcttggtgatggaatcggtcatttgaattgacatcaaaacacatacaatcaactattactaaagcagtgactaccaaaccttggattttctcttcccttcct

SEQ ID NO: 140808 - DNA, 601 bp, Human
gaagcttattgtcacaagacatgcaccctaggttgtgctactccttacagcactgctttcctcgtttgacttttgtggccttgatggtaaccacacgatacccacccctcccatcagcatggaacaaccccatttggagtttggagtggtacaggcccatactctttcctggggtagtgcccttcctctccaatcagttcacagggcaggagatgacagcaaggcttgcttttttgattcctatctgctaattctgtgttctgtgtgttagaggtcattatggcagaggaaaaggttattyttagtttaacctttggaactaggaaatagggttttgattggaataaaacagcactttactgatgttatctaatttagtcacaataaaaacttaagagatagatttcattatccacactgaagtaaacaaggcttagagacactaaataagatgcccaaggtcatgcagctggtaaagtgtggtgaaccctggttggactggctctaaagcccttgctaattaactaataatcatgcccagcagaagtgttggtaggcactgttggatgagcagatcactgaggttgaagacattaaaaaa

SEQ ID NO: 140809 - DNA, 601 bp, Human
cagctcactcttattggatggaagacctaaaattcagccccagctgttaatctgactaaagctcctttttaggtttcaaagagtcgtcaagggtagcaaaggagcatgttcataaaaggctgttaaagggaagcggaagagaatgaatgtttgctcatcccttactaacttatagatattattatcacatcaaccctaagaagtaagttatgattatccaccctgtacggatgaggcatctgaggctcagacaggcaacaagaacatcctcacacaccattccacacaccctcataggtcrctacatggggagcaagggtgtggtagattcattttttaaaatttcccctataaaatctggtgcaaaaacttacattaaaacatcaaacattttagctgccttcagtaaaacaaaataacattcctcagtattttgttaatattaatcaaataccagaatctcactaatttacaatgatagacgtattttttaaaatgccagtctgagatcatgggaagtgaatggcagactgcttttcaaaagacatgttcactatttctgcattcacatggtatctgtaggctaccaaggttttggttt

SEQ ID NO: 140810 - DNA, 601 bp, Human
ttagccaggtgtggtggcagatgcctgtaatctcagctacttgggaagctgagacaggagaattgtttgaacccaggagaaggaggttgcagtgagccgagattgtgccactgcactccagcctgggcaacagagtgagactctgtctcaaaaaaaaaaaaaaaaaaaaagttgcattaagtggactaagcgatcatggaatattcagagaaatatatcactcccagtgggtttgtgcccatttttctctgttgtttgtaatgacttgacaatgcatttttccacattgcagaaggaacayagcccattcttggtgactttcccagatttccccgggtagatgagtgaatataactcactcacaaggttgtcattaggctatctttatcttgacaggctggcccctccctttcttgcaaatgtgcttccttttccttcaccccctttatcaaacatgcccagaactctttgctagggcacctagcctagcagggtccaggctgcgtctccaagtacataggccctacagtgcctggcatggcaggacctcgagtttgttcaaagaaagacacagtcactcccatcagaatctctctcttct

SEQ ID NO: 140811 - DNA, 601 bp, Human
tggccaggtgtggtggctcatgcctgtaatcccagcattttgggaggccgaggcagacggatcacctgaggtcaggagttcaagaccagcctggccaatgtggtgaaaccgtctctacaaaaatacaaaaattagccaggtgtggtggcagatgcctgtaatctcagctacttgggaagctgagacaggagaattgtttgaacccaggagaaggaggttgcagtgagccgagattgtgccactgcactccagcctgggcaacagagtgagactctgtctcaaaaaaaaaaaaaaaaaaaaagttgcattaagtggactaagcgatcatggaatattcagagaaatatatcactcccagtgggtttgtgcccatttttctctgttgtttgtaatgacttgacaatgcatttttccacattgcagaaggaacacagcccattcttggtgactttcccagatttccccgggtagatgagtgaatataactcactcacaaggttgtcattaggctatctttatcttgacaggctggcccctccctttcttgcaaatgtgcttccttttccttcaccccctttatcaaacatgcccagaactcttt

SEQ ID NO: 140812 - DNA, 601 bp, Human
aacaagaccctgtctcaaaaaaataaataaataaaataaaatgtgatcatactggaacagaatctttccactgttggaagtgctgggcttcctagtccaacaatcccagtctctcacaacctagcttagctgtccattcacagaacgctgagcatcagtcagatactggagtggccactacatgaaagagaactgcttatttttctggggattcttgcctcatctgcaaaatgagaatgaagtccttctttgggatagatttgggaatcaataagataacacatgtacaacatagtgtacragagtaatgctgatactactaaaccagcgctgtccaatggaacttttactgtaatgatggacatggacactgtctaatatggcagccacaagccacatgtggttattgagcacttgaaatgtgactagagagactactatgctgaatttttaatttaatttttagaattttaaagtgttactgtcttttaattattttaaatttaaattctacctgtagctagtggctaccatattgggctgtgcggtagtagacattcaaaatgtcagtttcccttctggattagataaacgaacgcta

SEQ ID NO: 140813 - DNA, 601 bp, Human
ccattctccattcccagctcgggactaggcatctacttacttaccttgtccttttaaaactgaaatagactttctcactgtataagtaattttagtatttaggcaaatcgtaaaattacagcaaggagaagcaagggtctacaaaggtttgattttaaaatgcaaccaggctgggcatggtagctcatgcctgaaatcccagcactttgggaggctgaggcaggagaattgcttgagcccaggagtttgagaccagcctaggtcacatagtaaggccccatatctacaaaaaataaatttwaaaaaaaaattaggcatgatagtgtgtacttatagccccactacttgggaggctgaggtgggaggattgcttgagcccgggaggtggaggctccagtgagccatgatgatgccacagcactctgcctgaaacacagaacaagaccctgtctcaaaaaaataaataaataaaataaaatgtgatcatactggaacagaatctttccactgttggaagtgctgggcttcctagtccaacaatcccagtctctcacaacctagcttagctgtccattcacagaacgctgagcatcagtcagat

SEQ ID NO: 140814 - DNA, 601 bp, Human
tccagtctgactgatgtggcgaagttaaaaagtcaaccccttccttgcctccccaaccgcaaaaaaccctggaggtttgtcttatggctgctacaggaacatcatccttacagtttccttaagctggcattaaaagttgatatttgcatagatggtaacatttacacagcagaggtattgggaggactggtgtatttgattatgtttcataaatcatgcacaggttttgaaaaacatagacctatccatatagctgagaatctgctgtccactgagggggggaaaaagctttaagaaatarttgactgctgaatctggtcctttgaaagtttttctacatgtagaaatgttgacttgtgaatttgttgcctttaagggcaactttgtctctcagtagaggccatcattctagcaagggtagcatagattttcctggcagcctagaacaagaactcctggttagcggttttatcagagtgcccagtcaagtcctggttctaaattttgcctctgcaacatactgcagaaaactttatagaagtcactggaccactctgagacagtcttcttgtctattaaagagggacagtgcctacttcac

SEQ ID NO: 140815 - DNA, 601 bp, Human
aaaaaaaaaaaaaaagttctgaaatccagtctgactgatgtggcgaagttaaaaagtcaaccccttccttgcctccccaaccgcaaaaaaccctggaggtttgtcttatggctgctacaggaacatcatccttacagtttccttaagctggcattaaaagttgatatttgcatagatggtaacatttacacagcagaggtattgggaggactggtgtatttgattatgtttcataaatcatgcacaggttttgaaaaacatagacctatccatatagctgagaatctgctgtccactgagsgggggaaaaagctttaagaaatagttgactgctgaatctggtcctttgaaagtttttctacatgtagaaatgttgacttgtgaatttgttgcctttaagggcaactttgtctctcagtagaggccatcattctagcaagggtagcatagattttcctggcagcctagaacaagaactcctggttagcggttttatcagagtgcccagtcaagtcctggttctaaattttgcctctgcaacatactgcagaaaactttatagaagtcactggaccactctgagacagtcttcttgtctatt

SEQ ID NO: 140816 - DNA, 601 bp, Human
tagggcttaagttacttcctgaaatgaagtggcatagcccactggaacactcatttgttaaatggcacccaaatgactttaaagggcttgctgaaatggttaattcaacttcccaaaatgttttaacttagttctaggaaacagcgaaagcacagtgagaatctgactcaggaggaatgaattttttgagttactagggagaaagtcactatgtaaaatcaagagcttaatttgatcatcatttggcttatgtgacaagcatagttgtagcttttctctgcatttaagcttttttttttttattattgagaaactacttaacatggtgcataatagatggccttctaagtgatggatgagagggaaggctataacttgattatagaaatgtattcatttgtgttgatgttctgggaacttgtgccagctctctacagaggtcacctcggtgttgttccaacccttctctatttggatttccctaaaatgattagcactttctatatcaaagatgttttcttatctgataatttcaagacatgaaaacaagaggctctggtccacataagattaccagctcaatgtcacatcaaactgccag

SEQ ID NO: 140817 - DNA, 601 bp, Human
taaattattctgagtaacagcttcacactcatgagaaatatgttctggtaagaatttggcctttgttatgcacacagcttctccatgcatactatatgagtggcataaagtatgagattgcattgaaataaatgtaaattgagggctggccatggtggcacattcctgtaatcccagcacttttggagtctgaggtaagaggatcagttgaggccaggagtttgaaatcagccagggtaacatagcaagaccctgtctacacacacacacacacacacacacacacacacacacacacacagttagctgggtatagtagtgcacctgtagtcctagtgtactacacaattagctagtgtagtgtactacaccattagctagctatacaattagtgtagtgtactacacaattagctagtatagtagtgtactactaattacctagtgtactacacaattagctagtgtagtgcactatactagactacacaattagctgggtgtagtagtgcacctgtagtcctagctacttgggaggctgaggctgaggtgggaggatcacttgagcccaggagttcaagacagcagtgagctgtgattg

SEQ ID NO: 140818 - DNA, 601 bp, Human
ttgggtgtttctcgcagagggggatttggcagggtcacaggacaatagtggagggaaggtcagcagataaacaagtgaacaaaggtctctggttttcctaggcagagtgtgtgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagamgaatttttcttagtacagaacaaaatgaaaagtctcccatgtctacttctttctacacagacacagcaaccatccgatttctcaatcttttccccacctttcccccttttctattccacaaaaccgccatcgtcatcatggcccattctcaatgagctgttgggtacacctcccagacggggtggtggccgggcagaggggctcctcacttcccagtaggggcggccgggcagaggcgcccctcacctcccggacggggcggctcgccaggcagggggctgacccctccacctccctccc

SEQ ID NO: 140819 - DNA, 601 bp, Human
tcctcataagttctccaattttatagaagtgtgagaacaggccgggcacagtggctcacacctgtaatcccaacactttgggagtccgaggcgggcaaatcacgaggtcaagagttcgagaccagcctgaccaatatgatgaaaccccacctctaccaaaaatacaaaaattagccaggcacgatggtgcgtgcctgtaaccccagctactcaggaggttgagtcaggagaatcgcttgaacctaggaggcagaggttgcagtgagccaaaattgcaccactgcactccagcctgggcgayagagcgagactctaagaaaaaaaaaaaaaaagaagaagtatgagaacagactaatacaagggacaagagggattaatattaataatagtattggcaagttatatgctaaaaaagattggtaattaaaagtggggtaactatacttttgtgatctcctattacagttggtgcggttcttattatgacaaaggtaggcgcctaaagaacacaggagttttttgaaatagaaaagcattcaacagaaaacagaggttgagggtcaagagaaagagctgcttctattttagaactttcaaaaaa

SEQ ID NO: 140820 - DNA, 601 bp, Human
gaaccatgacaattaaagctcttttcctcataagttctccaattttatagaagtgtgagaacaggccgggcacagtggctcacacctgtaatcccaacactttgggagtccgaggcgggcaaatcacgaggtcaagagttcgagaccagcctgaccaatatgatgaaaccccacctctaccaaaaatacaaaaattagccaggcacgatggtgcgtgcctgtaaccccagctactcaggaggttgagtcaggagaatcgcttgaacctaggaggcagaggttgcagtgagccaaaattgcrccactgcactccagcctgggcgacagagcgagactctaagaaaaaaaaaaaaaaagaagaagtatgagaacagactaatacaagggacaagagggattaatattaataatagtattggcaagttatatgctaaaaaagattggtaattaaaagtggggtaactatacttttgtgatctcctattacagttggtgcggttcttattatgacaaaggtaggcgcctaaagaacacaggagttttttgaaatagaaaagcattcaacagaaaacagaggttgagggtcaagagaaagagctgc

SEQ ID NO: 140821 - DNA, 601 bp, Human
gttcctgtgacaatgagtgagttatagtgagatctgattgtttaaaagtgtgtggcacctccccgtctcttcctcctgctccaggcatgtaagacacctgctcccgcttggccttctgctaccagtaaaatctccctgagacctccccagaagcagatgctgccatgcttcctttacagtctacagaaccatgacaattaaagctcttttcctcataagttctccaattttatagaagtgtgagaacaggccgggcacagtggctcacacctgtaatcccaacactttgggagtccgaggygggcaaatcacgaggtcaagagttcgagaccagcctgaccaatatgatgaaaccccacctctaccaaaaatacaaaaattagccaggcacgatggtgcgtgcctgtaaccccagctactcaggaggttgagtcaggagaatcgcttgaacctaggaggcagaggttgcagtgagccaaaattgcaccactgcactccagcctgggcgacagagcgagactctaagaaaaaaaaaaaaaaagaagaagtatgagaacagactaatacaagggacaagagggattaatattaataatagtat

SEQ ID NO: 140822 - DNA, 601 bp, Human
gggaattggtcacgaaaaatattatttatttaaatagaagatcctcaactctggtctcctcaggtgtgctctggaagcttccctgaagcccacaaatgccatcgggagctgccaccttcctactttttgtctttgacaaaaaagttatatggcccatgactgtaacaattaagaaataataataacaataaaactttgaaaatgataataattcagttattttattcaacaaatatggattgtacatccctgttttggaaagtagaaataagacagcggcattggggagacaaaatccttycccttattgagtcatatactagtaggacatatcagtacaggttgaatatcccttatccaaaatgcttgggagcagaaatgttttggatttccactgttttcagatttcggaaatttgcactatatacttagttgaacatccctaatccaaatgtctgaaatcgaaaatgctctaatgagcatctcctttgagcatcatgtcagtcctcaaaaagtttcaaattttggaacattctggatttcagcttttcagattatggatgctcagcttataccaaacaagatagataggtaaatatat

SEQ ID NO: 140823 - DNA, 601 bp, Human
cacacaagtttggttaaaggaaaataaaaatacaaaaacatctatatttctcacctcccatcaaacctgtgcttcaggaaatcaaagagggctttctgcatcatgtctgttacctttgcagaggtgagaaaaaaagaatgaggcaaacacatgcagagagagagagagaagtcaaaagggagagaggagggagggaagggtactatgagccaagaccttattgtagccattcgtctcctagggggaggttaccatggaaggtgtttttcatgcttaaccatgtgcaattgctaatttccamcccccttggttctcctccagggtgttgaggaataaaccagcagtgttcaccagaccctcttccctcttccctcttccctcgttaggggatagaactgctgccaggagacaacaggctggctttgtacacaggtgccgggtatccttggcacgcctgagttgtgcctgcctccagtgaggagcagctagagaactgaggccagcactggactcagccttcctgctagtttgtgtatgttggcggaaattctccatgcccatggctggatttttgtagaccactctcctgctcatccctctg

SEQ ID NO: 140824 - DNA, 601 bp, Human
atactttttgatgcaccccatttaaatttcctacatttctgataaatctcaggttttttcatgtggttatttttacatggactgcattcagcactgtgaaagagcttaatatttagaattgagtcaatacaggctttttaccatttctctgcaaaacagagaaactttctttagaatttttcacaaaacttaaatgataaaattatttaatggctaatgcctgagccatattgttgatggatcatagtaaaatacattaaaaaaagatcaataaaataacaaggacatttctaataaaaamaacccacaactataataaatatccaaataagtactattccctacaaaatgatcactttgggaggcttatgattaaaataattctcactctcttcttttgaggaaattcagtacttgacatttatgctttcatatgacacacacacacacacacacacacacacatacacaattcccaaatactgcctagtttgaccagcaagccactatactcatgagaaatattatatattttaattaatattttttcataaaaaacattttggtatgaaattattaataactgagaaaataaagatat

SEQ ID NO: 140825 - DNA, 601 bp, Human
gagcaataataagcttccattgtgtttgaatcactacacattttggggtctatttattaaggcagcctgacctatatactaatgtacctagaagcattcttatttcttaaactaaaatctgtttactaactttctatattgttccagaaactaatgaatattttacccaattatccagaaagcttttattttaacaaatgcatacaatttatatttaaagcaataccatgcttgtttttattcttaatataccaatttattaaaatctatctgaagtttttttacattttaaaattatttygtgcatttagtggattctcataatttagcaaagagaaagtgaatggcttaattactgccttcaaaaataaagaatgtgatgtttttcttcaatcctacagtaataaattggatgcatttgcccatactttttgatgcaccccatttaaatttcctacatttctgataaatctcaggttttttcatgtggttatttttacatggactgcattcagcactgtgaaagagcttaatatttagaattgagtcaatacaggctttttaccatttctctgcaaaacagagaaactttctttagaat

SEQ ID NO: 140826 - DNA, 601 bp, Human
ctaagggccccaaatgacagagggaacaaactttctgcccaattctcccctcccccaactctatcctccctcccagccaaggaacacctgcttcagactgttaagtgagcaataataagcttccattgtgtttgaatcactacacattttggggtctatttattaaggcagcctgacctatatactaatgtacctagaagcattcttatttcttaaactaaaatctgtttactaactttctatattgttccagaaactaatgaatattttacccaattatccagaaagcttttattttaasaaatgcatacaatttatatttaaagcaataccatgcttgtttttattcttaatataccaatttattaaaatctatctgaagtttttttacattttaaaattattttgtgcatttagtggattctcataatttagcaaagagaaagtgaatggcttaattactgccttcaaaaataaagaatgtgatgtttttcttcaatcctacagtaataaattggatgcatttgcccatactttttgatgcaccccatttaaatttcctacatttctgataaatctcaggttttttcatgtggttatt

SEQ ID NO: 140827 - DNA, 601 bp, Human
gactgcaagagtgcctccgctgcaattaagtatgaccacataaccaagttctaaccagtgaaatgtcagttgcgctacctccaggccgggcaagctgactagagacatcgtacctgggctaagggccccaaatgacagagggaacaaactttctgcccaattctcccctcccccaactctatcctccctcccagccaaggaacacctgcttcagactgttaagtgagcaataataagcttccattgtgtttgaatcactacacattttggggtctatttattaaggcagcctgacctatayactaatgtacctagaagcattcttatttcttaaactaaaatctgtttactaactttctatattgttccagaaactaatgaatattttacccaattatccagaaagcttttattttaacaaatgcatacaatttatatttaaagcaataccatgcttgtttttattcttaatataccaatttattaaaatctatctgaagtttttttacattttaaaattattttgtgcatttagtggattctcataatttagcaaagagaaagtgaatggcttaattactgccttcaaaaataaagaatg

SEQ ID NO: 140828 - DNA, 601 bp, Human
ctgcctatttcttttttaaagagagtgaaatggaacaaatacatctttcttattaagcctttgtccagtagatgaatgtgacgaaggctattattgattcaacaaattctatctcctcttcctcctggactgcaagagtgcctccgctgcaattaagtatgaccacataaccaagttctaaccagtgaaatgtcagttgcgctacctccaggccgggcaagctgactagagacatcgtacctgggctaagggccccaaatgacagagggaacaaactttctgcccaattctcccctccccyaactctatcctccctcccagccaaggaacacctgcttcagactgttaagtgagcaataataagcttccattgtgtttgaatcactacacattttggggtctatttattaaggcagcctgacctatatactaatgtacctagaagcattcttatttcttaaactaaaatctgtttactaactttctatattgttccagaaactaatgaatattttacccaattatccagaaagcttttattttaacaaatgcatacaatttatatttaaagcaataccatgcttgtttttattcttaatat

SEQ ID NO: 140829 - DNA, 601 bp, Human
tctaaaagacattttatgtatccttccaactccaatgctctaggattcagggcttttaacttattttctttgaagctacttcattatctgcctatttcttttttaaagagagtgaaatggaacaaatacatctttcttattaagcctttgtccagtagatgaatgtgacgaaggctattattgattcaacaaattctatctcctcttcctcctggactgcaagagtgcctccgctgcaattaagtatgaccacataaccaagttctaaccagtgaaatgtcagttgcgctacctccaggcygggcaagctgactagagacatcgtacctgggctaagggccccaaatgacagagggaacaaactttctgcccaattctcccctcccccaactctatcctccctcccagccaaggaacacctgcttcagactgttaagtgagcaataataagcttccattgtgtttgaatcactacacattttggggtctatttattaaggcagcctgacctatatactaatgtacctagaagcattcttatttcttaaactaaaatctgtttactaactttctatattgttccagaaactaatgaatattt

SEQ ID NO: 140830 - DNA, 601 bp, Human
gtgaaatgaagagagaagctccatgcccattgtgtatccactgtgtcgtcgtcagcacaggaatcattgcttcatgtagatattcaaaaatacagagggcgctcaggaactgtttagtattgtgtttttctttttctttctttctttctttctttttttttttttttattgagacagagttttgctcctattgcccaggctggagtgcaatggcatgatcttggctcaccgcaacctctgcctcccaggttcaagtgattttcctgcctcagcctcccgagtggctggaattacaggcacrcgccaccacgcctggctaattttgtatttttattagagatgaggtttctccatgttggtcaggctggtctcgaactcccgacctcaggtgatctgcccacctgggcctcccaaagtgctgggattataggcatgagccactgcgcccagcctagtattctgtttttcttacatgtattacagttaggccccacaatagcagctacagcaataaaattgtataataagtagctctaaactgactcaaataatttctaaggtatcaaaaaaatcccaagtttatgattctgcaatagtcaaa

SEQ ID NO: 140831 - DNA, 601 bp, Human
ccaccacacatggctaatttttgtatttttactacagatgaggtttcaccacattggccaggctggtctcaaactcctgacctcaggtgatctacccacctcagccttccaaagcactgggattacaggtgtgagccaccatgctcagcgatgtgtgtttatttttgtgtttttgggtttctggtttatttaagaatggagctgctggatagaaacatacaggcatgtttcagagcaatccaaatatatgacgagagacaagtcggtgggtttagggacagaattcaactttctagaccartgatttttggactaatgatgtttggagggcccaacaacccagaaagttgaattccagtctcctttagtgaaaataaaattttctagttctatacaaacaagagactcttggttcttcaaatctgaagggattatcatcagattcacactttttttttctgagttataaaagtacttttacaaagctattttcaaacacgaccaaagtttgaaaaaattcagaaaaaaaccttttcatgtgttccaatacagggaaagatgcagacaataaagggcacgttttctcattttatttgctaat

SEQ ID NO: 140832 - DNA, 601 bp, Human
agtccctgcatgttactaatggtcattgccattcacaacaccaagaacaccgttatctagcttttcttctaaagatctcagaaggctgaacacctcgtttccttttatgtcagctgtgactcaggtatgacagatatcattagccttgttgagaagctgagcaaagtggagatgactggtttcatgtagttaggcaggaaaagactaggagagcccattgaggattctttccaccagactactaattagctaattgactaaagctgagagacagcaagctctcgctactgcaagactctgytgccttcttgtccatagctagcattctttttaggtactcagtgctcccccgttcagaatggggaacaaattgaaaaagacattcacaaatgcaccatgtgtcagcccggtctgtaagcacagcttgaagaagtaccacatttgaacatcttacctaagctggaccgggtgttcgaacgttcaattattgctctcttgctgggattatttaggacagacctcttagcaagagaaatgtcagctgtcactctcgttattgaaatcctatgaataggaacacagaacagaacaagccagtaaa

SEQ ID NO: 140833 - DNA, 601 bp, Human
ggggagtcatggactatgatgctggaggacctcgatgaacacttctataaactgaccatgatgatttgggcccacctctctccaggatccctgtcacaaattatatcccttatactcaaacctgttcatatttctcccatgcttaaaacacttcaatggctccccagggtccaaagcaacatttcccaaagtgagtactctggaacaataatctcataagatatcctatgggaagaagggggttttgtgtaagggttatattgaatactataatagcttctctttagaatttcaaacatgmattatccttcatatcttcaaggctctaagtcttgcagagaagaaacctgtcagtttaattcatcatttccaaatttatttgacaatggaaaacattctgaatgtaacaactgttactatgttgtaaaattaacattgcatgggatctattttggagttctctttagcaaggtgcattagaaccccaacacattggcctcaatctttttcaatctcttctgttcctctcaaatcacaccaccaacttccctgttctaagcatgctatacacaaatctacttgtttctcaacaacatatttt

SEQ ID NO: 140834 - DNA, 601 bp, Human
atacctactgcttaaccaacacaaaactcttaggcaacaggcacttgggcagaggaagagaggtgcttgggcagaacaagccagcagggatgctggagaaggccacattaaatactggggtgagcccaatgtttggataatatgtatacagaatgtaataaatatattttatctgtgaggcatatttatctatatagctctttttttgttttttaaagaaaaagatctcaaccaaatcaaaaaatcttggctacctggactgattctcagaggggttccaaataagttttcctcataatcytattccagtcaaatggagccctggggagtcatggactatgatgctggaggacctcgatgaacacttctataaactgaccatgatgatttgggcccacctctctccaggatccctgtcacaaattatatcccttatactcaaacctgttcatatttctcccatgcttaaaacacttcaatggctccccagggtccaaagcaacatttcccaaagtgagtactctggaacaataatctcataagatatcctatgggaagaagggggttttgtgtaagggttatattgaatactataatagct

SEQ ID NO: 140835 - DNA, 601 bp, Human
cttgccgagtagctgggactacaggtgcacatcactgtgcctggctaaattttttattttttgtagagactgggtctcactaagtttcccaggttggtcttgaactccaaagtccaagcaatactcctgccttggcctcctgaagtgttggcatcacaggtgtgagccattgtacccggccttaaacgaccctaaagatggcctagggaaaaaggtaatgttgctctaaatatcctcattgaaaagtgtttgtgatttgctttgcttatttagtataaattcaagttcacatagcccaccaaaaaaattctcccttccttaaccaaaaggattgacaaggtgtgcagggtcatgaatactcaagactatcatgaaaatctattttcttatgttttgcatgattgcataaaattcttatttcccatagaatcactgaagtttaaggcatgatctgtattaaaaaggattaatttgaagagtcaacatatcacttttcatgttatccaataccaatggcctgaaagacttcacattgcttggaaaggtgactagctttcagaatattaatgaaaacaagtgggcttatttgtcaaattcttct

SEQ ID NO: 140836 - DNA, 601 bp, Human
aaacaatgctgtaatctggtccaaagtacatacagtacacaaaactatctaacttaaattattattattaatttttagagacagggtctcactctgtgtcccatgctggagtgcagtggtacaatcacagctcactgcagcctcaaccttctgggctcaagtgatcctcccacctcagcttgccgagtagctgggactacaggtgcacatcactgtgcctggctaaattttttattttttgtagagactgggtctcactaagtttcccaggttggtcttgaactccaaagtccaagcaatmctcctgccttggcctcctgaagtgttggcatcacaggtgtgagccattgtacccggccttaaacgaccctaaagatggcctagggaaaaaggtaatgttgctctaaatatcctcattgaaaagtgtttgtgatttgctttgcttatttagtataaattcaagttcacatagcccaccaaaaaaattctcccttccttaaccaaaaggattgacaaggtgtgcagggtcatgaatactcaagactatcatgaaaatctattttcttatgttttgcatgattgcataaaattcttatttccc

SEQ ID NO: 140837 - DNA, 601 bp, Human
ctacctcccgggttcaagtgattcttgtacctcagcctcccacataaatgggattataggcacacgccaccatgcctggctaacttttgtattattagtagaagcgagatttagccatgttggccaggctggtcttgaactcttgaactcttgacctcaagtgatgcacccaccttggtctcccaaagtggtgggactacaggcatgagccactgtgcccagctgattttgttttttatttttattttttggctataggtgtgaccaaacaatgctgtaatctggtccaaagtacatacastacacaaaactatctaacttaaattattattattaatttttagagacagggtctcactctgtgtcccatgctggagtgcagtggtacaatcacagctcactgcagcctcaaccttctgggctcaagtgatcctcccacctcagcttgccgagtagctgggactacaggtgcacatcactgtgcctggctaaattttttattttttgtagagactgggtctcactaagtttcccaggttggtcttgaactccaaagtccaagcaatactcctgccttggcctcctgaagtgttggcatcac

SEQ ID NO: 140838 - DNA, 601 bp, Human
tgatatgcatatttttgtaccactggttaattgttctgagtctacccttaaaactaatcatattactaagtctagttagatttaagtacgaaagccaatgtacttgttctaaggcataattagcttcagtattaaaaaaaaaaaagtaaggccaattatattaaaacgctgcaatgcatctagatgcaaatctatctggctggctgtaatagccaagtgacccaaatctgtgcatgagtctagtcaaatgaaaaatctactcttttcaaatgtctgaagcaatccagttttttttttttttaaggaaaacagataatcaacataggacatggctttctgaaatataaaaaagttttatatatatatatatattttataaattacctgacttattggatcatgcccaaagtctgaattatactatttgattttcagagaaattgatttgttttcgtttttgagacacagtttcactctgttgcctaggctggagtgcagtggcatgatcttggctcactgtaacctctacctcccgggttcaagtgattcttgtacctcagcctcccacataaatgggattataggcacacgccaccatgcc

SEQ ID NO: 140839 - DNA, 601 bp, Human
atggagggagtggactgtaccaggtcatttatgttaagtaatactttaatattattcacctgaataatgttttagctcactatctccatgtcagataaatgtcagagtcattttctggttatttttgtcaccgattattaatgggacatttcagtttaattttaaattaatcagactattctgtgattggagacccaggcaaaacatttgtattagtatattgctacatgtaaaccagtgatatatctatgtcttttggccactgctgtaactgcatttggtcatatactgccatgtcccrtggcccttcccctgcaaacaatgctaatctatgagctctataataccccaggacataggtgtctgggaactcctgttcttgcacttaaggacaccacagtgtcatgggcagtgggaagggctgaactctcctgcactgcagtgaagtgcttgaacccccagcagctctttcaatccattctactgattctcaaaaggccctagtttgttcaggattcccaagtccactgcaccaaagcagtgtctgcagagatagatggaaggctaggatctcagaacatctggaggagagtacagcttc

SEQ ID NO: 140840 - DNA, 601 bp, Human
aatggtctgcttggccctgagtattatcagagaggaaatgcagtgtgagaaatcatatatttaaacctgtaatgatgtcatctgcttacattggctctcagttccatggatttgatatgttcatcctattctaactctgtgtgaagtctcaggaggagcctgagttcccatcctagatttttcccagagatttcaaagagagacctgtaaaaatggagggagtggactgtaccaggtcatttatgttaagtaatactttaatattattcacctgaataatgttttagctcactatctccawgtcagataaatgtcagagtcattttctggttatttttgtcaccgattattaatgggacatttcagtttaattttaaattaatcagactattctgtgattggagacccaggcaaaacatttgtattagtatattgctacatgtaaaccagtgatatatctatgtcttttggccactgctgtaactgcatttggtcatatactgccatgtcccgtggcccttcccctgcaaacaatgctaatctatgagctctataataccccaggacataggtgtctgggaactcctgttcttgcacttaa

SEQ ID NO: 140841 - DNA, 601 bp, Human
taactagtcaagaatgatgaagacaaaaaatgatcatacttactggggggcattgtgcaagtttatcagctgccaccagttgaacattcaagtgtttactttgtgactttcctctagatttaatcaaccgctgtaaaacctgatagaagaagacatgaacctgaggtattgtagatgagttgaaagaaaatcaaataagccaggatctttttaatggtctgcttggccctgagtattatcagagaggaaatgcagtgtgagaaatcatatatttaaacctgtaatgatgtcatctgcttayattggctctcagttccatggatttgatatgttcatcctattctaactctgtgtgaagtctcaggaggagcctgagttcccatcctagatttttcccagagatttcaaagagagacctgtaaaaatggagggagtggactgtaccaggtcatttatgttaagtaatactttaatattattcacctgaataatgttttagctcactatctccatgtcagataaatgtcagagtcattttctggttatttttgtcaccgattattaatgggacatttcagtttaattttaaattaatcagact

SEQ ID NO: 140842 - DNA, 601 bp, Human
aacaaagattatcttccttcaactgtgaaacattagaaggtcagggctgggcaatacattcctctgtctgttcagtgccttaatcatacattccactgtgtaattgggcttcactaacaggcagcgtgaagtgaaacttaacagagcacgccatgctccaagctatcaaattatcttcagggtaggtaaccaggtacatgtgtgtatgggtggatgggttagggggtaggaaattgtctttggagccagatagatctagaatagattgaatcctaatttgctatgtcaccttagggaaatygtttaatgtctctgttttcagttgcctaaactataaaatggagataatatggcctatctcaccaggtaactgtgaagattagagataatctatgtaaagcatctagcacactgtgtggccaactgtaagcatctaatgaaaggatgcattattactcttatcgtctgaacatcctttcatttattcactcattccacaaatatatattatgggtctactatgatagggaactgacatacaacagtgagccagaggggcacgggttcttacagagtctactggaccagacatgacgtcaca

SEQ ID NO: 140843 - DNA, 601 bp, Human
ccaaaacccatacttttctttccaggagaatatataactgacctgttgccattcatcatctagtcttgctagactaggagaaagagatcttaagctgactttggcccaggcatacaacctttgaaaagccagttctcttggtctcagttccatcatttgtaaaatgaggagattggactaagtctttccctagacatgttccactggacccataggatgctcaatggaaaagcagatctgcagtcacaattttaggggaagctgtgcacactatttgtcctattggagatataaaatacayattggcatattcagggttctgtagtaaagaaaccagactacctttgttcacctaagtgttttctcaaacatttttggtatcaggattattttcccataacacttactgatatcacataggacccatattataaataatatagtctaggaaatactatattgggtgctctttaaggtccccttttgcttcaacagtccctggatctaggattaattctggctacagcgttaacttttttcagagctcctataggcttccctttccaaaaactgttgcctttcatttcttagcaatgtgata

SEQ ID NO: 140844 - DNA, 601 bp, Human
aggctcaagccaccttcctgtttcaacctcctgagtagctgggactacaggcactcaccatgcacccagctctttgtgagtattttgataaacagaatgctgtggaaatgatgtggtctggtatctatgcccaggctgtaaaagattggaatctttgctcatggagcctgggagctgccacgtaagagcctgtattcaaaaagagctggctgagcccagccttcagccatttctgctaaggtaccaggtcagccgccagctgaatactacaagtggccattgtttgaagtgactgagtttkggggattattttattgcagagtaatagataaccatagcttggtcccagaacaagggggcaagttcagtttgccagctaaatcaggcctgtctcatgcctctacgaagtttgattggaacacagctacacccatttgtttacacactgtctatgtttgctttcctgctcgagagcagagatgagtagttttgcaaaggagtctatatagcccacaaagcctaagatattactatctggccctttacttaaaaagttcaccgatctctctcctagaaaaatccttacccatgaaatacatac

SEQ ID NO: 140845 - DNA, 601 bp, Human
gactggcaagtactgttcagtaaaatcaaacggctgaatggtacaacatgtaatgctaattataaaaataatcaacccaatggttctttcatatcaaaactccattctttacattattaaagcttttgagattctgagtatttaactcactggtcaactaatgatgggaaattagactctaagttgaagggcttttaaaagatctatgatgggtgcggtggctcacacctgtaatcccagcactttgggagaacaaggtgtgcaggtcacctgaggtcaggagtttgagaccatctctttyaaaaaatacaaaaatctcttttaaaaaatacaaaaattagctgggtgtggtggcacatgcctgtagtcccagctacttgggaggctgaggcaggagaatcgcttgaacccagaaggcagaggctgcagtgagctccgatcgcgccactgcactccaaccggggtgacaatattactgggctctagcagttagttccaggtagtttccactttaatgagctaaacaggaaagataatcataattcttgccagtaattggtgaggttaaaatgagggcaaaaaatatataactttgattctt

SEQ ID NO: 140846 - DNA, 601 bp, Human
aatgaatggatagaatttgtatatatcagcacatggtataagcctcagtcatttctaggaaactgcttttgcactgctaaaagacagatacaggttggaagatgacttgaaactgcttttaggctttcaaaaaacacagagaaaagcaaatttctgcttctgaatgaatactgacatatgtggcttattttcatctaggaagaatttcacagcctgtatatctgtgacaatttttctctttagctgtttaggaaataacacagctgagtagatcagagtgatagaaactcagtatcaggggaaaacaatttttaaaaatcatacaagaaatgcaaaaagaagcaacccaatgaattatgcaaaccagctatgccaatttttcataaatttaaaggttcaagtgtagtcagctccttactatgcaatatgtggcctgcagcatgggctatggatgcagagagctcctaatcagcagaagtcccgggcagcgaacagttacccactcggtgataccatgcccttggtgcagcccaagagaagggcaacgctgagctgttttcaaagcatggccacagggaacacctttgcccttgtatgatgg

SEQ ID NO: 140847 - DNA, 601 bp, Human
gtaagtgtaaatgtgttacaggtaaaatatgacaaaaacccacgtgtattcacatctttagccatgtattcctatagagctgcactctacacactttggaatatgagagaagcaagtttgtggcactgagaagggagttctagacatgttttgggcaatgaccacatcaatggaataaacattttttctcctaaggtaactatgttgaagggaataacatttacttaggtaattttcagaatgcttgtgaaaataacattatctgttttatgataaaacaataaggaaagaaagtttaggrttaataacagaaaaccacatggcagtggtttctgctaccacaagatcattttgtgaaatggttaaaaaagaacaaggggtgtttagttagggaaagcagggggtcacaaaagaagtatctgctgtccacgtttcggacagtaaggccattgttcaacatctggtctgtactcaggaagttgttctgttccagaggagcagggtggcccccctgtcattgcagtgtggctgggaacacagacaggatataccccagacatatactcttcagagggaaaccagaaaactttggcaccacaca

SEQ ID NO: 140848 - DNA, 601 bp, Human
tcctcaagctgattttcatccaatataacatcaaacatttcctgtagatgacaagaaaatccactttacttccattttaggttttaggcaatgaaacctaaaattccacttaacacagataatagcatttttaatagctattagctaaaatcaaatttgaggtgctatatgggcagtttctaaagttagggtcaagtgaagagttacacagttatccatgaacgaatgtagacattaatataaaaatgaaagtgttcattcaatatttggatcttttttttttttttttttttttttttttaagacggagtctcattctgttgcccaggctgaaatgcaatggcacgatctcggctcaatgcaacctctgtccactgagttcaagcaattctcctgcctcagcctcccaagtagctgggattacaggcgcctgccactgcgtccagctaatttttttgtattttttttagaagagatggggtttcaccatcttggccaggctggtcttgaactcttgacctagtgatccacctgccttggctcccaaagtgctgggattacaggcatgagccacagcgcccagccggatttttcattattt

SEQ ID NO: 140849 - DNA, 601 bp, Human
gtttcaaaagctattcatttgcatgacagtttttctgcttacaaagatgcaattttgtaacagagtaatacagctataatagcatttcagagagtgccatttatctcagagttaactctgtatgatcgacaattaagactatcattataatccattaaaacaaaactcatcatgatacaagagggctcaattgactacatgttcctcagtttgctgcgggtttggccacattccagcagctacttgatgaatggtaaataataattgatgtagaaaggcaggctcattttgtaccataagktctctggttccctatctctacctctgagtgcaataccagaacagcagaagggagaacctcttgatcctgtgttcgtcaccagcttccctaaaggacacgtgccacagccacttacaaaggtgggcacctgcacagccccaagaaaactcagggatcagttactgtttctgaacagagcagctctacttatatccacattgtcttgtgcaaggtagagagcaggcctagcaacctgggtgcggcaggattaattaagggcagctgaaaggcctatctgcacctatatatcttacttagcta

SEQ ID NO: 140850 - DNA, 601 bp, Human
gtcaattgttactgggagaagaaataggccacagaataaagggcaacacattaactcattagtgaaacagggagaaccactctaggtggatgtcttagcagtgatgagtcaagattgttgtattcaatataaaagtgcaacattgcatttctacgtacattacagaagtgtattgcttcatgcatctatttctcattctgtaatgtacaattcagagccaatccacactagtcaatagtaatgtacactcagatcagcccatgggaagtgaaacaaggcatgaaatagtcctaatgcatgygtatgtgctgtacattaccacagtacatttttcatgttcatttctagtttcaaaagctattcatttgcatgacagtttttctgcttacaaagatgcaattttgtaacagagtaatacagctataatagcatttcagagagtgccatttatctcagagttaactctgtatgatcgacaattaagactatcattataatccattaaaacaaaactcatcatgatacaagagggctcaattgactacatgttcctcagtttgctgcgggtttggccacattccagcagctacttgatgaatgg

SEQ ID NO: 140851 - DNA, 601 bp, Human
tcagaattttaaaagttaaggtgcctataaatgcacaggaagaaggctgagggatggtgggatgagagggtcctgtgggatggcagaaggccttggtgtctgctacgggtcctttgtccctgccagggctcacgttgaaatctgaaccgtaatgtagctggtggggcctgttggggtttggggtggatccctcatgaaaggcttggtgccataaccgccccctcccacattcccccaggagttgtcaatcttagttccccatgacacctggttgttagaatgaacctggcccctccccgtstcccttccggatctcatccccctcctcctgccatcctccccaccccttcccctgatgggcagaatccagctgtccttccccttcaccaccagtggaagtttcctgaggcctcaccagaggcagatgctggtggcatgcttcttgtacagcctgcagaaccatgtgccaaataagcctcttttaaaattatccagcgtcaagttttcttttttattttttttcttttccgaaacggagtctccctctgtcgcccaggctggagtgcagtggcgtggtctcggctcactggaagctccgcct

SEQ ID NO: 140852 - DNA, 601 bp, Human
ggctacagcacagggatgggaccccgaagagccctgtggactctgctgaggaacaccaggagctccaaggccgagtgcatggcgagatgtggagaagcagctgctacgaggaccttagccctgcagaggccaaaacacggctgctattatacagaaggggagaccaaaaatgctacagacatggctccggcagattatttttgccaccatcgaagtgctgaaaccacactgttaaggagaaaatcttaaaagcagccagagaacaaagatctcctccccacagacaagccaggtgagaggsgcagcctaagccctgaaaaaccacacaggaagaggcagcggcagaggccccaccccagccggtgctgctcccctctcctcttcatcaggactgtccccgctccctccacccagtgctgagaccaacagcagacatgggggcgagggtgtgatgcacttaacatgacctaagccacacaaatatattaccaacaaactccaatgacttaactttgagattctcttcatctaagtttttaaagtggtcattcctagtttctctcattcctaccagtgctctggacagacttgcctgtggcca

SEQ ID NO: 140853 - DNA, 601 bp, Human
tcctgcccagcccctctactgaacaaatgttctgagtctcatgctgtttgtctaaaacaaagacaatgagggttcctgtacagtctggttgtatgaggattaagtgtgttcatttacatatgaagtgctaagaacagagcttggcacacgcaagtactgtatttcagcacatgctgttgttagtacaatcattcccctcaatgttgattttaatgaaaccacatcctctaagccaccaataccatgacctggggccttgcaactgctggagtcaagtagggagggatggcatccctggagycggcacagcctctctggaggtggggggtgggggaggtggcccccatgcttcctgatagttatttaggtccctagtgacacctcctccaccagactgtgggcttcagggagcaggactgacacagggctcatttgtcctcccaccaccaccaggcgcagacattctcagagtaaagtgctcatcacctacttcctgggtgagtgactttccctccaagcccatgaggtgagcccagtggtggcctcagctcaccgcctcaggtcacaggttccaggctacagcacagggatgggaccccga

SEQ ID NO: 140854 - DNA, 601 bp, Human
aagccatctgtcttgtagtctcgggccagcctcatggtctgggggaagccacttcttctctaaacatgtctatcattctggaaataagaggtggctttacatgacttctcaggtacccccagcagtgacccagcgctgggtgaatgcaggcctcatgaaaaagcaccaaatactcccctgggaaaggtcagcagaacccagtgacccaatcactgctgctgccccgagggttgctcatcctcctgcccagcccctctactgaacaaatgttctgagtctcatgctgtttgtctaaaacaargacaatgagggttcctgtacagtctggttgtatgaggattaagtgtgttcatttacatatgaagtgctaagaacagagcttggcacacgcaagtactgtatttcagcacatgctgttgttagtacaatcattcccctcaatgttgattttaatgaaaccacatcctctaagccaccaataccatgacctggggccttgcaactgctggagtcaagtagggagggatggcatccctggagccggcacagcctctctggaggtggggggtgggggaggtggcccccatgcttcctgatagtt

SEQ ID NO: 140855 - DNA, 601 bp, Human
ctttgagtctttcgtggcttttttatttctttgttcttttggtataaaaagacccctgggttaagaagcaagccatctgtcttgtagtctcgggccagcctcatggtctgggggaagccacttcttctctaaacatgtctatcattctggaaataagaggtggctttacatgacttctcaggtacccccagcagtgacccagcgctgggtgaatgcaggcctcatgaaaaagcaccaaatactcccctgggaaaggtcagcagaacccagtgacccaatcactgctgctgccccgagggtygctcatcctcctgcccagcccctctactgaacaaatgttctgagtctcatgctgtttgtctaaaacaaagacaatgagggttcctgtacagtctggttgtatgaggattaagtgtgttcatttacatatgaagtgctaagaacagagcttggcacacgcaagtactgtatttcagcacatgctgttgttagtacaatcattcccctcaatgttgattttaatgaaaccacatcctctaagccaccaataccatgacctggggccttgcaactgctggagtcaagtagggagggatggcat

SEQ ID NO: 140856 - DNA, 601 bp, Human
ttgatattcacactgatttcctctctcaggcatacacaccctaaaaaaatgccttattgatcttaaaatgagcaactcagaattgttctgaggttggctgtggtcgaaaatctgcttcctttgagtctttcgtggcttttttatttctttgttcttttggtataaaaagacccctgggttaagaagcaagccatctgtcttgtagtctcgggccagcctcatggtctgggggaagccacttcttctctaaacatgtctatcattctggaaataagaggtggctttacatgacttctcaggkacccccagcagtgacccagcgctgggtgaatgcaggcctcatgaaaaagcaccaaatactcccctgggaaaggtcagcagaacccagtgacccaatcactgctgctgccccgagggttgctcatcctcctgcccagcccctctactgaacaaatgttctgagtctcatgctgtttgtctaaaacaaagacaatgagggttcctgtacagtctggttgtatgaggattaagtgtgttcatttacatatgaagtgctaagaacagagcttggcacacgcaagtactgtatttcagcacatgc

SEQ ID NO: 140857 - DNA, 601 bp, Human
agatggggtttcaccatgttggtcaggatggtctcgatctccttgacctcgtgatctgcccacctcagcctcccgaagtgctgggattacaggggtgagccactgcgcccggcctgaattcacttctaacactaaaaatagtaccttaaaaaaaaatctctactaatagcaagtgaaaacctgacaacgagctcctggtgactctggacctggacagtgctcagccttctgttcagctgttcttcccacctctcacatgaaacatgtctatgaaaggctgaggacgtcacatctgcattgrtgcgggcttcctagaacccatgttactcattcatccaaggagggcatgtcggcgcctggtagaaacgctgtgcaaggaatcgtggggtatcaagaaaaaggcacgaccctccctttccttaggacagttccagttcccagggagatgaggcacagccatcaataacccgagtcacgaggggctgcccaggcagaggtgacaaatgccactggtggcagggacaccggtagacatagagggaaaggtccacatagagggaaaagtccacacaggcaggttcctaggcagatacgaagtcaa

SEQ ID NO: 140858 - DNA, 601 bp, Human
gagatggggtttcaccatgttggtcaggatggtctcgatctccttgacctcgtgatctgcccacctcagcctcccgaagtgctgggattacaggggtgagccactgcgcccggcctgaattcacttctaacactaaaaatagtaccttaaaaaaaaatctctactaatagcaagtgaaaacctgacaacgagctcctggtgactctggacctggacagtgctcagccttctgttcagctgttcttcccacctctcacatgaaacatgtctatgaaaggctgaggacgtcacatctgcattsgtgcgggcttcctagaacccatgttactcattcatccaaggagggcatgtcggcgcctggtagaaacgctgtgcaaggaatcgtggggtatcaagaaaaaggcacgaccctccctttccttaggacagttccagttcccagggagatgaggcacagccatcaataacccgagtcacgaggggctgcccaggcagaggtgacaaatgccactggtggcagggacaccggtagacatagagggaaaggtccacatagagggaaaagtccacacaggcaggttcctaggcagatacgaagtca

SEQ ID NO: 140859 - DNA, 601 bp, Human
tgccactgcactccagcctggacgacagagacagactgtctcaaaaaaaaaaaaacagcaaaaaagtgtggtttaattttcacatatttgtggattctccagttttccttctgctattgatttataatttccttttattgtgattggaaaagatagtttgttttatttcaatttttaaaattgtattaagacttgttttgtggcctaacatatagtgtgtcctggagaatgtttcatgtacccttgagaaaaatggatattctcctgtgattgggcagtgttcacatacacacagacatayacacgcttttactaatgagggttaggtgatgtgtaaattttttaaaaagcaggatactgaatcaaatattaaataatgaacttcaggtttaaaaaggcactttacaaactgtcccccaaaacagcctgccaatgtcccatgaaatactagagtcagaaaaagatgaaagagcagtatagttattcaggacaggatttctgtgcaataaattacattataaagacaagtgaaaaccattggggtctgaggattagctggtagtaatgtactgatgcttactgtctgatattgaggattgta

SEQ ID NO: 140860 - DNA, 601 bp, Human
ttgtctctttgtccccatgcccccagcctgtggcaactaccattctactgtctgtttctatgaatttaactactctacatacttcatataaatggagacatacagtattttatggttttcttgaggctgtcatatttcaattagcataaaatcatcacgatccatccattcggtaccatgcattggaatttcattcctttccattgtgtgtatatgtattacgtttatccattcatctgtcaatgggcacttggtttgtgttcacattttagctattgtgaataaagctgctatgaacacrggtgtacaaaatctctttatgccctttctttcaattcttttggatatataccccaaggtaaaattgctgttttcttacaagagttgtataattcttatagatcttacatttggaggccacatatgaaaagccaacagctaccatcctactcaatagtgaaagactaaaggttttttctccaagatcaggaacaagacatggaggcctcctttcatcacttctatattatcagggtaatgcggggcccacacgaagagttagaaagtgttccctccaactcagtttcttggaagaatttga

SEQ ID NO: 140861 - DNA, 601 bp, Human; identical to SEQ ID NO: 28875

SEQ ID NO: 140862 - DNA, 601 bp, Human; identical to SEQ ID NO: 28876

SEQ ID NO: 140863 - DNA, 601 bp, Human; identical to SEQ ID NO: 28877

SEQ ID NO: 140864 - DNA, 601 bp, Human; identical to SEQ ID NO: 28878

SEQ ID NO: 140865 - DNA, 601 bp, Human; identical to SEQ ID NO: 28879

SEQ ID NO: 140866 - DNA, 601 bp, Human; identical to SEQ ID NO: 28880

SEQ ID NO: 140867 - DNA, 601 bp, Human; identical to SEQ ID NO: 28881

SEQ ID NO: 140868 - DNA, 601 bp, Human; identical to SEQ ID NO: 28882

SEQ ID NO: 140869 - DNA, 601 bp, Human; identical to SEQ ID NO: 28883

SEQ ID NO: 140870 - DNA, 601 bp, Human; identical to SEQ ID NO: 28884

SEQ ID NO: 140871 - DNA, 601 bp, Human; identical to SEQ ID NO: 28885

SEQ ID NO: 140872 - DNA, 601 bp, Human; identical to SEQ ID NO: 28886

SEQ ID NO: 140873 - DNA, 601 bp, Human; identical to SEQ ID NO: 28887

SEQ ID NO: 140874 - DNA, 601 bp, Human; identical to SEQ ID NO: 28888

SEQ ID NO: 140875 - DNA, 601 bp, Human; identical to SEQ ID NO: 28889

SEQ ID NO: 140876 - DNA, 601 bp, Human; identical to SEQ ID NO: 28890

SEQ ID NO: 140877 - DNA, 601 bp, Human; identical to SEQ ID NO: 28891

SEQ ID NO: 140878 - DNA, 601 bp, Human; identical to SEQ ID NO: 28892

SEQ ID NO: 140879 - DNA, 601 bp, Human; identical to SEQ ID NO: 28893

SEQ ID NO: 140880 - DNA, 601 bp, Human; identical to SEQ ID NO: 28894

SEQ ID NO: 140881 - DNA, 601 bp, Human; identical to SEQ ID NO: 28895

SEQ ID NO: 140882 - DNA, 601 bp, Human
acggagctgggccaaggctgcccccagccccagccacgccaggctggggagagggcagccacaggctcaggggagcaagctcagaagccccgtgggaaggaagagacatcagggcccagcccagaggagggcaggccccaggctgagcaggagccccccggccagggcccaggggctgtgccctgcccctgccgccccattgcacaaatccttctcgcagcagtccacgtcgacctttaagatcccagagttaataaaccccatcagatagtctgagaaaaagtgtcgcttaacgaagtcrcaggaggaggcacacatcttgttcaccgagtgatccttcctgcctgggaagagaaagcgtggcctgggacgggggctcctcctgggccctctctgcctcatcccgaggacccagcccaggcccctccgggtcagctcggggccccagtaggcagggccgagtccctccaccctcccacgctggcctcaactagatgaaaagggccaccaaggagccagggggggacagcaggacagtatcctgcctgccgccccacgctctcactctcgtcccaggccagaggggctccgaggacacctc

SEQ ID NO: 140883 - DNA, 601 bp, Human
ggttttccctcgcggcggggcgcccggggcccgtgcaacctccgcgcctccctcctttaaacactattggtcctctcgggcatctgttcttccgtaacgccccttctcctaggagacagttgtccggccccgccccagcatccccgcggctccctgcgcggttctggccctctggggcccacttggggccgagcggttctcacccgccctctccgcacgtccgccggcgcctcaggtttcccccggtagccaccggcagtcctccgcgtgggacccgggcgcggtggtcctttccctcgcsgttctgccccgtcccctccccttcctcccctctgcccccaggtcgctcagcctctactatttccccctactttggcaggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatc

SEQ ID NO: 140884 - DNA, 601 bp, Human
ctggaagcaaacagggtcactcttgttgtctttatataatagagtactaggttcagagcctttttgaagggagtcgaggtgtaaataaataacacgtaggaggtggatgtggcagttagcaagataatggaatccaggtggtttgacaagaaacccactgagagatttcccaaagctattggctttacgtgaacaatgttctaaatgattagggaaaaaagcctgtcttctcagttttggtattccttggctaaaggatcagtagaggtctatatatatatatatatatttttttttttttcccctctttttaaaatcacgatgtaatacatatacagcaaaacgcataccaaagtgctcaagtatttttttccttgcattttgatgttgcattattttccccaagtgtttgtaaagagggcaagatgataattttggacctccctgtctctgccccaccctccctgccaccccctggtcgctcagcctctctgatctccccccactttggggggccaggtgcggtggctcatgcctgtgcaatcctagcactttgagaggccaaggtgggtggatcacctgaggtcaggagtttgagacc

SEQ ID NO: 140885 - DNA, 601 bp, Human
aaacccactgagagatttcccaaagctattggctttacgtgaacaatgttctaaatgattagggaaaaaagcctgtcttctcagttttggtattccttggctaaaggatcagtagaggtctatatatatatatatatatttttttttttttcccctctttttaaaatcacgatgtaatacatatacagcaaaacgcataccaaagtgctcaagtatttttttccttgcattttgatgttgcattattttccccaagtgtttgtaaagagggcaagatgataattttggacctccctgtctytgccccaccctccctgccaccccctggtcgctcagcctctctgatctccccccactttggggggccaggtgcggtggctcatgcctgtgcaatcctagcactttgagaggccaaggtgggtggatcacctgaggtcaggagtttgagaccagcctgaccaacatggtgaaaccccgtctttactagaaacataaaaaattagctgggcatggtggcacacgcctgtaatcccagctactcaggagcctggggcaggagaattggagaattgcttgaagccaggaggcagaggttgcagta

SEQ ID NO: 140886 - DNA, 601 bp, Human
aaggcagagatgaggaaccagacctcagagagaagtgattttcccagagtcacagagaagttagcagagctggagttaagattcattctagaggcagtactcttagcctctctgctttgcttgtgaggagccacatcacatgtattttcttttcttttcttttctttttgagacagagccttgctctgtcgcccaggctggagtgcagtggcatgatcttggctcattgcaacctctgcctcccaggttcaagtgattctccagcctcagcctccctagtagctgggactacaggcgcccrccaccacttacgtctgattttttaatttttagtagagatggggtttcatcgtgttggccaggctggtctcgaactcctgacctcaggtgatccgcccgccttggcctcccaaggtgttgggattacaggcgtgagccaccgcagccagcctatttttcttatagtttattacattagaaatctttcataccagcagtgaaaagaaaaaaaaatagaaatgaaaaacaaaagtaactccttgaagtttatagtcatacctcataaaactatgtcaaaactgactccttgatttaccagaca

SEQ ID NO: 140887 - DNA, 601 bp, Human
tcaggagttcgagaacagcctggccaacatagtgaaactccatctctactaaaaatacaaaaattaggctgagcgcggtggatcatgcctgtaatcccagcactttgggaggccgaggagggtggatcacgaggtcagaagttcaagaccagcctcgccaacagagtgaaactccatctactaaaaaaatacaaaaattagccaggtgtggtggcgtgcacctgtaatcccagctactctggaggttgaggcaggagaattgcttgaacctgggaggcggaggttgcggtgagctgagatsgcgtcactgcactccagcctgggcgacagagcgagattccatcttggggaaaaaaaaaaattagtcagccaggtgtggtggcaggcgccagtaatctcagctcctcaggaggctgaggcaggagaattgtttgaacccaggaggcagaggttgcagtgagctgagattgtgccactgcactccagcctcagcgacagagcgagactccatctaaaaaaaaaaaaacatgtctgggccaggtgcggtggctcatgcctgtaatcccagcctttgggaggccgaggcgggcggatcacctga

SEQ ID NO: 140888 - DNA, 601 bp, Human
gctgaaacggctggcggaggccgactcagagaaagcggtaactaaggctgcccttgtctactctagtgggtacaggtggcaagagcgtcgttccactacaaagtgtagaggtgcttggatcaaggcaggagggctggagcatttcgctaggtcttagtttcacgatctgtaaaatgggctgatgtcctcctgtcacgcttgttctgataggcttgtctagttagttacttgagaccttgagccacaaagctggacaccaacatagagagggtaatgatgatgttggatttgtaaatcatcygtgtctgttaaagctggatttccatcaaattagtattatggattcaaagccatcaaaaagtacacacctttggactcagtaatcctaattctaggaatctctcccaaagcagcatgttccaaagtctgttcatggaaccctaagttcctcaagatgttaatgagtgcaagaaaccgaaggggaggttccatagccagttaaatttgggaaaccataggctggcctgaacatgaagttcaacagcttctttcaagacttttttggagtgtctgctgtattaatgcttttgtaagtctccaa

SEQ ID NO: 140889 - DNA, 601 bp, Human
ccgggtgcggtggctcacacctgtaatcccagcattttgggaggccgaggcgggcagatcacgaggtcaggagatcgagaccatcctggctaacacggtgaaaccccgtctctactaaaaatacaagaacttagccgggcgtggcggtgggcgcctgtagtcccagctactcgggaggctgaggcaggagaatggcatgaacacgggaggcggagcttgcagtgagccaagatcgcgccactgcactccagcctaggtgacagagcgagactccgtctaaaaaaacaaacaaacaaaaaamacacacacacacacacacacacacaaacaaacctgtgtaattgattctctctgtctgctttcactttgtgatcttccagccgggtaacagatcttgtaaaccaacaacaaaccctggaggagaagatgcgggaagaccgggatagcctggtggagagactacaccgtcagactgctgagtattccgcattcaagctggagaatgagaggctgaaggttcgcagtgagagctggggaccaggcagctggatggggcccagcgagctgatgaggggtcttgtcttacgtgggcctgggggca

SEQ ID NO: 140890 - DNA, 601 bp, Human
gtaatcccagcattttgggaggccgaggcgggcagatcacgaggtcaggagatcgagaccatcctggctaacacggtgaaaccccgtctctactaaaaatacaagaacttagccgggcgtggcggtgggcgcctgtagtcccagctactcgggaggctgaggcaggagaatggcatgaacacgggaggcggagcttgcagtgagccaagatcgcgccactgcactccagcctaggtgacagagcgagactccgtctaaaaaaacaaacaaacaaaaaacacacacacacacacacacacamacaaacaaacctgtgtaattgattctctctgtctgctttcactttgtgatcttccagccgggtaacagatcttgtaaaccaacaacaaaccctggaggagaagatgcgggaagaccgggatagcctggtggagagactacaccgtcagactgctgagtattccgcattcaagctggagaatgagaggctgaaggttcgcagtgagagctggggaccaggcagctggatggggcccagcgagctgatgaggggtcttgtcttacgtgggcctgggggcatcttgactaagagggagtcaga

SEQ ID NO: 140891 - DNA, 601 bp, Human
ttgcagtgagccgagattgcgccactgcactccagcctgggcaacagagcgaaactccgtctcaaaagaaaagaaaagaaatgagaataaggaaactgaggctgagagagaagtcaagtgtcttgccaagattttgccctaggaagtatcagagttgagatttgaacccgagtctgactcgagccctagctcttaaactcaccatacccacttccagcctgccaggagtgagaggcacctgagcagaggttgacatttcagagacaggttttatcttgctcttttgttgatctgggcaataacatctagctttattttttcactgattttgttttttcttgttaagattgattttaaggaagaataacatatggaaaagtacacagatcctagaattttcataaagtgaatatactttgtccatcactcactctgattgaaccttgcctgcaccctagtgacctttcttgttactaatacccctgtaaaggtaactgctagcccatctcctgtcaccacaaattagttgcctgcttttaactgtagagatttgaatagtttgaatatccctgggcctggcgtctactctgcaagtttgttg

SEQ ID NO: 140892 - DNA, 601 bp, Human
ccacaaattagttgcctgcttttaactgtagagatttgaatagtttgaatatccctgggcctggcgtctactctgcaagtttgttgagtcagccccattgtttggaggagtttattcatcctcagcgctctagggtatgtcgttatatgaacacaccacagtatatttgtccattctactgtcagtggacatttgggtttccatagtgttgctgtgaacatctttgtatgtctttaggtgtacacatttggtgcgtctttattgtttatataccttgaagtagaattgccaggtcatcatggggtgtgcattaagtctatatttggtagatgtcactgaatagtaaagtgtgtcactgagtagtaaagtagttactggtagatgttactgaatagtaaagtagttgaacaaatctccacacctgtcagtggtgagtaaaaggataacagttgctccttgcctccttggcaacgcttggtagcttggtattgagtgtcttattttatgttagctactccggtgggagtgtagtagtatctcatttgtatagtgtaattgtcggataagttaaaaataacatgcacgtcttaacagttattta

SEQ ID NO: 140893 - DNA, 601 bp, Human
gggacagcatcacctattttacaggttgtctgaattaaatgagcaagtgtgcagagagcccctggtacaatgcctgggtcttggtgtttactgtgtggttgccattgttacgggataactaaatgaatggcaagccacctgctcaatggccagcggggagtgtaggccacacttctgctgtggattttgcaggatcctccactggggactgtgtcagccctgccctaactctaaaggactctgcctggctccactaggagccaggtctttcctaactgtgggtctttccttcctgtgggtctttccttcctgtttcaggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggag

SEQ ID NO: 140894 - DNA, 601 bp, Human
aggcagtgagcagggagaccccgaagccaaaggctggcaggatccagcagggcagaggccagcaggggaattcagggaagagcctcagggctgacaatggggacacctgactacagtcaaggggattcaaagcacagcctggaacctggaggaatcccctggaacatggacacagaaatgtggacagctgaagccatgaccttgaccacaggtagggagcttgcagttagggacaggagccaactttacttagacataactcaaattcatttcatttctgaaggaaatgaaatttccttcwttttcacctggttggaatttattgctctctccttaatggtgcatagcaccttgtttatttatgctttgagtaattgtaatatgccttgttttatagtatttttatacatttctacttcaactcttgattataaatttgttaaggcagggaatatctatctatctatctatctatctatctatctatctatctatctatctatcttatctatctatcatctacacacactaatggtattttagctatagcatacataaatacataggtacattttgttgaattgaaattaagtgaattaat

SEQ ID NO: 140895 - DNA, 601 bp, Human
caaaggctggcaggatccagcagggcagaggccagcaggggaattcagggaagagcctcagggctgacaatggggacacctgactacagtcaaggggattcaaagcacagcctggaacctggaggaatcccctggaacatggacacagaaatgtggacagctgaagccatgaccttgaccacaggtagggagcttgcagttagggacaggagccaactttacttagacataactcaaattcatttcatttctgaaggaaatgaaatttccttcattttcacctggttggaatttattgctmtctccttaatggtgcatagcaccttgtttatttatgctttgagtaattgtaatatgccttgttttatagtatttttatacatttctacttcaactcttgattataaatttgttaaggcagggaatatctatctatctatctatctatctatctatctatctatctatctatctatcttatctatctatcatctacacacactaatggtattttagctatagcatacataaatacataggtacattttgttgaattgaaattaagtgaattaatcccatcctctttcagaatagaaattat

SEQ ID NO: 140896 - DNA, 601 bp, Human
tcaaaatggctggaacttttacttaatactttacaaggtgcgcccctgccccaaagtataggtggaaataaacctctgctttaaaatctcaacagaaaaatcagatcaaagaaatctggtgaaatacctttgattaaatgtaacacacaattgatctcaattccatagctgattattaatttttaattaggagtaagatacaggcaccatgatgtgtagattttgttgtctaagaaagaagatgaatagaagataatatgttttaactttttttttccaccaagttttaaagttctaagaytgctggcaattttcaatgaatatatggggtctccatcactggccattttatgggcaaaacagcaaaacacaaataggtttaatgctgagctcccagcccttatctttgcttctccccctccatttccaccagtcaggtgtctagaaaagaagggcatcccggttgggaggaattggttgtggggaggatttggccatgatcagagtaggtactgcttcagaccgagctggggcattttaaaactgaggcagaagaagccatactttaggggtccggggaaagaaagtaggactaggatgg

SEQ ID NO: 140897 - DNA, 601 bp, Human
ggaatattacatcaaatgtggaaatacggaggcacatggtaaactgtcacgtactatacaaatgatcattgtgatgacattttcttaaaatgggttatatgaagtataaagaattgagaggctgactattgccagcaattagtttagtatagccttgtttattaatctatggccagatgtggtaccttagagcctatagatcttactgtgcacacccatgaccttcagatgttcgtcgggagacacaacatagagcctggtcttggtgcttgaggaatctgggatgtcatacctgactctytgatgcattatttggataccttaatctctccaaatttccttgtttataaaatgaagatgtaaatgcctcaattgcctcatgtggtggttatgaaagctaaaataaaaatgcacagatggttttgaatgtgctttgggtcagtgaagtgttataaagtgtaaggtgttatgatgatcatagatgtaacttgggatgtatgctttgtccatggatggtttcttatctgaaaggaaaggctgatgaaagctaggtcgacgaataatgtgtgatgagtatatgtgtgcatatgcacacgtggac

SEQ ID NO: 140898 - DNA, 601 bp, Human
tcgggagacacaacatagagcctggtcttggtgcttgaggaatctgggatgtcatacctgactctttgatgcattatttggataccttaatctctccaaatttccttgtttataaaatgaagatgtaaatgcctcaattgcctcatgtggtggttatgaaagctaaaataaaaatgcacagatggttttgaatgtgctttgggtcagtgaagtgttataaagtgtaaggtgttatgatgatcatagatgtaacttgggatgtatgctttgtccatggatggtttcttatctgaaaggaaargctgatgaaagctaggtcgacgaataatgtgtgatgagtatatgtgtgcatatgcacacgtggacatgcaggtgcacatgtccatgtcagggtacatagtgttacaaaggggagacgaggtgtgtactgatcattttcacatttgcactctgccccgttcactgatcttcccctaatcggccctgtatctccaggagttccactgcataggcctctgcctagggcctgcttcttctctcacccctggtggctggctgggtcctgttgggtggctccagcctcagaggctacagcagtttc

SEQ ID NO: 140899 - DNA, 601 bp, Human
tgcattatttggataccttaatctctccaaatttccttgtttataaaatgaagatgtaaatgcctcaattgcctcatgtggtggttatgaaagctaaaataaaaatgcacagatggttttgaatgtgctttgggtcagtgaagtgttataaagtgtaaggtgttatgatgatcatagatgtaacttgggatgtatgctttgtccatggatggtttcttatctgaaaggaaaggctgatgaaagctaggtcgacgaataatgtgtgatgagtatatgtgtgcatatgcacacgtggacatgyaggtgcacatgtccatgtcagggtacatagtgttacaaaggggagacgaggtgtgtactgatcattttcacatttgcactctgccccgttcactgatcttcccctaatcggccctgtatctccaggagttccactgcataggcctctgcctagggcctgcttcttctctcacccctggtggctggctgggtcctgttgggtggctccagcctcagaggctacagcagtttcctgatgttgtttatctatagatggtctctcttctgtttggtgtctgagctcttccatcttatgggcaac

SEQ ID NO: 140900 - DNA, 601 bp, Human
tgggtggctccagcctcagaggctacagcagtttcctgatgttgtttatctatagatggtctctcttctgtttggtgtctgagctcttccatcttatgggcaacggattctccatattaaattccttctgtttgaaatacttagagctggccaggcatggtggctcacgctggtaatctcagcatttggggaggctgagggaggcagatcacctgaggtcaggagttcaagaccagcctggccaacatggagaaacctgtctttactaaaaatacaaaaattagtcaggcatggtggtgcrtgcctgtaatcccagctattcgggaggctgaggcaggagaatcacttgaacccgggaggcggaggttgcagtgagcggagatcataccactgtactccagcctgggtgacagagtgagactccgtctcaaaaacaaagcaaaacaaaacaaaacagaaatacttagagctgattctgctttcctgactggcccctgactgattccagatgcttactttgtagatggatactagattaagacatgcatagtacaatttgtagagaagaaagataatgtagaatctaactttatactgttta

SEQ ID NO: 140901 - DNA, 601 bp, Human
ggaattataggtgtgagccacctagccgggcccggtgtactttcttccccattcatctagaaaagtaagaaggcatattgttgatgaggtaattaaaataaattaattagcacaacaataagaaaataagtaatgtgataaaagcagtctgcaagggcataattaaaaaaatttttttcccataggttattgggaaacaggtggtgtttggttacatgagtaagttctttagtggtgatttgtgagattttggtgcacccatcacctgagcagtacacagtgcatgctatttgtagtcttytgtctctcatccccttcccaccctttcccccgtgtccccaaagtccattgtgtcattcttatgcctttgcatcctcatagcttagctcccacttaggagtgagaatataccatgtttggtttcccattcctgaattacttcacttagagtaatagtctccagtctcatccaggtccctgcaaatgccattaattcattcctttttatggctgagtagtattccattgtatatatataccacagtttctttatccactcgttgattgatgggcatttgggttggttccatgtttttcctat

SEQ ID NO: 140902 - DNA, 601 bp, Human
tcatataattatatgattaaacaaatttctactaagacaaatttggtataatcctctagctcttcatttgctattcattgttttaaaagtttcttatttgaaataaacagttagataattataatgggagatcatcttttttgagggcttttctgtatgctctttctagtataagtcacctctttctcttttactgttccttggcaagcaaaaacacaagtttaggaacaagccagagttatcaaaagttctacaggagtgaggaaaaaaagagcaagaggaacgcaggagaggcaactcmcttgatgacatggcagaagcatccaagctgctgaattgttttcaaaagatggcaggcagggcccacagtgaaagcatcccatctggttgtccaatccaccatgaaaggggtcgagagtggtaaggattagagtagaggagattcccaggagctattgctggtgatggagggatgtggagactttccattgtttatgtacattagagaagattgacttgaaatttcataaatatatatcttatcttatattccttaatgtacataatggagaaaaaaacccaagagagcactccaagagga

SEQ ID NO: 140903 - DNA, 601 bp, Human
tgctgaattgttttcaaaagatggcaggcagggcccacagtgaaagcatcccatctggttgtccaatccaccatgaaaggggtcgagagtggtaaggattagagtagaggagattcccaggagctattgctggtgatggagggatgtggagactttccattgtttatgtacattagagaagattgacttgaaatttcataaatatatatcttatcttatattccttaatgtacataatggagaaaaaaacccaagagagcactccaagaggagttgagtttggatcaaatcctatcctaascattatcctattttggagttgagatacctacattttagaaatatttttaatccagaataggtcacatgctaaatattctgggtaaatggtgtttatttgttcattgttttttttcttggcatgtggaagagaaatcatcttgaatcaattgtgttcattggccaaacagtatgataatttgttaaattttactgattaatgatgcagagtcttgactttcattgtaagtaaactcaggacacaaaaagcactaagagatgcccaaagtggttttctataatttaaatggaaataaatttg

SEQ ID NO: 140904 - DNA, 601 bp, Human
ctcagctaagatttttatagtggtagtggttgttgatatttggtgtgtaaaacctctttatgctgctttagctatatattttttaagctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcatgtatttaaaaaaaaaaaaaagaggatgtcacaatcatactgcctattttccaggattattgtgagtatccagtgaggaaaatatataaaagactcttataaccttcagatttcttacacatacatataattgtttttaacacatttctgatctttgttcatatgtatatatggtttcaatcacaggaccctatacacatttgtgttccacttttcatatctaatgttatagttgtgccataatttactagccctttccctattgatggacatttaaatggtttacagttgttccctattataatagt

SEQ ID NO: 140905 - DNA, 601 bp, Human
ggttgtggagtcaaagtgaatgaccatttttttaactaacctgtcttttgagcttttcacttcatccaaatatctttcccttggtaactttcctagaaagtcacagagcactcaaatgccttcttgaagtcagccagaaagattcagaatctacatttggtggccatatttccattttcaggctctttcagaaccactggcctgtgaggcctcccctagactgcaaggcccttcaggacaagattgtgccttaatcatgttggcatcctagcatggcctggcttgtcacaagaactcggtragtgattaatcaatggagctaaacagagcagatgcctaatacatgataggctccttatggtcacctgacttgccaaagcattcattcatcaaagagtttttaacaatgtcaggcactggtgctagaaactggagacagagaggcaaatgtgacacaggtggcctcatcagcctagcaagcagagcccccctggcagtggaagagcttagtcttgaatctgagaattccttgagaaggggtccaagagtggagttgaccttggcccatgtaatgtgattgcagggaaggcccttgctatgc

SEQ ID NO: 140906 - DNA, 601 bp, Human
aattgaaatagctttcaactattaataattttaaaaatacatggtttcctttgtctcctctatggttttgaaatttaacaatgggatatttgtcatcattctgcaggttgagtttttcagtccagcgtagagtgattgtttctgtttttattttatttctaaatttttatgcctgcagtggatgtgcgtgagctatggccttggggcctaaacagctctgggtctcatggagagcgaaatgagtgcatttcatgctttcgctttccacaatgtttattctgttaaagtaaactcaacttayggatgtatcattggttgtaattataccattcacataaaaggtaaataatttcaagtaaaattagaatggtatttttgtaaatccttgtactttcctcactgactttcaaattttcctctttcctaatttcatcctaattttctccaggcccaaggacattaaaggcatccatcaacttttccggaatcaggtttctctggataccgtttctgatttggaggcttgcagccatttttttccaagcataaaaatggcttcaactttccatagtaagggaaatctcagtaagggaaatcatat

SEQ ID NO: 140907 - DNA, 601 bp, Human
atatttgtcatcattctgcaggttgagtttttcagtccagcgtagagtgattgtttctgtttttattttatttctaaatttttatgcctgcagtggatgtgcgtgagctatggccttggggcctaaacagctctgggtctcatggagagcgaaatgagtgcatttcatgctttcgctttccacaatgtttattctgttaaagtaaactcaacttacggatgtatcattggttgtaattataccattcacataaaaggtaaataatttcaagtaaaattagaatggtatttttgtaaatccytgtactttcctcactgactttcaaattttcctctttcctaatttcatcctaattttctccaggcccaaggacattaaaggcatccatcaacttttccggaatcaggtttctctggataccgtttctgatttggaggcttgcagccatttttttccaagcataaaaatggcttcaactttccatagtaagggaaatctcagtaagggaaatcatatacccctaagtatatgcattttaattttccatgtcttgtcactgttatgataaaaaagaacaacagagtttgaaaactttcagtga

SEQ ID NO: 140908 - DNA, 601 bp, Human
ggtgatcaagaatcaatgcagtgtcaaaacctcagccctccaatctactcctggaatttttacagagtgtgagatgtttgcagaccaggaggctttcttgcatttatgcctcaggaaatgggtcgttttataattcttgtggggttctttttgttgtgttgttttttgtttttaaaaaaatccctcttcctatacagaatcactattaacagtggtatgtgacttttcagacattgtatgtgcatacatccccacacacacctttatgttgttttttatttatttgtttttattttttaattttttttttttgagacaaagtcttgctctgttgcccaggctggagtgtagtggtgccatctcaggtcactgcaacctctgcctcctgggttccagcaattctcctgtctcagcaacccaagtagctggattacacaggcaagcgccaccacacccagcaaatttttgtatgttttgtagagacagggttttgccatgttggccaggctgatcttgaactcatggtctcaagtgatcggcccacctcagcctctgaaagtggtgagattacaggcgtgagccattgtgcctgaccatgttt

SEQ ID NO: 140909 - DNA, 601 bp, Human
attattgataataattaagaactggtttgtatatgaaaatgtgtttgtagcatacatttggcttcattatctccatcagttcacatcactttgaaattaaaatcaaatgagatcatgacacatacctgtcagtgacatgcaaattaaaaattcttggcaacatagattaatgatcatttttgagatttttctctcttttattaattttctcctcttgttttattacatctgggtacttattgaaggaagagactctgatagaggatattgttagtggagaaaaggaagcttggcaactttygtgaaatggtgtgccttaaagaggaaggaatttacagtaaagcctcagggagcccaatgcttaggcaacagtctacaagttggtgaatatctctttcagattggtgttgtgctttacacgatactgtattacaaagctgctaaacaacaaatggtttttctacagataggggatctctaggcatctcaaggataggaatcaatttttcaaagggacacacacactcacacacacacacacacacacactctcacacattttacccacacatgcatatactgtatatacacacccacaata

SEQ ID NO: 140910 - DNA, 601 bp, Human
ctgaacaccatctatcagctagatttaatttacatttatagaaccctccaaccaacagcagaatatacacttttttcaagtgcatggagcattcacccaggtagaccacatcctgggtcattaaaacaaacaaactaactaaatgtaaaagaacggaaaccatgcaaagtatgttccctgaccataatagaattagactaaaatttaataacagagagatagcaaggacatctctaaatgcttggaaggtaaacaatatgcttctaaataatccatcaaagaaaaagtttcaagggttatygtagatgtcctttatttggctgaagaagttaccttttattcctagtttgaatggatgttgaaattttgtcaaatgattctttgaactaaattaaagatattttaaattaaattaaaatgaaaatacatcaaaatttgtaggatgcaggtaaaacattgcttaggagggaaattctttaatataagcattaagagcttatatttataagagaaaggtttcacatcaataaactatgcttctactttaataatgtagagaaaagagaataaataaacccaaggaaggaatggataaagataa

SEQ ID NO: 140911 - DNA, 601 bp, Human
agcaggggttgggtatttgaaaggcagaaacaacagctttcagatcaccatggtgggttattctacattttaaactaaacacccctggagggtgtacagataagcaaagaaggggtacaggaaggagtggaaaaggtggtgggtattatggcagaaagagcaatagttttggaactagacctggaccagaactcccacagggattggccttcagctggcattacgaccccagggcaagtcagttactctgcctggagctttgctttcttcatctaaagactgaagaggctgaactagctgkcccctaatatccctttttgttacaaatcttaagaaatatatactttgggtctagggccataacttaatttcttagctgagtataaaactgtgttaaactcaataggattttttttttaatgcttatagcagtggtcttcaaatgttagagtgcgtaagaatcttatcaggattagataggtggaaaaaaaaatcccttgtaaaatgcagatttcagggccccatccccagagattctgatccattctttctgaacagaacccaagagtctgcatttttaaacaacgttgtcaggtaattc

SEQ ID NO: 140912 - DNA, 601 bp, Human
aggctgaactagctgtcccctaatatccctttttgttacaaatcttaagaaatatatactttgggtctagggccataacttaatttcttagctgagtataaaactgtgttaaactcaataggattttttttttaatgcttatagcagtggtcttcaaatgttagagtgcgtaagaatcttatcaggattagataggtggaaaaaaaaatcccttgtaaaatgcagatttcagggccccatccccagagattctgatccattctttctgaacagaacccaagagtctgcatttttaaacaaygttgtcaggtaattccaatgcaggtgatcaaagctaaagacctgcacaccatctgtttgattcccagtccctagaaggaaaccccatccattggagctgcaagcacttagaaaatgtttaaagttgaacaactggacataccctttgaaagctccctcctaggctccctagatagtgtgaggatgcttggaatacagcagacaccagggtagccaggggctccaccgcctgcatattgggacacaacgtggagatcttgcattctctccttacacttgctcactcactctgactcaagtg

SEQ ID NO: 140913 - DNA, 601 bp, Human
gggctctgtatattagaatctcttcactcctgagtttttgataatccttcttacgcccattggaatatagtccagagatcattgttcaatcaataggcacccctcaagccctgttcattgccagaccctgaactgagttgatattcagagaaagacacagcccttgtcctcctgaagctgctggagatgcatgcaggggacagcatagtgtgaaaggtgttgtggcagaaatgctctaggtgctatgggacagcagattgtgggctgattgtgtctctctggggaaccccaggaggggccactcattctagacttcttcacccacttgggctactatagtaaattaccatagactgagtggcttataaacaacagaaatgcatttctcacagttctggaggctgggaagtccaagatcaaggacccagcagattcagtgtgttgcaagggcctgcttcctggttcatagatggctgtctttttgctgtatcctcatgtggcagaagggtcgagggagctctctggagtctctaatgtaagggcactaatcccatttatgagggcttcaccttcatgaactaatcacctcccaaagcctacc

SEQ ID NO: 140914 - DNA, 601 bp, Human
cagagagagaggtattcctcctgctccattcacctttatctccctccactgtaggctgtgggattttgacctaaagggactgctcaccaaccccctgccccaccacaagactgtgcccctgaagcagttccaagctcagaagccctggagtcttccattcctaccagccctttgcccttctaccaccagcaggcttgcttgttttctggcagttagtccctgaagtaaaagctccctgcccttctcttagtaggaagtttctcctaagcaccaagagcccctacacggaatggaaccacgyagaccaacgtggcccttgcctcagtctccagagaaggggggagggtcagttaagtggccttctcatctccctggggagtctctgcttctccagttgatctcaggaacttcctgttctcaccaacctattttggtctctgtctcccatagacgactagaacctctgagagaggatcggtctcagtgcaggtagcactgcacgggtgatcctgaatgcaaacagctgctgttcccatctccttcctcttcccctaccacatcctctggatctgaaccccagaacaagactgctcaggggaac

SEQ ID NO: 140915 - DNA, 601 bp, Human
atcggggagggtagatcttccaagttcctccacagccctggtggcattggtgggttctggctgcttctctgagccaggtggtggtgtgtctcttcatttagtctcattaattcttcagtgttgcaaatatctgaaacctgttattaaagagctggaacgatatcccactaggttttcaatatggactattgatgaagaaacagtaattggaatagcaggggtctgagataatattgcaagacaaaagaacatacaatttcttttttgtggctcttttgcattctataatttggtggccttsgactatggctgtttgtcgctgtagaaataaactacagcttgtctagtgcctttctgatggataataggttgcttctgatttagctctatttctctttcacatatagtgtggtaataaacatccttgaacctcatcttcttgtgcgcgtgtgttcaagtttctctaggaaagataccagagaggggtttgctggattatagggcatgatcaagtctactaggaattctcaaacaactctgagtgtaaagtgagtgtaccaacttataatcttgctgtctttttttttcttttctgttttcc

SEQ ID NO: 140916 - DNA, 601 bp, Human
atctcagacttcctaacctctagaactgtgggaaataaatttctattttttataaattatctagtatcagctatcccattataagagcacaaaatggaataacaggctttatgctggaaaagcatttaaggtaggtcttcaggcaacttgaagtattctgacagacgtgggaaaggaggattaatccaggaaaaatgaatagcataaagaaggactgggcagtatacaacaacaaaatttaagggcatatttggaaaataggaaatcattcatcttgttagcagcatagaatacatagggrgtagtgtgggagaaactgttggaaagctaggttgatgcaatttccaacctacgtcacattttaggaggttttaaaattctgactaaagagttatatccagcatagttttcaggctccttctcactcgcaggaaaaaatgtggcccaggttacctttctttttttcccttcacactctggcctttcctaggaagtgagttctcatgtttatctccccgacacaatggcaagcagttagggagaagggttcagcccctcagcatgggcagcttcgttttcagcttttgtactagagaatttc

SEQ ID NO: 140917 - DNA, 601 bp, Human
agaatgcatatttttatcctaaaatgtctaaagtgtgtgtgtgtgtgcacacgtgtgtctaaggggtagtaggtgagtgggtgggggtaaatctgagcagtgcatcacagttcatctttagtagatactgttaaacaatattcccaagtgtttatgcccaaataccctcttaatttagattctgatatccccacatggactctttccaaaaagataaagaaaaatgtatagaagtgaaacaaatgtaaaaaatattctgtatattaacttattattttctatatggtggagaaagcaaaaytgagaaccattgaaatgggttgtttattattttctaacttatggcttgatatcctgaaatctgtcaacactacccaggttgttctgaaatctagctatggatttagtagatcctaaagacttcctactgtgctgagaaaaaaaaacagaaaatgaaatatatgaattgacttttctcaaatttcatttttcagagtggccaaatcaatgaaggtccctgtatatgagaccccagctggatggagattcttctcaaatctgatggactcaggacgttgcaatctgtgtggggaagagagct

SEQ ID NO: 140918 - DNA, 601 bp, Human
tctttaaatataagggctcttgttcagaaaaaccacataaccacagtaccattatcacacctaaaatgttaaaaacgttttctttttttacatactttaaatacttcatccagttgttttctggcttgcatcatgtccaagaagtcggatttaatttttatgtttattcctctatgtaaagtactctgtgtaaagtaccccccagtctcctgcctttggctgacttcaatattttttaatctttgattgtcaaaagtctaatcatattaataatgtgtctaggggtgtatgcatgtatgtrtttaaccctatgtgggattctcttgaattcttggctctgttgtttgttgttgttcattaattttaggaaatgctcagctattattttttcaaatatttctccttccccattctttgtctcttgtccttctgaggctccaattacacatgtgttagataatttgtgatgacaaatgagctcttacattcatttttctgatttatttctccccttttttcttcttgtgtttcagtttagatcgtctctattggaacatctttaagttcactgattctttccttagctgtgtccaatctgctg

SEQ ID NO: 140919 - DNA, 601 bp, Human
tttgttgttgttcattaattttaggaaatgctcagctattattttttcaaatatttctccttccccattctttgtctcttgtccttctgaggctccaattacacatgtgttagataatttgtgatgacaaatgagctcttacattcatttttctgatttatttctccccttttttcttcttgtgtttcagtttagatcgtctctattggaacatctttaagttcactgattctttccttagctgtgtccaatctgctgatgagcctgttgaaggaattcttcttctccgatactgtgtgtkttttttttttttttagcatttctctttgactcttttaaaatagtttttagttctctgaaattccccatctgtttatgtaattgtttatctttttcattagatcatttaacatattagacatggttgttttaaacaccctgtctgatagttccaatctctggttcatctctgactttggttcagctgattgctttatctcttgacaatggtttgggttttcctgttttttgtagatctcataaatttttattgaatgctgaataatatgtggataagaacagtagatattcaggtcaattg

SEQ ID NO: 140920 - DNA, 601 bp, Human
cgtgtgccatcactccctgactaatatttgtatttttaggagagacaggatttcaccatattggccaggctggtctaaaactcctggcctcaagtgatccgcccaccttggcctccgaaagtgctgggatggcaggcatgaaccgccatgccggccactattactttttactatgtgttctttaaaaactaatgtcaatagtcatacaaatttgccaactaaaatcaagcgatgtaacaatgtttattatttccaagaaagtactctgttgagtctttcacagaaataatagtgttttttaaaaaaaaaatgagcacttagtatgtaccttttgtatgtattcatctttttctagaaatttggaattgaatccagagctgctggcattagcatgagttgtccatacttgtcacaccaaatttttccactgtgaactctgaagtacagcctggtgctcttgaagttgactgttttcatatgtgcccaatttctagcacaagaaggggccctgagtgtgtgtgtattctgtgtcacaaggactcttgagtatctttccagtcttttgaggtttgctggatgcttccatgcatggattccatgc

SEQ ID NO: 140921 - DNA, 601 bp, Human
ttaggagagacaggatttcaccatattggccaggctggtctaaaactcctggcctcaagtgatccgcccaccttggcctccgaaagtgctgggatggcaggcatgaaccgccatgccggccactattactttttactatgtgttctttaaaaactaatgtcaatagtcatacaaatttgccaactaaaatcaagcgatgtaacaatgtttattatttccaagaaagtactctgttgagtctttcacagaaataatagtgttttttaaaaaaaaaatgagcacttagtatgtaccttttgtrtgtattcatctttttctagaaatttggaattgaatccagagctgctggcattagcatgagttgtccatacttgtcacaccaaatttttccactgtgaactctgaagtacagcctggtgctcttgaagttgactgttttcatatgtgcccaatttctagcacaagaaggggccctgagtgtgtgtgtattctgtgtcacaaggactcttgagtatctttccagtcttttgaggtttgctggatgcttccatgcatggattccatgccaatattgtaaatgccctgaagacagggcccatgt

SEQ ID NO: 140922 - DNA, 601 bp, Human
ggctcatgcctgtaatcccagcactttgggaagccaaggcgggtgaactcctgaggtcaggagttcaagaccagcctggccaacatggtgaaaccttgtctctattaacaatacaaaaattagccggatgtggtggcgggtgcctgtaatcccagctactcgggaggttgaggcaggagaatcacttgaacccaggagatggaggttgtgatgagccaagatcgtgctactgcactccagcctgggtgacagggtgagactccatctcaaaaaaaaaggacaattcttagagtcctattgytcctatctgccttggtgacaaaaaaaaaaaaaaatgagttgggatgtatgagttaggagcatgctggtatgctctgtgagggaagcatgtcagctggctggccatgatatggttaatgtgctccctgctctgggatggatggcttgatgcctcctaagtgatagacacaattcctagtgcctcctgtactttattttagagtcttcttcacaatgatggtatagagaccctaatgaccccattttgttgatgaagtcgttgaggtttagggaggaatgtcaagccgctggccaaagtcac

SEQ ID NO: 140923 - DNA, 601 bp, Human
gagacaacttcgtctgaggggatgatctgtaggtttcttccatcatgatatttcaggttgcttctaactagctacccttagtgaggagcaaacctgatgaattatatgcactacatactaaagaggcattcatttattcattcagtgaacatttactgcacaccttctatgagccagcccagggtagagtgcgagtaatttcagacacaggcccttccctcagggagtttatagggtgttgctatggtcaggatatcagccttgtgtgaaacactatttattactattttacttattaaaygtgttgtgacacagaattattcactgggagccacattgcccacagcacaggatgtgtcctttgctgctgtctgactcttctgcgcttgcacctggctctgacttacatgcaggagagctttgttctctaattgatgaacattaggtacatttaagaatatttttttaagcatagaaaggtgacttttttttcagtgagccttgctttttcacctgatgttaaagatctgaacataagtggtttgagaaatgaaaatcaatctatctatcagtctaccgatcgatcgatcgatctccatca

SEQ ID NO: 140924 - DNA, 601 bp, Human
tgaagtgatcccactgggcagggtttcctaaacttgttttttggcagttggccatggagctaactcagtcttccaaacttcttccatttttgtagcagtgtaaagaattcactggataagactaaagacacttcatggtgtgatgattaatgcccagggtcctgttaacccagaggcaaccacaactggacatccaacagtgccattagcagaccgttgatcagtgtgtaggaagaactaaaaacctgaccctttttcttattgattttagtaccttcacagcccccctcaggtttgcatrttttccttattgagaaaaaaagtttaacatttaacaccataaatgtcacaagtacggtaaatggtctgtagctttagttagaagttgtcaaagatgtttgacttaagtattgtttgatcccattttcaggggttaaacagctctgtggcgttgcgtctcccttgttggttttccatgtatgttttgtagttctgaaacccaagaatactgttgtccattctcattgccctgctgcaagaaggtccactctgtggacccagtcctgtttcttaagacattactattgctagagtgagagga

SEQ ID NO: 140925 - DNA, 601 bp, Human
gggcagggtttcctaaacttgttttttggcagttggccatggagctaactcagtcttccaaacttcttccatttttgtagcagtgtaaagaattcactggataagactaaagacacttcatggtgtgatgattaatgcccagggtcctgttaacccagaggcaaccacaactggacatccaacagtgccattagcagaccgttgatcagtgtgtaggaagaactaaaaacctgaccctttttcttattgattttagtaccttcacagcccccctcaggtttgcatgttttccttattgagaaaaaaagtttaacatttaacaccataaatgtcacaagtacggtaaatggtctgtagctttagttagaagttgtcaaagatgtttgacttaagtattgtttgatcccattttcaggggttaaacagctctgtggcgttgcgtctcccttgttggttttccatgtatgttttgtagttctgaaacccaagaatactgttgtccattctcattgccctgctgcaagaaggtccactctgtggacccagtcctgtttcttaagacattactattgctagagtgagaggataaaattacatgaat

SEQ ID NO: 140926 - DNA, 601 bp, Human
aactatctgtattaatctcctagggctgtcataacaaatcaccaccaactgggtggcttaaagcagtagaaatgtattctcttatagttctggaggccagaagtctaaaaccaaggtgtaggcaggaccacccttccttggaaggctgtagaggaggattccccttgcctctttcagtttctggtggctccacatgttccatgacttgtggcggcacaactgtaatctctgcctctgtctgcacatagcttgcccctctgtatttctcctcttctgtgtcttctcctcttcttataagaaygtttatcattggatttaggtgcttgagataatctcacctcaagattcctaacttaattgtatctgcaaagagcatttcccaaaataaggtcacattcacaggttccaggtggacatatctgttgggtcggggaaccaccagccaaccttaggtcaagcagcttttggtgctgttatgctctgtgacatcatcacctctttattttcttcaaagcacttgtccttatttgatgcatcttgttctcttatctacttttctttgcctgtctccacctaactccatctacttggattcaaactt

SEQ ID NO: 140927 - DNA, 601 bp, Human
ctccacatgttccatgacttgtggcggcacaactgtaatctctgcctctgtctgcacatagcttgcccctctgtatttctcctcttctgtgtcttctcctcttcttataagaatgtttatcattggatttaggtgcttgagataatctcacctcaagattcctaacttaattgtatctgcaaagagcatttcccaaaataaggtcacattcacaggttccaggtggacatatctgttgggtcggggaaccaccagccaaccttaggtcaagcagcttttggtgctgttatgctctgtgacrtcatcacctctttattttcttcaaagcacttgtccttatttgatgcatcttgttctcttatctacttttctttgcctgtctccacctaactccatctacttggattcaaactttatgagtaaagaactatcttgttcactgctttaccccaagacgtagaacaatgcctgatatattgtaggggtcactaaatatttactgaataaatgaataatctcattgggctaatgagatgtcaacttggctctctgatcccttcagaaatttccaagttttattttttttactattttatttgaa

SEQ ID NO: 140928 - DNA, 601 bp, Human
tagtaacaactattcagagcttccttcttccagttcactctgagaactcacatcctttctctatgctacaggaagcccaaatgtaagatcctccaagtgacttgggtgcagctgcccctcctatggcttccttcttaaacagacagtcctaggtgtgccattaggtctcagccaagaccatctgacattgtaaaatatagtttatttatggtggtgatggcaaataaaagttgttagctgtttttaagcacaagtgcctggcactgtgccaactcttggtatacatcatcatattttaaamcccacaatgacaaatgcaattggtattatttttagtcttttattttattttttctaatcgacttccagccccattgttacatttaatacgcttggctaggaggacttttttgaatggaacaattgtgatatttcttccaagtttccaagagttctatattgtgctcagttccccttctccctttctttttaccttccttgatttttctctctttccttccttcctttcctttctcccatttttcattccattctacttacatagaacttactatgtactagaaatagcagagagcaagac

SEQ ID NO: 140929 - DNA, 601 bp, Human
tctgtgctgtccttccctggaaacagaaccaatgattaaataactgtaagtgggccacccagttgctggttctctgattaggtttctgttcctcctgtgtcctcaccaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacaggtacttgytaggaaatcactacaacgggttatcaggcagaaccagtggccaaaatgtcctagaactggagaggtccttagggatgatctaaggtgacctcattttatagatgagaactgtgcagccaggaaagaggaaagcccttgatgaaggacacctaacaagttagtgcacagggtagattagaacatgggctttctgtggccaggcacagtggctcatacttgttatcccagcattttgggaggccaaggtgggagggtcacttttgagctcaggagttcaaaaccagcgtgggcaacaaagtg

SEQ ID NO: 140930 - DNA, 601 bp, Human
cttagattcaagtctcattttgatgtagaattcaagagatataaaataatgtgccttttaaagtatccttgggatatttttgctcaccgacaaggaaggctcggaaaccattccttcaagggaatggtctaatccgcactcagttatggattttatctacttgcaagaagcttgtctgttgagcttatttgttttgctgttaatgcagtattcctctaccttatatcttcctcagtgtactcagtgcttggataccttttccttagattttctttaactgttcacatcaggccagttctgmaactggatctcaagttcatctatttatttcatttcccctccccctccataactctgactgttggttttcatttttacactggaatgtgtttgatagggtttggctgtgtccccacccaaatctcatcttgaactgtagctcccataatccccacgtgtcatgggagggaccaggtgggaggtaattgaatcatgggggtgggtttttcctgtgcagtcttgtggtagtgaataagtctcatgagatctgatgtttttataaagggcacttcccctgcacatgctttcttgcctgctgcca

SEQ ID NO: 140931 - DNA, 601 bp, Human
tgacacttcaggagcaaaatttaagcaactgagtctctttttatgactcatcctaatcctatgttgttgttgttgttgttgttgttttcttttttctttttcttttctttttttttttttttagacagagtctggctctgtcgcccaggctggagtgcagtggtgtgatcttggctcactgtgacctctgctcccgggttcaagcgattcttgtgcctcagcctcctgagtagctggggctacaggcgtgcaccaccacgcccagctaatttttttatacccttagtagagacagggtttyaccatgttggccagtctgatctcaaactcctgacctcaagtgatccgcccacctcggcctcccaaaccaactcctatatttctaacaagctcaaaaatcatgaaactcttccagtgctgaagtcatttgcaagtcacagttcagctgatggttaaaaagctgatgtaaataaatgcataccagttaggtgatgtggaaaaccaaatccaatttgattatgtcaggctaactctgagctgattaatacctcttcaagttaagcaggctatgtggaaacattttgatgttgtccttaacctg

SEQ ID NO: 140932 - DNA, 601 bp, Human
ttgcaagaaggtgtctgctctttttaatttcagtgtttagaaatagtaaattggcaatctcaaagtcacattttatttccagcatgtggtgttttaatatgtacctcgatgcaacaaacccctggtcagcaaatatgaagcagctcactaaggtgttgtccccagcactgtataaaagcaactgaatcatatcaactggagaatctgaagctttaagattgagttcttctctcttcagagttagctagtcaaatttcagcttcaactttttgtttttgttttttgttgttgttttgttttytgttttttgagacggagtctcgctctgtcaccaggctggagtgcagtggcatgatcttggctcactgcaacactgcaacctccacctcctgggttcaagagattctcctgcctcagccccccgagtagctgggattacaggcatgcgccaccatacccggctaatttttgtatttttagtaaagacagggtttcaccatgttggtcaggctagtctcaaactcctgacctcaggtgatctgcttgcctcgggctcccaaagtgctgggactacaggcgtgagccactgcgcctgacctca

SEQ ID NO: 140933 - DNA, 601 bp, Human
gttctccatagagaggtgatatctaagttgtactctgaagaatgggtagaaggcagcccaggtgaaaccattttatcagactctttgcttttcttcagtccaatgtggttgttatatggttgtttagctctccagataaagagctaaggtttcctataggcattctcaatgggatgctacgataactgtgattaggattctcaacttcagtgctcactctacaacactgtagttggggaaaataaagacagtcgggctctgtattgcactatggcttgtgctaggacattttgaaaaccayaggtttaaaaaaataatttctactagccacttttcctgtgattttcctatttgtcctctgaaggccaaacgcatattcagtactttataatgacctgtcagctgatttgaaaataaaatgggaagctgggtgcaatggcttatgcctgtagtcccagctacttgggaggctgagacaggaggattgcttgagtccaggagtccaagatcaccctgggcaacacagcgagacctcatctcaaatttttaaaaaagcgagaaagaaaatagaatgagggagaccctgtttctggttagtcgg

SEQ ID NO: 140934 - DNA, 601 bp, Human
tcctttatcaatcattcttcactgggacaaagctaaggtgagcagaactcgactgtcatcattaaagctcacaaccacaggcactgaaaagtaaggaaaacactaagctggaactgaagtgctcttttgatacccacactcctccccaccacataattaacattgtcttctaataaaggagagcatatttttcccttttttgagtgtgtggctatgtgtcatcctggatattccggctactctagctgctgtggctagtgagatatcatgaattctttcacagttgctccaggaattcctwcgaagactgtgctaaaaaaaaaaaataataatgtcagatggttcaagaggtggttctgctgctgacaaggccccagggggaagctttcaggattcagtggcatgaagttgttttattagcctcactgtgttaacagccctcctacagtcccagcccagtgagagcctatgtatgaaaccttaaatcctaaagggaccttccttataagggacatgtagcacagtccagtcacttgatagatgaggcaagtgacccagaaaaaagaggttattgcaattagttactgcacattagaatcac

SEQ ID NO: 140935 - DNA, 601 bp, Human
ttatttcatttttaaaaggcttagttatgagcagataacacatgtttatagtttgttatgacctgaattcttaaatttcccctcactggccaaaaatgaatctgagaatgttaattgtttaatgggaggtacttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaaygggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaattattgtgtctttatattcatatacccaggatttagc

SEQ ID NO: 140936 - DNA, 601 bp, Human
acactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactatttttccctacccacctcttacatgaaaattgtgtacttctcaatatcctgccctttccyctttaaatttggagccttcaaaatcatctttggggaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaataga

SEQ ID NO: 140937 - DNA, 601 bp, Human
gcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactatttttccctacccacctcttacatgaaaattgtgtacttctcaatatcctgccctttcctctttaaatttggagccttcaaaatcatctttggrgaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagattta

SEQ ID NO: 140938 - DNA, 601 bp, Human
gccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcatcacggctcatcttccggctcagttcctccagtggtgtgcgggccaccctcagactgtacgcagagagctacgagagggatcccagcggccatgaccaggagccacaggtacagaaacagctgtgctcccagcagtgtgtctygcagctcctggcaaatttagagagctccatgggcctttagtggggctattttacctcctggaaaggtacatgataatttcagctggaggacaagctcagggcaactccaagcaagtttaattcgttcattacagtgtttgaaacagaaaaattgctctctcgcatctatttgtaatccgtttagaccagcatttcccaaacaactgtcctctcttgactgttgagtggtttgttaattggggtaaagaaaaagcaccttttatagacaaggaaatttagcgttagagtcaaactggtgaa

SEQ ID NO: 140939 - DNA, 601 bp, Human
gagaggagaggatataggtggccttttaagttaaggaagcacattgacaaggctaagccagactgtttggcaaagtctcctcatgttttcaacaataaggctaattaagaactcagaaaaatcataaataacacaaccataagcctctccactcccacattcattaaagctccagccaacattaattaataccagaaatgactcactttaatgttgggtacttcaagctatacagctggctgctcctgtcttcttggtgtcttcaatctgggttttgaagcaaggtccttgataagatgattttttcagatgaaaacattggttctacctgccatacttcctttgtggaaaagtagagaaacagagaaatactcactgctactcattttagaggtgctcagaatttctagctataatttgccctgatggagtaagatacctggcaggcttttctttctttgtcagtagtttaggggtttttttgttttgttttgttttgttttgtttttttcatggtctgtttctttggagagtctcaaagaacttggcaataatgggtgctacagatccttacacctgaccctacagccagaagatctgt

SEQ ID NO: 140940 - DNA, 601 bp, Human
agccatctacacttaaattattttgcaagagaacagagagttcccttcaactggcttattaatatctggctattttactttggccatggatagtttcttttccagacattttgaacacatgtgaacagagcatgttttaagcatttacactgattgccttgcagacatactcataacaatcctagtgatgcaattaggaaaacttgtgatataatctatatgcatttagaccatactcacatgtagattttccatttgcatccttttgtagaacagtgattatgctatttaagttaatatyaatttcttatctacatcaaaaatattttttaaaaattatatccatatgtgcctacgaattggtggtaaggagaggatgggccggggagggccctgatgagatgggcaggttcttgccctgatcccactctgtgtccttggtaaatcaggaaggaaagcttccaaaggcttgttgctggaagactacctagttttttaaaatacaagtttattttaattttaccagcaatcagtaggccttcaatgagccctcaaaccagctggtaatcatttggaaaaaggaatgagccaaaagggttta

SEQ ID NO: 140941 - DNA, 601 bp, Human
attttttaaaaattatatccatatgtgcctacgaattggtggtaaggagaggatgggccggggagggccctgatgagatgggcaggttcttgccctgatcccactctgtgtccttggtaaatcaggaaggaaagcttccaaaggcttgttgctggaagactacctagttttttaaaatacaagtttattttaattttaccagcaatcagtaggccttcaatgagccctcaaaccagctggtaatcatttggaaaaaggaatgagccaaaagggtttaaaatcacaggtaaccagaaacagyacaattgtttccgttttctttcccatccaatttattagcagggctgctattattagcttctcgttgaccttcttcccttgtccctttcagcctgtgggtggagtagttaaggaacaatagaagatccaaaaggaaaaggaaggagaagttttgttaagggctaggaaaatcacagactgataatcagcccgtggctaatcaacccttggctttagtactttcaaggcagaatacagtcacacccgatctcaccccagtccttgggaggggcctgattttcccccagtcttcctgaaaatt

SEQ ID NO: 140942 - DNA, 601 bp, Human
catttggaaaaaggaatgagccaaaagggtttaaaatcacaggtaaccagaaacagtacaattgtttccgttttctttcccatccaatttattagcagggctgctattattagcttctcgttgaccttcttcccttgtccctttcagcctgtgggtggagtagttaaggaacaatagaagatccaaaaggaaaaggaaggagaagttttgttaagggctaggaaaatcacagactgataatcagcccgtggctaatcaacccttggctttagtactttcaaggcagaatacagtcacaccygatctcaccccagtccttgggaggggcctgattttcccccagtcttcctgaaaattgaggaatttaagtatttgtttgtttgtttgtttgtttgttttttgagaggaagtctcactctgtggcccaggttgaagtgcagtggcatgatctcagctcactgtaacctccacctcttggattcaagggattctcctgcctcaaccccccgagtagcggggattacaggtgaccgccaccatccctggctgattttgtatttttagtaaggacagggttttaccatgttggccaggctggtct

SEQ ID NO: 140943 - DNA, 601 bp, Human
ctaagaaaactagcaatgaaacctggaaggaaagagggaacatacagaaatgagaagagtcagctcagaggttctcaacccaggcaggctgcacatcagaaccactcaggcagcttggtgaaagtacccatgctttggccccagtcctagagattctactttaattgttttgaggtgggacctgtagtttttaaaaaatttcccagatgatattaattagacaagtgcatctcaaactaattaccggccaatcaccttgggaatgtgttaaaatgtggattctgactcaggtatgaggagsgccagagattttgcatttctaacaagctcccaggcaatactgtgctgctggtccaggagccacccattgaatagcaaagagctaggtgaactgtgaagtgctagcagcaggaccttgaattctttaaaactgtagaatgagcagcacctgtttttaataccattccacacatcgatctctgtcttctagacttctatttctgttgcttattggattccacctgaatgtcttatagacatcaccaacttgacatgtgcaacactgatttcccgccagcctcctgtgcactcctccaaaaca

SEQ ID NO: 140944 - DNA, 601 bp, Human
gctagtttgtgcttttctaagtctctttgcctacatatattcaaataattttaaaacaggggcaagagtagaaagtattgagcaggataatgtctcaaagtatgtgtcagccttaaaattttagttctgtaattataatttttttttttttttaagaaacaagaaacaagttctggtcaggtgggttagatttccctctagtggtgttgaaaggaatttagtatggctgtgttttcataactggctcttggggcggaattaaacttggaaagatgcaaagatgtataggtttttttctatytctgcttagatgagtactttctggaaaggcagacaaaacgccagggcaaacagtccttctttttcttccttagatattgaaatctggactcatactctgccgttactacatattgttttccctggagctgagaacactccttgggagggttggtcatctgatggcatgtgaaaaactcccttggttgggaatctgggagattccctcagggcctagtgtctatcatagaccagggctttttacagttttgatgacaataagcctttttcttggccaaacattgtgatcagatctcctttc

SEQ ID NO: 140945 - DNA, 601 bp, Human
tgtgttttcataactggctcttggggcggaattaaacttggaaagatgcaaagatgtataggtttttttctatttctgcttagatgagtactttctggaaaggcagacaaaacgccagggcaaacagtccttctttttcttccttagatattgaaatctggactcatactctgccgttactacatattgttttccctggagctgagaacactccttgggagggttggtcatctgatggcatgtgaaaaactcccttggttgggaatctgggagattccctcagggcctagtgtctatcatrgaccagggctttttacagttttgatgacaataagcctttttcttggccaaacattgtgatcagatctcctttcaaggtactgagtatgcgaagccctgtgtatccacactccacatggtctaggacttgtgggaaactatggactgccaccgtgaaccactcatgttaatcccacagacagagcccatctcaaatctctctttgtggcaatatatacaaaagaggcccttaattccaaatcttgcaagaataccggcattgccagcttatcccgagaaccagtggtcttaagaacagacc

SEQ ID NO: 140946 - DNA, 601 bp, Human
tggtgccagttttaccatgtctaaagcacatgcttaaccagctattggttaacccagtgatgtttatatccacaaatcaccaagtcttgctggatcttgtttactcagcctgaaaaaggagcatgaatgaatttgcagcggtcacacaagtccagaggtcactggtcatcacttctcttgccagatggatgggtttgacaagctgtgtccagcacaatctgcctttcccagcagcctttttgttctagcccagatgcacagcacaaccacatttccgtgcctttcaggagaaagctacccrggtctcatgaactggtggtgattcaggttttctttgaagtggtgtccttccttggtgtacagtaaataatttgctttgcttatataataaacaagagtgtatcttaacaaatggggactgacagtgaacctggaggttgcctgtggccttcagaaggaagctctggactagtgtgtgcaattagccagcatctggaagcagcttttcctgggcttcccaacacggtcatgcttcattcacatggggaatacaggatctgagctgttaaggggagaatgtggctgtttttgctctcccgtc

SEQ ID NO: 140947 - DNA, 601 bp, Human
atgccctaatcccagaacgagaactcctgttcaagatgcaggtgagggagtttcccatcccttgtttttgactcccaggaacgctggcaggcctgacaaactccagggaggagcatctcaaagccagaatgcttaggccttgggcaggagggaaagctgttaaaggtttatacaattctggtatcgtgtttgtgtttttggttttacttttgagcatttttgttggtacaaatcatcacttgggacatactttggcaggttgggcctgtgtactataccatcatgatatgagatggaaggyagatgaggctgacagagtggcttgaaatgtagacttcattattattcaggtatggggaggccaacagatgatgagatgacggccattgaagagatagtttgttactcacagttcccaagaggaggggacacaacacgccacacagggccacgcagggaagcgccagcgtcggacaggaggcagcatgagcaaagggaaaatgtgggtgaagcctttttggagattctctgggaaaggtaaggtaaacatgatgagaaggtttaggattagcttgtttgaataatttcagcaggctctggg

SEQ ID NO: 140948 - DNA, 601 bp, Human
gtctgagaaaggaagtgtttggtttgcatctgaaaggcaagctccagggtgtgttgtttgctgtctctaagaattagctaaccctgggaagaacaaaaccttccagagtcagccaggccccaagatgtcaaagcattagaataaaaacaccagcttaacagccagaggaaaagataaaaccactgtcactttctcaggtgggtaaaattgttagggagcaccccaacaagattttgtttttttcacataccatcaaagctggatggcctctgatacaaaggttgggctttgaaatcagcatttttttttttttttttttttgagacagagcctcgctctgtcactcaggctggagtgcagtggcgcaatctcagctcactgcaagctccgcctcctgggttcacgcccttctcctgcctcagcctcccaagtagctgggactacacgcacccgccaccacgcccggctaaatttttgtatttttagtagagatgggctttcaccatgttagtcaggatggtctcgatctcctgacctcgtgatccgcccacctcagcctcccaaagtgctgggattacaggcttgagccaccgtgcctggc

SEQ ID NO: 140949 - DNA, 601 bp, Human
ttctctacagaaggccgatttcccccacaaaagatggctttgtagagccattccaaattacgtcaaagaaatatattttggggtaagatgctttgatttccttcagtgcctgttatctgtcatctgatgctatatcagggtcaggttggaatttggtatcttactgctacaaagagtctgttctgtcagtcctagaatctctaaatgtcaacagctaagctccagagaggaggatatattgaggcatatgctacgcccttttcctgttatggcctgaactagttttcgggatccttttggmcaatgattaggggcagggaggagatgtccattcagtcagtttggggcttagaattatatttttggtttatacctgacatgtgaataaatgttcaataaatgttgattgtcactaatgttattgtttttgccctttttttttttttttttttttttttttttagatggagtctcactctgtcaccaggctggagtgcagtggtgcaatctcagctcactgcaacctccacctcccaggttcaagcaattctcctgcctcagcttcctgagcagctgggactacaggcatgcgtcaccatgc

SEQ ID NO: 140950 - DNA, 601 bp, Human
gtcacattctgaggtattggcaattaggacctcaacgtatgcacttatggaagacaaattcaacccataatattagtcgtatggtctgtgttacaacttctcaactgccactgttgcacaaaagccgccacaggtaatacataaatgaattagtgaagctatattccaataaaactataggcactgtaattgacttaagataattttaacatgtcacaaaatcttatttttttcccaaccattaaacataaaaaccatttttatggctgcaccaaaaccaggtggtggccagggtttggcytaaggcctataatttgttgatccttgccttataggtttctgaatatgacacgttatttacaatttctgattacattcagtacagcatgtatcaacatgagtttgggtaaaccatacacactataaatttcaaaattacatttgtatttgtgtatatttgtatacatagatgaattgtgaagttttagggaaaaaaatatcaaatctctctggaaatctccagcatgaggcttctgaggttgaactccatagcttttgattgcaaccaaacatgaaagggaaatgattatgtttgtattca

SEQ ID NO: 140951 - DNA, 601 bp, Human
gaatttgcagtcattatgaattcactttccttttaatggataagatttgataaaaagcttaaaagaaagtacttttacactgtttttaacagcgctttatacttttgctacactaaaggtagttcttggactagcagcatcaacatcacctggttgctacttagaaatgcagaatctcgggccccaacccagatctactgactcagattctgtattttaacaagctcctcaggtgattcatgtgcacattaaagtttgagaagtcctaatgctgggcgtggtggcattagcctataaagtkccatctactcaggaggctgaggtggggaggatcccttgtgcttaggagttgaagaccagcatgggcaacttaaggaggccctatctctaaaaaaagaaaactgatgctggctgtactggcttaaacctccaatcccagcactttgggaggctgagacgggtgaatcacctgaggtcaggagttcgagaccagcctggccaacatggtgaaaccccttctctactaaaaatataaaaattggctgggcatggtggcaggtgcctgtaatcccagctactcaggaggctgaggcaggagaat

SEQ ID NO: 140952 - DNA, 601 bp, Human
ccagacaaaccctctaatgccaaactaaataggatgcatttataggggtgcctggcctctatttcttcctcatttaggaaaatcataaagcatgcagaaaataacccagacaaatgtgccaagatccttgaagacttgttcctgcttctcaggtcaattaacaaaaaaagaaacaagaaaatcagtttcaagttgcatctccatagaaaccctttctcaatatcaactcagcagtgttagacagttttcttcacacaattatactagttgagctgagagattcaaaataacagtggatgargtaaagaaagttctaatttgattttgccaaggcacaaagccttgctaaaattgtgggtagacagtctagcacacttcaattactaggaaaaggtcaattatttaaaacactttaaatatgttaggttaaatggcagctgagtctaaaggcaaaggccataaaagaacatgttcctttgtccaaactgcattcataaagtgtgcattaaccatccattaatttcactaatagtctttctattgtggggaagagtctctcctcgtttacagggctcatttccatgtttttagtgcctggtgt

SEQ ID NO: 140953 - DNA, 601 bp, Human
taacatgaactttattttatgggcaaataaacttaagctagaagggttgttgactatctaccaaaggtcagcttattgggactggtatgctggtccactcacctgtagcctacttttctattaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttktacaaataagaaaactttggccctgagaatttgaacaatctactgtttctaaacagtgtccctggtatttgaacctagatttgggcctcagagcccaagaccttaactaaggtccttattatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttc

SEQ ID NO: 140954 - DNA, 601 bp, Human
cttttctattaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttgtacaaataagaaaactttggccctgagaatttgaacaatctactgtttctaaacagtgtccctggtatttgaacctagatttgggcctcagagcccaagaccttaactaagktccttattatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttcagtcctcctattcccttttatgtcctcagatcctttcccaagggctagccctttcttagaaggctgtaccctctggaagctggagaatgccactgtgctgcttgtaactggt

SEQ ID NO: 140955 - DNA, 601 bp, Human
ttaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttgtacaaataagaaaactttggccctgagaatttgaacaatctactgtttctaaacagtgtccctggtatttgaacctagatttgggcctcagagcccaagaccttaactaaggtccttatyatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttcagtcctcctattcccttttatgtcctcagatcctttcccaagggctagccctttcttagaaggctgtaccctctggaagctggagaatgccactgtgctgcttgtaactggttacctcaa

SEQ ID NO: 140956 - DNA, 601 bp, Human
aggccaagacaggtggatcacctgaggtctggagttcaaggccggcctggcccacatggagaaatcctgtctttactaaaaatacaaaaattaggtgggtgtggtggtgtgcacctgtaatcccagctactcaggaggctggggcagtagaattgcttgaacccaagaggcaaaagttgcagtgagccatctgagccttttatatcaggggctcacatgaacaagtctcttgtaaaaagaagctctctctgatgaaactgagaacagatagcagactcacgcaagctccggatggtggggyagtgtgttaaggaaacaatggggatgagaatgaggaagtagatggggagaaatagaatcagagggtttggcaactgcttggatgtacaggaaagggagaaggacccaccaacaagtacttccagctgagcagattgagagttcagagggacctgctcctagcaggaaagagaaggtggaaccatggactggcatagcgaggaagttaattttggtttgcaagatgttacatttcatattttgggtttgttggtggtagaatactggaccatgatggtacctccaaacaatctaagagaaa

SEQ ID NO: 140957 - DNA, 601 bp, Human
atcaggagaaagtagcatttgttataaatctctattttatggatgccagaatgtcagtgttttctgttgttggatgacctacctgcatttctggtttgtattgcctgccccgaaagatgaactatggtaattatcgtcatccacacctattcactctccacccatggctccaatccttccccgactgtacaaatgcacattcctcatagagaccagcccagcactaggttccctccacagattctgacaaatcttgcttgataagtgattatgattctggttagggtattgttttcctccraaaaatcagttaactatttactttgagtcttgtgacattcagatcatttacatccttcctgtctattgcttgtcccagagtaagaagttcagtttgttagggttgttttttttttaatggatctaatttacatgaaagtggattataacaatgacataaagcaaaagagaagatgggagagaaagtaaaaagagaaactctgtctttccagggagtatggacaagttaaaacctaatctaggatttatgtgggctaggattaatgtgaggttaactgggtgcaaaatttaagtgggtgtg

SEQ ID NO: 140958 - DNA, 601 bp, Human
aaggcagatgactccatggcatctgtgccggattagcccaggctcttggctcaggatgggagtcctcatatttaggagtttcctcatgtggcattttcttcccttcagcttgcataagcaccacggaagccctcttctctgacatgaacagaagaagggacaagtgcttggttgatgaatccagaaacagagttaagtaggtccactatacacatagatatcctattacatttgtatcataaaacatataaatgtacatgcatttgccagtattttgattttggcccaagacctgttcttyaatatgagcatactgtttgccattgtgatcctctttcttcaaaagattcccactcataattcatcatctataatatctgtctttgattcctttatattacagcgggaacttaaggacaattgtgaagcaacctgaaaaaataattcttctataattttaaaatttctccctaatattttgtagtatctcacccacatctaatttgacaggattagctaatcaccattatctgttctttccaaaacactcaacttaattttcatagaaaaaaagtcttcttatttgcattcacgtttcatt

SEQ ID NO: 140959 - DNA, 601 bp, Human
tgtctttattttttattttatttttattttttctttttagagacaggcagggtctcactttgtcacccaggttggaatgcagttatgcaatcatagttcactgtaaccttgaacttctgggctcaagccatcctcccatctcagcctaccgagtagctaggactataggcacacaccactgcactcagctaattcttattttttgtagagatgcggtctatgttgttcaggctggtattaaactcctggctcaagtgatcctctgcctcagccttccaaaatattgggattacaggcatgwgccaccacgcgtggccaatatttgtctttaaattgactcactttgtttttacctcaatctacttatttattataaaagtactctacatggaaaaaacaataccacttgataaatataagcacatcatgaacatgaattcaataaaaacattcagtgacattacattctagctgggtaactcctgaggcatgcactatcttggttaaattgttaaagattggcagcaaacagagtttctccttgatgaaatcagaaggattgaagaacggaaaatagactgattttctcactgttttatta

SEQ ID NO: 140960 - DNA, 601 bp, Human
cggcgctaaggtggccatcaagaagctgtatcggcctttccagtccgagctgttcgccaagcgcgcctaccgcgagctgcgcctgctcaagcacatgcgccacgagaacgtgagtcgcgcggccccgctccgggaaggcgccgcggcctcggcttggttcagctgggctgggttcccccacccggcaacccctcctccaggcagcctgctgtggggccgggcgggggtcgggccgtgggtccccaggggagaaggagagcaaggcctgtctctccttgggagacgactcccccaagggccrttccccatcctccgccagccccgggaaggactcagccccttgactcggcgcctcagccaggccctggtcagggaacacgacttggccaggcccaggggatcctccaggtctcacgccaagccttgcccccagccaggaagcccgcggtgagagcatgctcccggcgggaggattttcctggaaggggcaccttccctcttccccatcccctttccagcccctctgtggagcccactctgctgctgtccatctcccgagtcttccgacccggtggtggagggggaggaggggggcgccaga

SEQ ID NO: 140961 - DNA, 601 bp, Human
gagctgcgcctgctcaagcacatgcgccacgagaacgtgagtcgcgcggccccgctccgggaaggcgccgcggcctcggcttggttcagctgggctgggttcccccacccggcaacccctcctccaggcagcctgctgtggggccgggcgggggtcgggccgtgggtccccaggggagaaggagagcaaggcctgtctctccttgggagacgactcccccaagggccgttccccatcctccgccagccccgggaaggactcagccccttgactcggcgcctcagccaggccctggtcaggsaacacgacttggccaggcccaggggatcctccaggtctcacgccaagccttgcccccagccaggaagcccgcggtgagagcatgctcccggcgggaggattttcctggaaggggcaccttccctcttccccatcccctttccagcccctctgtggagcccactctgctgctgtccatctcccgagtcttccgacccggtggtggagggggaggaggggggcgccagaacgcagggagtgtgttgaaccctcaggagcccctgggggtgaagggtttagggagctgctgtttgaggagcac

SEQ ID NO: 140962 - DNA, 601 bp, Human
ctgggcgtggtggccgcctcacagacaccctcctgtgcgttgtgggggcccatcctttccagtccttccagtgagatgccacgtacagctgccctgggcctctcccatggcggtggctggctgctaagaacccgatctctctgccaggggtgctctggtttctggatacagtcccacttgtccactgccccccacgtcactcctgccctccccctggtctgggcccagcctgagggctggtggtctgggcacccggaccctacctacagggtgagatgctctggaccctcctgggtcatcygagccaccggtgccttgggagaacgagtccctgcgtccaccagcaaagtgccccgtccaccagcaaagtgccccgtcccccggttcctggccaccgctactccctcagccccttggatgggtctttttctctgaggcttcccatgcccaccctgacccccagctcactaccctgggccctgtgaaatccatttgcagtggacaccagccctgcccgcacctcgacaccccgtcacacccagccctgcccccacttcgccggcaccgcacccccccaccacccgcccatcacaccaaggcc

SEQ ID NO: 140963 - DNA, 601 bp, Human
atgctctggaccctcctgggtcatctgagccaccggtgccttgggagaacgagtccctgcgtccaccagcaaagtgccccgtccaccagcaaagtgccccgtcccccggttcctggccaccgctactccctcagccccttggatgggtctttttctctgaggcttcccatgcccaccctgacccccagctcactaccctgggccctgtgaaatccatttgcagtggacaccagccctgcccgcacctcgacaccccgtcacacccagccctgcccccacttcgccggcaccgcacccccccaccacccgcccatcacaccaaggccttgccccaggactgcagccttccccacggccccctgctcccacccacccactcacccacccgtgccttgccccatccagccaagcgctctggggctttttttctttttttttcttttgagaccgagtttcgctcttgttgcccaggctggagtgcaatggcacgatctcagctcactgcaaccttcgcgtcctgggttcaggcgattctcctgcttcagcctcctcagtagctgggattacaggcgcgcgccaccacgcctggctaattttttgt

SEQ ID NO: 140964 - DNA, 601 bp, Human
tctggaccctcctgggtcatctgagccaccggtgccttgggagaacgagtccctgcgtccaccagcaaagtgccccgtccaccagcaaagtgccccgtcccccggttcctggccaccgctactccctcagccccttggatgggtctttttctctgaggcttcccatgcccaccctgacccccagctcactaccctgggccctgtgaaatccatttgcagtggacaccagccctgcccgcacctcgacaccccgtcacacccagccctgcccccacttcgccggcaccgcacccccccaccmcccgcccatcacaccaaggccttgccccaggactgcagccttccccacggccccctgctcccacccacccactcacccacccgtgccttgccccatccagccaagcgctctggggctttttttctttttttttcttttgagaccgagtttcgctcttgttgcccaggctggagtgcaatggcacgatctcagctcactgcaaccttcgcgtcctgggttcaggcgattctcctgcttcagcctcctcagtagctgggattacaggcgcgcgccaccacgcctggctaattttttgtattt

SEQ ID NO: 140965 - DNA, 601 bp, Human
ccgctactccctcagccccttggatgggtctttttctctgaggcttcccatgcccaccctgacccccagctcactaccctgggccctgtgaaatccatttgcagtggacaccagccctgcccgcacctcgacaccccgtcacacccagccctgcccccacttcgccggcaccgcacccccccaccacccgcccatcacaccaaggccttgccccaggactgcagccttccccacggccccctgctcccacccacccactcacccacccgtgccttgccccatccagccaagcgctctgggrctttttttctttttttttcttttgagaccgagtttcgctcttgttgcccaggctggagtgcaatggcacgatctcagctcactgcaaccttcgcgtcctgggttcaggcgattctcctgcttcagcctcctcagtagctgggattacaggcgcgcgccaccacgcctggctaattttttgtatttttagttgagatgaggtttcactatgttgggcagactggtctcgaacccctgacctcaagtgatctgctcgcctcggcttcccaaagtgctggggttacaggcgtgagccaccgcg

SEQ ID NO: 140966 - DNA, 601 bp, Human
ccaccacccgcccatcacaccaaggccttgccccaggactgcagccttccccacggccccctgctcccacccacccactcacccacccgtgccttgccccatccagccaagcgctctggggctttttttctttttttttcttttgagaccgagtttcgctcttgttgcccaggctggagtgcaatggcacgatctcagctcactgcaaccttcgcgtcctgggttcaggcgattctcctgcttcagcctcctcagtagctgggattacaggcgcgcgccaccacgcctggctaattttttktatttttagttgagatgaggtttcactatgttgggcagactggtctcgaacccctgacctcaagtgatctgctcgcctcggcttcccaaagtgctggggttacaggcgtgagccaccgcgccgggctccaccggggcttttctttagccaccgccccgctgtgctgggatctccgctgtgcctgtgggcccaccccctgggctcctggcctgcagctgaggctctttccctggaaccccatcttcctgggagactgaagctctgtgaggccacgtgccttgctcagcgggggaggaggct

SEQ ID NO: 140967 - DNA, 601 bp, Human
gctctttccctggaaccccatcttcctgggagactgaagctctgtgaggccacgtgccttgctcagcgggggaggaggctctgccacaggcctcagtcctgccaggccgcctccctctccaggccagcccccataccacagaggccaggccaagtcctgtggcccctagcccacaggaccctgctctccgtcttctgctaaagcactctcccgggcaccctccagctctcatgtccacagtccccgctgccccctggacaccccctctgttccctctcctcctccctccacattcttgccyatggctctggcccacgtggctccggcggagctgtccttccagcttgtgtccattcttacctcactctggccggttcctacaccacggccaggaggacgcatttagcctcacgtccccatttaaatcgtccccgtctcttgggatcaaagccaaacttccacctggtgtgtgctgccctgccggctccctctggcctctcctcagcccctccctggcctgggcctccgccacctggcctccctccctgtattcttcaaactatccaagtgtgctccctcctgcctcggccactctgtgtgt

SEQ ID NO: 140968 - DNA, 601 bp, Human
ccaggccagcccccataccacagaggccaggccaagtcctgtggcccctagcccacaggaccctgctctccgtcttctgctaaagcactctcccgggcaccctccagctctcatgtccacagtccccgctgccccctggacaccccctctgttccctctcctcctccctccacattcttgcccatggctctggcccacgtggctccggcggagctgtccttccagcttgtgtccattcttacctcactctggccggttcctacaccacggccaggaggacgcatttagcctcacgtccccrtttaaatcgtccccgtctcttgggatcaaagccaaacttccacctggtgtgtgctgccctgccggctccctctggcctctcctcagcccctccctggcctgggcctccgccacctggcctccctccctgtattcttcaaactatccaagtgtgctccctcctgcctcggccactctgtgtgtgccctctgccaggtgtcccgcagcccacatgtctacctgcccctccacccttggctgtgcaaaactccaggcctccctgggaccgtcaccccaaaatgctgaggcggcagttgtcaca

SEQ ID NO: 140969 - DNA, 601 bp, Human
ctgggcctccgccacctggcctccctccctgtattcttcaaactatccaagtgtgctccctcctgcctcggccactctgtgtgtgccctctgccaggtgtcccgcagcccacatgtctacctgcccctccacccttggctgtgcaaaactccaggcctccctgggaccgtcaccccaaaatgctgaggcggcagttgtcacatgacctgtctactgtctatctccccaaccaggggtgctgaggggaccaggtctggtgggtcacggtgctgtccgcctgggcctcaccagcagaggcctrgcctctttccatagcgctgtccccaccctgggcctggatctgtttggttggggtgaagaggggtgaaagggtcaggcggcaggagccctttggatggttcggagccatcccagactccgggttgcccctcccccagaagatcccggttgtcaccgtccaaaaataacctttctgtgggtatgtgtgccagggctgggccacactgccagtgggtatgtgtgccagggctgggccacactgccagtgggcagagccaggccctttggacagtggggcatgacaatgacagctgcagagggg

SEQ ID NO: 140970 - DNA, 601 bp, Human
ccaaaaataacctttctgtgggtatgtgtgccagggctgggccacactgccagtgggtatgtgtgccagggctgggccacactgccagtgggcagagccaggccctttggacagtggggcatgacaatgacagctgcagagggggtttcctgcccagagggttgtgccactcttggggggtgccccagcccgtgtcctctgctgcattctcaaccctatgtggcccccccaggtgatcgggctgctggacgtattcactcctgatgagaccctggatgacttcacggacttgtgagtgccracctgggctggccgctgggcacgaggggtgttgggcagctctgggcactggcttcaggttctaggttggcaatggggttctcttcctgcagcctgagtgggggatgcacaccgcccaccccctccccataccactgtccaccccacgccctcccccacatggtcctgggacccacgggcactggcacagctgggcagagctggggctgctgcctctctccacgcctggcacctgggccctctccagcaccggaggtgtgaaccttggacctgaccatttgttaacaggaaggtcccgtgc

SEQ ID NO: 140971 - DNA, 601 bp, Human
tctgtgggtatgtgtgccagggctgggccacactgccagtgggtatgtgtgccagggctgggccacactgccagtgggcagagccaggccctttggacagtggggcatgacaatgacagctgcagagggggtttcctgcccagagggttgtgccactcttggggggtgccccagcccgtgtcctctgctgcattctcaaccctatgtggcccccccaggtgatcgggctgctggacgtattcactcctgatgagaccctggatgacttcacggacttgtgagtgccgacctgggctggccrctgggcacgaggggtgttgggcagctctgggcactggcttcaggttctaggttggcaatggggttctcttcctgcagcctgagtgggggatgcacaccgcccaccccctccccataccactgtccaccccacgccctcccccacatggtcctgggacccacgggcactggcacagctgggcagagctggggctgctgcctctctccacgcctggcacctgggccctctccagcaccggaggtgtgaaccttggacctgaccatttgttaacaggaaggtcccgtgctcgggaccctggca

SEQ ID NO: 140972 - DNA, 601 bp, Human
ctgggactcacaccctgtcggccaagagtgaagggccaggccgaggaaggcctggagagggtagcaggcgcctcccgcctgacttgcagaggtcaagtcagtggcctctgggaaggtgctaaataccattctcctgtgtctgtctccaccggcccagccgacccctctgacccagatgccttgccgcgcccccatcgcccccaggcacctccctcatttctggcacaaagttgtgaagttgaaacctgactgcctccctcccctgcctgtgaagactcgagtcctgctgcctctaccatgsagcctcagcccctagcctggcacgcagggcgcttcagaggagggttcaaaaaccccaaggcagcctcctccctgcctgacagtcctcagggtgggaggggggtgtgagcgctgctggcagtaacagttgcgggaggatggagcctggcactgcaaggtggggctgcgaggacaccgaggccagtgtggatgtgtgctgcaggggtgaccttcctgggggtgcctgttggatccgggacgggtctgagcctgggcctgctgggtgggtctctgggatgcagaggctggctctgtccgctga

SEQ ID NO: 140973 - DNA, 601 bp, Human
gggtgctggagtgtggggcctcccgtggtctggcctgatgcaccttcccccgcagctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggaccygtgagttgggggctctgggcagggcctgtgtgaacccgtgagttgggggctccgggtagggcctgtgtggaccccgtgggccctgtgcaggtggccaggctcagagtcctagatccccatccctgggatgcaggtcaggtgaggaggatgggaggtcagggcagcatggggccgtgtggcctggtggagatgacctctggctggagctggaagatgaagggaagggtgttcctggcaggctcagcacagaggctggcacagaaggagccgggagtggtgaaaggcagctgtgagtcaggg

SEQ ID NO: 140974 - DNA, 601 bp, Human
ggcctcccgtggtctggcctgatgcaccttcccccgcagctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacccgtgagttgggggctcygggcagggcctgtgtgaacccgtgagttgggggctccgggtagggcctgtgtggaccccgtgggccctgtgcaggtggccaggctcagagtcctagatccccatccctgggatgcaggtcaggtgaggaggatgggaggtcagggcagcatggggccgtgtggcctggtggagatgacctctggctggagctggaagatgaagggaagggtgttcctggcaggctcagcacagaggctggcacagaaggagccgggagtggtgaaaggcagctgtgagtcagggaaccagggcccactta

SEQ ID NO: 140975 - DNA, 601 bp, Human
tcccgtggtctggcctgatgcaccttcccccgcagctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacccgtgagttgggggctctgggyagggcctgtgtgaacccgtgagttgggggctccgggtagggcctgtgtggaccccgtgggccctgtgcaggtggccaggctcagagtcctagatccccatccctgggatgcaggtcaggtgaggaggatgggaggtcagggcagcatggggccgtgtggcctggtggagatgacctctggctggagctggaagatgaagggaagggtgttcctggcaggctcagcacagaggctggcacagaaggagccgggagtggtgaaaggcagctgtgagtcagggaaccagggcccacttagccc

SEQ ID NO: 140976 - DNA, 601 bp, Human
cctgatgcaccttcccccgcagctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacccgtgagttgggggctctgggcagggcctgtgtgracccgtgagttgggggctccgggtagggcctgtgtggaccccgtgggccctgtgcaggtggccaggctcagagtcctagatccccatccctgggatgcaggtcaggtgaggaggatgggaggtcagggcagcatggggccgtgtggcctggtggagatgacctctggctggagctggaagatgaagggaagggtgttcctggcaggctcagcacagaggctggcacagaaggagccgggagtggtgaaaggcagctgtgagtcagggaaccagggcccacttagcccctcctggccccca

SEQ ID NO: 140977 - DNA, 601 bp, Human
atgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacccgtgagttgggggctctgggcagggcctgtgtgaacccgtgagttgggggctccgggtagggcctgtgtggacccygtgggccctgtgcaggtggccaggctcagagtcctagatccccatccctgggatgcaggtcaggtgaggaggatgggaggtcagggcagcatggggccgtgtggcctggtggagatgacctctggctggagctggaagatgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggc

SEQ ID NO: 140978 - DNA, 601 bp, Human
tggatgaatggaagcgtgagtggggggctcctggcacggcctgtgtggacccaagtggggggctctgggcagggcctgtgtggacccgtgagttgggggctctgggcagggcctgtgtgaacccgtgagttgggggctccgggtagggcctgtgtggaccccgtgggccctgtgcaggtggccaggctcagagtcctagatccccatccctgggatgcaggtcaggtgaggaggatgggaggtcagggcagcatggggccgtgtggcctggtggagatgacctctggctggagctggaagwtgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggccaccctgacaccctcaccacgtccgcttgtccctaaggcctctctgctcacacctcctgaatctgtccttgcctctccttgccccatttttgttttttgagacggagtctcactctgatgcccaggctggagggcagtg

SEQ ID NO: 140979 - DNA, 601 bp, Human
cagccctctccttgccccactttaggatccctcccccctggacaactgtatacccaagacagtccccagggcctcgcctgtctcccccagcccccgctaagcagtccagactccaaccccaactgctggggtccatcatcccctataccaggggctatcccctcaacttggagggctggccaaagcctgtgcagcctcaggctggactcagagaagcctccccagctcccgcagctatgctgtggcctgaggctgtgctggacctggcttcatttctgctccaggatggcaggctgtgtcktcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataacttgaaagccatg

SEQ ID NO: 140980 - DNA, 601 bp, Human
ctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataacttgaaagccatgggccataggatcctctctgtagtccccacccacacaactgtggctgaggcctcagctcttaggacagaccgtggtggacatgtggccargccctggccacctcccctttccctggaaaatccagatctagagcaatggcctcttcacacaaaccttctctcagtggttcagaccacattaggattagagaagggccccacgaggcaccgccaggcgtgtctgtgagcgactcccaggatggaaggcaaaggctgacccccctctctgttgtgcccgcccccccacccccgccaggtgttacttacaaagaggtgctcagcttcaagcctccccggcagctgggggccagggtctccaaggagacgcctctgtgaagatctctgggctcc

SEQ ID NO: 140981 - DNA, 601 bp, Human
ccacgggtccctgggtgcccgcagcagggcctccacccttcgctgtgtgcatattcgtgtgcttatgagtttggctttgtttgattaaaggtttctgctgctagaaagataacttgaaagccatgggccataggatcctctctgtagtccccacccacacaactgtggctgaggcctcagctcttaggacagaccgtggtggacatgtggccaagccctggccacctcccctttccctggaaaatccagatctagagcaatggcctcttcacacaaaccttctctcagtggttcagaccayattaggattagagaagggccccacgaggcaccgccaggcgtgtctgtgagcgactcccaggatggaaggcaaaggctgacccccctctctgttgtgcccgcccccccacccccgccaggtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaag

SEQ ID NO: 140982 - DNA, 601 bp, Human
ctaaatcactcagccttctgagcagctctctgcttggagatgagctgtgtgaattacagagatccctggagtttccagagagtagcagtcacactaaatacagatccagagggagtgagtacaactttaatgtgattgtactagttggtgggagtaagagaagggaagggaataggggaaggaagtgggggaaggtagaaataccattatatcagtcttttatttttggaacacagttttacatgtggcttgtgctttatgttttcaaaagacttttacatttgttattttatcctcaagstgggtttataaactccttctatagatgaagacttcacctgcccaaggtcatgcagataagaagaggcagctcagacacaagttttcagaatcctagtctttccctcttttttgctagttgatgctgataattcagcatgaataagaggacatgctgtttttgttttgttaagttcaacattgaaacgttgcattcagtttatgaatgctctggaatagagcaccctgggaccctgcaaactgtatggacctgtgtcattcatgtgttgtccaactgtggcccatgctgtcagaacatgtc

SEQ ID NO: 140983 - DNA, 601 bp, Human
agagacagccatgagcttgtgtatatgtgtatgagtcagccttgaaaagacacaattttgagaatattttcttaggtgagtttgagagcatgaagcaacaagagcaggaagtggaccaagaggaggcgaataaaaggttaatggctttgaaaaagctttacagggtgccagttggagacaactgaatcaatggtagttttcattttacgctgccagggagtttcttggatttttgacatattcttcttcttttcaatcttataaacaccaagagggacaaggtggtcaaatactgtatatrtagtgttctcaccatgagtgatgtgggttgatagtagggaggagaatcaatacagtgaagctaagtttagctttaagaagagaatgaaaatagcagttgggtcttctactttgtggccaatgccactgtaccctcagatgtgcctgattttagaccccatgtgtcttcagcatgtgaatgtcaatctccttacagtatggctgacataatatgcaaatgagaacatcagccagtctctacctcctcccacttaaaaaaataaactttaaatactcatatttgaggcattgtggaaagagt

SEQ ID NO: 140984 - DNA, 601 bp, Human
tgggttgatagtagggaggagaatcaatacagtgaagctaagtttagctttaagaagagaatgaaaatagcagttgggtcttctactttgtggccaatgccactgtaccctcagatgtgcctgattttagaccccatgtgtcttcagcatgtgaatgtcaatctccttacagtatggctgacataatatgcaaatgagaacatcagccagtctctacctcctcccacttaaaaaaataaactttaaatactcatatttgaggcattgtggaaagagtctgccgcataaaaggtggacaacrttgggcaaattctgagcctcagatgtccccatttgcaacacgggagtctaaggtctatgacttagggctgttagagaattaaagacaatgattcattcattcagttacatgtactcattgcctgctagtgcctatgtactgcaccagttgttgagaataaaagagtgaataatagtgtatatgaaagcacttaccacagtgcatagcctgaaaaaagatgcttagcacatttttcttaaaacatttttaatggagaattttaacatgtacaaaaataaaataatacattaaactcttttg

SEQ ID NO: 140985 - DNA, 601 bp, Human
tgactgtacaactttctaattccaagacatatttatcatcctcaaaggaaacccaaatccattaatagtacccatctcccctccccccagcccccagcaaccactaatctactttctgtttctatagttttgactattatggatatttcatataaatggaataatacaatatatgatcttttattgtctttttttaagtagacctttttcattagcataagttttcaaagttgatccaggttgtagtctgtcagaacttcattccttgatggacatttagattatctcccctttttcgctrttatgaataatgctgctacgaacattacatacagtttttgtttgaacatatgttttcagttctcttgggactatacctaggaatggaattgctgggtcatatggtaaacctgtttaactttttgaggaatgggcttaaactgctttctcaagtggctgtactattttacattacttacaatgacacacaagggttccactttctccacatccctgccaacacctgatgtatcataatacaacatttgcattattattactttttgactatagccatcatactggtatgaagtggtgtctc

SEQ ID NO: 140986 - DNA, 601 bp, Human
tcattttcattatttctttagtatttatattaccttgattgatttacacgttaagttaaccttaaattcctgagataaatcccactactcatggtaatataattctttttatatgttgctggatttggtttgctgatgttttgttgaggatttattcatctgtattcataagggatgctccctgtagttttcttgtgatgtctttttctagttttggtattaggagaatactagcttcatagaaggagctgggaagtatgcctttctcttctaatttttgggagggtttgtgaaagattgstggtgattgtggtaaaattcaccagcaaagctatctgtacatgagctttccatatgaaaatttttaaaattgcaaattctgtatctttacttgttaataaataggtttattcagatttcctttttcttcttgagttagtttgtgtagatcatctctttctagtgtaaactaaaaataaaattctaagccctcttgactatctgaatggacccctcctctaggccaacgtcattccaaaattaacctgaaaaatgagttcagaccatgatgagaaggagaggtaagacatgcttcattata

SEQ ID NO: 140987 - DNA, 601 bp, Human
gatatgctgagggctatgtcacaggccattggtcactcatatttggctcaaaataaatctctttaaatattttagagtttgaccctttttgttgacactagcaatttgtacacttcatctaggttatctaatttgtggacatatgattgatcatagtattcctttatagttcttttcattatgtaaggtcaatagtggtattgttctttcattgctgattttgctaatttgaatcttctctcattttttaattttcctttgttttgtttaagttttgagacagagtctgactctgtcaccraggatggagtgcagtagtgcgatctcggctcactgcagcctccccctcctgggttcaagtgattctcatgcctcagcctctcgagtagctgagactagatgtgcatgacaccatgcccagctaatttttgtattttttgtagagatggggttttgccatgttcaccaggctggtcttgaactcctggcctcaaatgatccatctgtcttggcctcccaaagtactttcattttttcttgattagcctagttgaagatttgtcaatttcgttgattgttttaaatgaccaatggctttgtt

SEQ ID NO: 140988 - DNA, 601 bp, Human
tttccttttttttttcagaggaggaatttgttctcttgcagacaaccttgcctttccataaacataaggggaaagagattcctttctgacctttctgctccctttaatggtgttactgtctgcccacttttacagactagaaaacacatcctcttttggcctttctgcttccttgtccctttttttttcccaatcagttaccaaatcctgtagattctgtcttataaacttcttctgagtttatcacttcctctttatatgcactgccactgtgtgtgtccatgtccttgccacccctaasctgttctgttgcagccctgtcttcttggtcccagcttttgccccgtgcagctttcacgctgctgtcattggcggctttctaagtcacagtcacaaacctagctatgtctacttgttgattaagaccctttagtggtcttgctgacagattctttggactgatatacagggtcctccacaatctggcttctgtctacccttcgatgcctctggtgggaatgtccttttcctttcagtttggtggtgtgttagtctgttctcacactgctataaagaactacctgagactgggtaatttata

SEQ ID NO: 140989 - DNA, 601 bp, Human
tgcagacaaccttgcctttccataaacataaggggaaagagattcctttctgacctttctgctccctttaatggtgttactgtctgcccacttttacagactagaaaacacatcctcttttggcctttctgcttccttgtccctttttttttcccaatcagttaccaaatcctgtagattctgtcttataaacttcttctgagtttatcacttcctctttatatgcactgccactgtgtgtgtccatgtccttgccacccctaacctgttctgttgcagccctgtcttcttggtcccagcytttgccccgtgcagctttcacgctgctgtcattggcggctttctaagtcacagtcacaaacctagctatgtctacttgttgattaagaccctttagtggtcttgctgacagattctttggactgatatacagggtcctccacaatctggcttctgtctacccttcgatgcctctggtgggaatgtccttttcctttcagtttggtggtgtgttagtctgttctcacactgctataaagaactacctgagactgggtaatttataaagatttaattgacttacagttctgcaggctgtaca

SEQ ID NO: 140990 - DNA, 601 bp, Human
agacagtgcttgggggatgatgctaagccattagaaaccacccccatgatccaatcacctcccaccaggctccacctgcaacacgcaggatcacaattcaacatgagatttaggtggggacacagagccaaaccatattaggtggactccacttgaacctttgagctgcatataacctctgctatgaagcttctccaggtaaggtcactgcttttttctcagtaatcccaaagatgcttgactgacctctcgcatagcatgcttcacattggattattagattataaaaaggaagaaggtkggggaagtctatgtagtggagagaacatggactttggaattaattcaacctgggtttaaatcttggctccatcatttacctattatgtacctagagaggctgagagcagtacccatttttctatccagctaccatatagtgttggaaggactgaatgacataatgtgtaaaggcctccagtagtatcaggtggggactcagtatatgacagtctccttttatttgtatcatctgttctgaggaaacgtcattgcattgggtgaggatcaaaagctgttattttctctctgagaaagcgac

SEQ ID NO: 140991 - DNA, 601 bp, Human
gtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaartactaccagaagcaaaaggacattgatgtggaccagtgcagtgaggatgcaccagagaagtgtcatgagctaccttactttaacattagggatatatatgcacagcggatgcacgccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagct

SEQ ID NO: 140992 - DNA, 601 bp, Human
ttaattcctgaaccagctcctgcagctgggagtcgggggtgtggcctcagctcctgcctaggctctgggcttcagaaggaggctgtccatctgcataaggtccagctgggccaagtgcccagaagcctgggtctgccttcccacctctcccctcctgagcccaggctccttctctagccagcttggggtggaggcaggggggtccctgggagggacagccagcctgggttgcctgctgagtgtgacccaaggaggctcttggcccagacatccacctccagaaggggtcacccaagggttwgttttctgcaagaggctctggaggggtgaggcccaggcctgaggggcgccttggaggtaggggtggtgggaggtgtgggtgtggtctggagctggtgggtgtggggggtgggctgcaggtggctgagtgaccagagtgtttctgtgacggggggacggggcagaatgactgaagggcagtgggtgtgggggcccggcaggcaggcaggcaggtcctgggaggggaagccctctctcctctccaccctcctcctgtcctccgtggcctggacacctgccttcagggagaaagaagagggtc

SEQ ID NO: 140993 - DNA, 601 bp, Human
aagtgcccagaagcctgggtctgccttcccacctctcccctcctgagcccaggctccttctctagccagcttggggtggaggcaggggggtccctgggagggacagccagcctgggttgcctgctgagtgtgacccaaggaggctcttggcccagacatccacctccagaaggggtcacccaagggtttgttttctgcaagaggctctggaggggtgaggcccaggcctgaggggcgccttggaggtaggggtggtgggaggtgtgggtgtggtctggagctggtgggtgtggggggtggsctgcaggtggctgagtgaccagagtgtttctgtgacggggggacggggcagaatgactgaagggcagtgggtgtgggggcccggcaggcaggcaggcaggtcctgggaggggaagccctctctcctctccaccctcctcctgtcctccgtggcctggacacctgccttcagggagaaagaagagggtcctttcccagggggggtctctctgctctgagagcagcccgccctcatggaggacccccagtggacctctctttgctctgtgaaccccagagaagcctccattcctaccgcatg

SEQ ID NO: 140994 - DNA, 601 bp, Human
ggaaagaacacacaaggaacccccttgggaccctattctgggctggaaaatgcaattctctcttttttatctttgttttttgagatagagtcttgctctgtcgcctggagtgcagtggcgtgatcttggctcactgcaaccttccatctctggggttcaagcgattctcatgcctcagcttcccgaattgctgggattacaggcgcgcatcaccacgcctgtctaatttttgtatttttagtagagacagggtttcaccatgttggtcaggttggtctcgaactcctgacctcgtgatccrcctgcctcgacctcccaaagtgctgggattacaggcggccccaattattttttattaatcaatcaccaccttcccgccagtccagcaaactggagccccgctggcttcatacaccagccttggccccccccaaccctgggctggtgcccagtgggggtctaagggtgggggcggggcaggggaaataagaatgagtgggggttttgccaggagagtctgtcccgggctgatgtccacgcctgctgtgccctgagtcactgtgagctaagccctctcctcctggcgtgaggctatttcagg

SEQ ID NO: 140995 - DNA, 601 bp, Human
aatgagtgggggttttgccaggagagtctgtcccgggctgatgtccacgcctgctgtgccctgagtcactgtgagctaagccctctcctcctggcgtgaggctatttcaggagtcaggcctagcgctccccttccccagggctcctttccttttgggggtgccagccccctgttgtcggggcttttgccgcccactccatttcctactcgttgggagaccaggggatacaacctggcctcctcctcctcctcctccgtcttctcaggggcgaagttcaggggttaaggtggtgggagggaygtccccccggcgggacctcaagatccccgcgtgtgtctgtcctgaccccccccgctgccggagtcctgctgggcctgtggggagggcatgggggagccccagtgggcagccagtgaccagagccgtgggcagtggtgggagccggggtggggtgaggaaagttgtgtgtgactggggggctgtgcccgtcctgggtgtggctgtgggtgtgggggcaggggctgagccctgtaagtggtacaggtgcggccagggcactgggaggggttggggggctgggagtggggtcccatgcctggc

SEQ ID NO: 140996 - DNA, 601 bp, Human
acgcctgctgtgccctgagtcactgtgagctaagccctctcctcctggcgtgaggctatttcaggagtcaggcctagcgctccccttccccagggctcctttccttttgggggtgccagccccctgttgtcggggcttttgccgcccactccatttcctactcgttgggagaccaggggatacaacctggcctcctcctcctcctcctccgtcttctcaggggcgaagttcaggggttaaggtggtgggagggatgtccccccggcgggacctcaagatccccgcgtgtgtctgtcctgaccccccccgctgccggagtcctgctgggcctgtggggagggcatgggggagccccagtgggcagccagtgaccagagccgtgggcagtggtgggagccggggtggggtgaggaaagttgtgtgtgactggggggctgtgcccgtcctgggtgtggctgtgggtgtgggggcaggggctgagccctgtaagtggtacaggtgcggccagggcactgggaggggttggggggctgggagtggggtcccatgcctggctcgtgtgcggtggtcagggtgcagcttccctctgcccccagcttgc

SEQ ID NO: 140997 - DNA, 601 bp, Human
gccacacccctagctgctccccatctggctgcatttgaccagagggacctggccctcctggcctcagccctgctcatcctgcttttgattttctgtctccaagctaatggggcccattttctcttgcgctttgaggctataattttcctgccaaaatgttttaaaagctgcatatgcagaaacactttcaaaattgcaggtaattttattaaccacgtgcacgcattttatctgtgtgggtctgccagcacgctggggcctcggggcccgggggacgccgggttgcagggcggtaacgcgygcgtgtggccacgtgtgatggtgtgaggcgtctgtggcaacgtgggctgttgtctgtcacagtgtgtgtgaccgagcccgtctggtgacagtgggtgtctctttcctgccgtctccggtggaggtgaggatgtttcgtggagtgttaattagggaaatcagttcccaccagggctggggcagttgtgggaggggcccagggctggaggtgtagggttccttcctgcccagcccccatggaacggggtttcccacacctggcatggcaccagtcactctgcacatgtcctccctgtgtcct

SEQ ID NO: 140998 - DNA, 601 bp, Human
ggtctgcgtccttggaaggcagaggcagatggagcaggcagtttgggttttttttttttttttttttttttgagacggagtctcactctgtcgcccaggctggagtgcagtggcatgatgtctgctcactgcaagctccgcctcctgggttcacgccattctcctgcctcagcctcctgagtagctgcgactacaggtgcctgccaccacgcccagctaattttttgtattttttagtagagacggggtttccccgtgttagccaggatggtctccatctcctgacctcgtgatctgcccrcctcggccttccaaagtgctgggattacaggtgtgagccaccacgcccggccccagtttgggttttaaatgacagttttctctgttgtgctagcacctcccctcagttcagggaccttcacccccagcctgggcatttcgtctggaatgagacttgtggggttgcttggcgcttgaggccaggatgtactctgagctgctgatggccatctcctctcctggggcctcgtttccctctgacctcctgccctcatcacctggtgatctggacccagggccatatcccttctctgcccagtta

SEQ ID NO: 140999 - DNA, 601 bp, Human
gtgaccttgtgcccgacggtctggagggaccattgagtgggccattgcctgtccaggcctctcctgtgctccagaatgttacgagggacacctctccaaaggggtgggtgggggcgccgcgttcacagtcagcaccctggacagcccatcccccagctgctggtgcatcccatagcagggccaggtcccccgggaagtgggggcatctttgtagagctggcagacccctgcccaccctggggctgtgccccaagcccagtgctcccagtgaggacagattctcttaattagggatgtcccytggcacttctgccacggagctggcctctggtcctgcacactccagacacatccaccctggctcacacacaccctggctcacatgcaccccggatcccacccccgctgacactcaccccggttcccatgcaccccaggctcacatgcactcccggctcacacgcacccctgctcacacgcacttcggctcacacgcactccggcccacacgcaccccgctcacacaccctgctcacccagttcccacgcaccccaggctcccacggacctccgctcacatgcaccccggttcccacacacc

SEQ ID NO: 141000 - DNA, 601 bp, Human
ctcacatgcaccccagctcccatgcatcccgggctcacacacaacttgactcacacgtctcaggttcatgcatccgtcccctggtgcgtctccgggccgccctccaccgggctgtgctggctgccacccccaagcctcttcctggtctcctgggaagcctcccctatcaccctaagctgcttctggggctggctttgctcagaagccacacccaggctgggcactgtgcccaggtctcctattggctccctgcagccacgaggggctgtgtggtcagagccagcaagtcagcccctgcctyggtactcccaatcctggggcccagagcacaggggtgacccctcttcctgcacccagtctgtccagctcccctgtgcgctgtgcctggcctgctggggaggggctctgggcgtgggtgtcagagctcagcaggcaccaggagccaatggctcagcagagcttcccaagataggtcctgcgctggcagcctccggacagcgttctgttttgaactttaagcggagatgctacctctggaaggccggggaaggacagagcctgccttctccccaggatggcctgagcgtgtgtgggacttgtg

SEQ ID NO: 141001 - DNA, 601 bp, Human
cccagagggaccgaagacaccagtgacaggcctggcctgaatcttggggcaccagcagccatgctggcccttgggcagggagctgtgtcccatctccccagcacagcctcctgcctgccagccagccagtaaaagggtggcggcctccaacctccagcctggcgctggctgatgcactgctcagggaggggcaggtgagcgtgcacacgaggagggggcatctcccacccccaggccccctgaggcaagagtgttggggctcatgggccctccgtgggccctgccagggtggaggccccakgcctgtcttgagctgggctggtgttgcaggtgggggtggggcggctgctggtggccagcagctatcccagccttggtttctgtctggaaagtggggtgtgagtctggccactggggcttgggaggcttttatggggtgacttggggcttctggtagtcccccgggaacccccagagcctggggtctgagcctgtcctcaggcatgtggtctgggtgctccaaggggtttcatcaggttgaggggtggctttgccagcccattcccaagtcctgtccagtccagggtggggcagggatccc

SEQ ID NO: 141002 - DNA, 601 bp, Human
catcctggctaacacggtgaaaccctgtctctactaaaagtacaaaaaattagctgggcgtggtggcgggcgcctgtagtcccagctactcgggaggctgaggcaggagaatggcgtgaacccgggaggcggaggttgcagtgagccgagatcgcgccactgcactccagcctgggtgacagtgcgagactcggtatcaaaaaaaaaacaaaaaagactattgtggctaaaccatctctactaaaaatacaaaaaattaaccgggtgtggtgggggcatgcctgtaatcccagctacttgrgaggctgaggcaggagaatcacttgaacctgggaggcggaggaggttgcagtgagcccagatggtgccactgcactccagcctgagcaacagggtgagactccatctccaaaaaaagaaaaaaagaaagaaatcataaccaggagcagagtgtgagggaatcagcgtttctcctgccacgagtgacaggggacagctggggacatcacagagatcttgtcgggagctgggaatcggaatcctgggaccacctgccaggaagccccatcccggagtgagggcagggctgggtctccctgac

SEQ ID NO: 141003 - DNA, 601 bp, Human
catctccaaaaaaagaaaaaaagaaagaaatcataaccaggagcagagtgtgagggaatcagcgtttctcctgccacgagtgacaggggacagctggggacatcacagagatcttgtcgggagctgggaatcggaatcctgggaccacctgccaggaagccccatcccggagtgagggcagggctgggtctccctgacagcacagtctggaaaggctggagtggcctgtcaggtggggagtgagccttctgccctgcgcagaccagacggtgaagcggggttaggggtgtgcagactgcgycctggggcctaagatcccgtccctttggctccaggccaggggttgggcggatccctcctagagggagtggttcagaggcacaagggagcctccccgactgtggccatggagtgtgggtttggggatggggtgccagcccagggtgtcgggaaagactggcctgccctggacacccccccgggctgccgtgggatctagcaggactctgggtggttctggctcaggctggcaggcggcatggctttgggcttgtgggccgggctctgccctggggtccagagcttgcattggggcctcacc

SEQ ID NO: 141004 - DNA, 601 bp, Human
tccaaaaaaagaaaaaaagaaagaaatcataaccaggagcagagtgtgagggaatcagcgtttctcctgccacgagtgacaggggacagctggggacatcacagagatcttgtcgggagctgggaatcggaatcctgggaccacctgccaggaagccccatcccggagtgagggcagggctgggtctccctgacagcacagtctggaaaggctggagtggcctgtcaggtggggagtgagccttctgccctgcgcagaccagacggtgaagcggggttaggggtgtgcagactgcgtcctggggcctaagatcccgtccctttggctccaggccaggggttgggcggatccctcctagagggagtggttcagaggcacaagggagcctccccgactgtggccatggagtgtgggtttggggatggggtgccagcccagggtgtcgggaaagactggcctgccctggacacccccccgggctgccgtgggatctagcaggactctgggtggttctggctcaggctggcaggcggcatggctttgggcttgtgggccgggctctgccctggggtccagagcttgcattggggcctcaccctgt

SEQ ID NO: 141005 - DNA, 601 bp, Human; identical to SEQ ID NO: 26964

SEQ ID NO: 141006 - DNA, 601 bp, Human; identical to SEQ ID NO: 26965

SEQ ID NO: 141007 - DNA, 601 bp, Human
gatccaagcgcaaagggcggccggagcggaacgcacaagcgaccgagctgcctggaaggacgcgcgccccgcccggcccgcccccgacggggaaggccggtccactgcctgcgttccgccggccgcgagcctgctggggggcacttcggggctcaggctccccgccctgcgggaccgcgggtggctgcgaccccagcccggttccccgccagcctgtcccctagcaatgcctccccgtacccgggtcccgcagacttacgcgcaagccgcgcgtagggcccagaagcagcagaaccagcarcagagggaggatgcgaaccaggaaccccggcatgaccaccagcctcccggctctgcagtcggcgcccaggccggccgcttcgcgtcacttgactaaggacccacggcctggcaccgcccctcgtcggcccagcagccagccctcgcgcctgctcagccccgcgccccgccccgctgtggccgagccgggcgggtgggggcggctaggaggctgcgcgccgccgcgtgactccaggatagtactatctgggttttgcaggcgtcttccctgggaagggaccctttggaactgcagtccgga

SEQ ID NO: 141008 - DNA, 601 bp, Human
aagcccaggtcactgatgagaaagatgtaaaatcaagaaaccagtgaaataacacgtaacaggtgagtcaaacattaccagccgcatcaaacagtggaagtgaaatggcaccatctagcccacctggtgaaatccaaagcgagaacttaaagggagtaaggatgattcacaaaatgcggtcgggacacaagaaaagtgagtttggaaggacagtgaagagagaaaaaagaataaggaaaccaccaaaatttcaactcaaagatacattttaaactgcatggtatggcccactgtcaatacmgtggctgcctgggaacaaaaagggtggtctccagatcccccagaaccccactatacaccaggaggacaaggaggaaaggaagaaaccccctttgcctgccagaatgcacatgaggggaggaaggcaaacccctagcagttgctgctttgacacatcacctgccccagcagcaggcagctcgctacccactcacattccccaggactggctgctccatgaatcctctgggcacctgtgcccaacagagttccttagcaagctccactggaacgttgaaaaattaacattgagtgtttactg

SEQ ID NO: 141009 - DNA, 601 bp, Human
agaggtacatgtacgaaaagtttaaaacaaaccaaacaaaacacgaggggaagaaaagcatggatgggtatttggaaggaatggcagcaggatcaatttattgagattttgtgacagcatcatatactacagacactattgctgattttcaaaaagcattgcatttcaatttgcatctaacagattaaaaataaagaaacaaatgaaattgaaagaatgatcaagcttcaagtaacgtttctcaccacctcccccggccacaaacaaacaaaaaggtccatggtttaagaatgttgaacaragggactaaaggtgtcatggagacctgcccaccagggccagaatctggacagtgatggagaaatttctgctgcaaaaatgtccgccgcgtcagggaatacaaaccacatacgagagggtgttgatgttgtttctcagatacataggatggacctgttttctttctgctaatagaaagcaatcagtcaagcaaggacttcagagtggatgaagggtacataagaccacacaatgatggcattcaagagaaagaaaagaggtaaggatgcaaaattaaaaaaaaaataggacttaatgaaag

SEQ ID NO: 141010 - DNA, 601 bp, Human
ctctaagatcaggaaaaaggcaagatgtctgtttttgccacttctactcaacatagttttggaagtcctagtcagagcaactaggcaagaaagaaataaaaggcattcaaattagaaaggagaagtaaaatgatcgattcacagatgatataatcttagatgtaggaaaccctaaagactacacacacacacacacacacacacacacacacacacacaaactgttagaactaataaatgaattcagcaaagttgcaggatacaaaaagcaacataccaaaatcagttgcttctctatacmctaaaaatgaacaatcctaaatggaatttcaaaaaattccatatataaaagcatcaaaaagaataaaatacttagaaataggcctaactaaggtgaaagactacactgaaaactacaaaacactgttaaaaagaaattaaagaagacacaaacaaatggaaaaaacatcctatgttcatggagtggaaggttcatattgttaagatgttcatactacccaaagtgattcacagattcaacacaatccctataaaaatcccaatagcatttcttgcagaaatagaaaaatttatcctaaaa

SEQ ID NO: 141011 - DNA, 601 bp, Human
ctacctccacatcataaagcccacatgtgaagagcccatagctaacatcatattcaatagtgaaagactgcaagcttttcctctaagatcaggaaaaaggcaagatgtctgtttttgccacttctactcaacatagttttggaagtcctagtcagagcaactaggcaagaaagaaataaaaggcattcaaattagaaaggagaagtaaaatgatcgattcacagatgatataatcttagatgtaggaaaccctaaagactacacacacacacacacacacacacacacacacacacacaaactgttagaactaataaatgaattcagcaaagttgcaggatacaaaaagcaacataccaaaatcagttgcttctctataccctaaaaatgaacaatcctaaatggaatttcaaaaaattccatatataaaagcatcaaaaagaataaaatacttagaaataggcctaactaaggtgaaagactacactgaaaactacaaaacactgttaaaaagaaattaaagaagacacaaacaaatggaaaaaacatcctatgttcatggagtggaaggttcatattgttaagatgttcatactaccca

SEQ ID NO: 141012 - DNA, 601 bp, Human
aactacctccacatcataaagcccacatgtgaagagcccatagctaacatcatattcaatagtgaaagactgcaagcttttcctctaagatcaggaaaaaggcaagatgtctgtttttgccacttctactcaacatagttttggaagtcctagtcagagcaactaggcaagaaagaaataaaaggcattcaaattagaaaggagaagtaaaatgatcgattcacagatgatataatcttagatgtaggaaaccctaaagactacacacacacacacacacacacacacacacacacacaccaactgttagaactaataaatgaattcagcaaagttgcaggatacaaaaagcaacataccaaaatcagttgcttctctataccctaaaaatgaacaatcctaaatggaatttcaaaaaattccatatataaaagcatcaaaaagaataaaatacttagaaataggcctaactaaggtgaaagactacactgaaaactacaaaacactgttaaaaagaaattaaagaagacacaaacaaatggaaaaaacatcctatgttcatggagtggaaggttcatattgttaagatgttcatactacc

SEQ ID NO: 141013 - DNA, 601 bp, Human
aaactacctccacatcataaagcccacatgtgaagagcccatagctaacatcatattcaatagtgaaagactgcaagcttttcctctaagatcaggaaaaaggcaagatgtctgtttttgccacttctactcaacatagttttggaagtcctagtcagagcaactaggcaagaaagaaataaaaggcattcaaattagaaaggagaagtaaaatgatcgattcacagatgatataatcttagatgtaggaaaccctaaagactacacacacacacacacacacacacacacacacacacacaaactgttagaactaataaatgaattcagcaaagttgcaggatacaaaaagcaacataccaaaatcagttgcttctctataccctaaaaatgaacaatcctaaatggaatttcaaaaaattccatatataaaagcatcaaaaagaataaaatacttagaaataggcctaactaaggtgaaagactacactgaaaactacaaaacactgttaaaaagaaattaaagaagacacaaacaaatggaaaaaacatcctatgttcatggagtggaaggttcatattgttaagatgttcatactac

SEQ ID NO: 141014 - DNA, 601 bp, Human
aagattcaacaccctttcatgattaaaaaaaccaacaactcaacaaatgcaaaatagaagaaaactacctccacatcataaagcccacatgtgaagagcccatagctaacatcatattcaatagtgaaagactgcaagcttttcctctaagatcaggaaaaaggcaagatgtctgtttttgccacttctactcaacatagttttggaagtcctagtcagagcaactaggcaagaaagaaataaaaggcattcaaattagaaaggagaagtaaaatgatcgattcacagatgatataatctyagatgtaggaaaccctaaagactacacacacacacacacacacacacacacacacacacacaaactgttagaactaataaatgaattcagcaaagttgcaggatacaaaaagcaacataccaaaatcagttgcttctctataccctaaaaatgaacaatcctaaatggaatttcaaaaaattccatatataaaagcatcaaaaagaataaaatacttagaaataggcctaactaaggtgaaagactacactgaaaactacaaaacactgttaaaaagaaattaaagaagacacaaacaaa

SEQ ID NO: 141015 - DNA, 601 bp, Human
acagttggtttttgaaaaaaaaatcaacaaaattgagaaacttaactagatttaaaaaaaagaagatataaataaatcagaaatgaagaggggacattataactgatgacacagaaataaagaattgtaagagaatagcatgaacaactgtatgccaacaaattggataacctagaagatatggataaatttctagacacacccagcccaccaagaccgaatcatgaagaaacagaaaatctatacagaccaatagctattaaaaagattgaatcagtcatcaaaaacctcaaagaggccrggtacggtggctcccgcctgtaatcccagcactttgggagggggaagcggccagatcacttgaggtcaagagtttgagaccagcctggccaacatggtgaaaccccgtctctactaaaaatacaaaaattagccgggtgtggtggcgcgtgcctgtggtcctggctacttgggaggctgaggaaggagaatcgcttgaacctgggaggtggaggttgcagtgacccaagatcatgcctctgcactccagccccggcgacagagcaagaccatgtctcagcatgcgcgcacacacacacac

SEQ ID NO: 141016 - DNA, 601 bp, Human
tccagcctggacaacaaaatgagatcccatccctataaaaaataaacaaaagttagctgggtatggtggcacatgcctgtggtcccaactacttgggaggctgaggtgggaggattgcttgagcccagaatggttcaggctgcagtgagtagtgatggtgccactgcagtccaatcagagtgacagagcaagagtctgtttcaaaaaaaaaaaaaaaaaaagcgagagagagagaaacaaacataaaatcaaacaaaattaagaaccccataatcaggagatacaggaaaatctctgtacyttccactcaattttgctataaggctacaactattctaaaaaatatagtccattaaaaaacaataaaatccataatctcttatttgaattgtaaatactagtatacacttatgattttttttctctctaaaaaagtattgcatttcctagcaatacccaaagacacagtttggaaatgatatcagcgggtagcaatctaacccatatagcgcctaaattgtgatctgcaaacatttcccactaaaagtaaccaaagctgcttcttcaagaaattagttaatccaagtctgtggcataagat

SEQ ID NO: 141017 - DNA, 601 bp, Human
gatcatttccatcatgttcattcaaattgcccgtgagcctctgccagaaaaaacagatcacagtacatgatggtggccacttaattaaccgagtagtagctccaaaagcagctaccatgtaggtatgggattaccactgggacagaacaacacagcctctgatatttggtttgcgattaatgttctaatcttttcaaatcctactgataaaaaggattgaaaacagttcgtgagtgggcaggacagcagtatattctccctcttgcccggggctgtgtccactgccctgctgtatcacacragacctggactgtctgtgcattcatggactgtcatggtctgagagatgaacatcaccatgttatttgaaccaggagagcaggggacatgtctctgaaacaaaaacctagaaaagccacagagaggggatcaagatggacagctgcagaagcagtatcacttaaaagacagttcatcattgttgactgtcacagccaaagtaaacagggacagtccacttcatggacccaagatgacccctctcaaaagttacggacctaaaaaaaagacccagcttcctttgagcttcctctgagctgtg

SEQ ID NO: 141018 - DNA, 601 bp, Human
taaccagcatgggaccgcttaaccatcagaagcaggaaggcacaattaccacaacaaccagcaaggtcacagtggcaaccagggtgtgctgacctgtggaccaggagtgaccttatgcagtggctcataagccacacgtttctgtggggtgagttggccaggcaatcagcaagagtactgcttgacatgtttaaaaacttgtgagcaaaaggctgatgtcaacaactgcatggaaaattgagattccttcatccaattcccagctttgagccagttctctaacatacagtcaacaaaattwgatggaaggttggatggatccccttgaggaaggatcctgcattaccaccccaagtccacacagtaaatattcctccaatccttcccaacaagactcagggtaactgtgtcctaagaaaaggggcaccccaaggccaccaccttctgaggactactggatacagtctgaactgacatggtagcaccagggaacctgaaatgccatcactctcccttatcactcttagggaggccagggataatgggagccttggccccagtccttttcacagagagtccaacaaatcagaggatccatcac

SEQ ID NO: 141019 - DNA, 601 bp, Human
tggtttggagctcctgacctcaggtaatccgccgcctcggcttcccaaagtgctgggattacagacgtgagccaccgcgcctggtctttaaaagtttttaaaaacatgcctacatcagctgtagctctgtgaatggtcttgtgcaagctcagtatgctttgtgctgattgtctcaactcacactcagatctcatgtctttttgcctttctgccccaacactgggggaatgggttcagcccagaagtccaggagcaccaggcagtccatgcccctgagggcaaccttcagccaatgagggayaaagagggtggagaactgcattctcttgttttttaggcaaataattctggagacactttgtgcacttttcaggaggtctcagaagaatcatgtcccggttcccagagtgataactacaatatgcattctgacccaggctgtcccttctttccacctgtcccttgctcctatgctcttggatcacttctcaaaccacttgcacccaatgttctgcttctagagggacccaaagtacgaccttgataccaggagtggcctcaacagcagatcatcaggatgtgagtctgcaccttgttgtct

SEQ ID NO: 141020 - DNA, 601 bp, Human
acatgcatgtttgtatatatacaaatacacatacatgatcaaatgttacgcagctctggagagtatgtagcccttgccattgtgaaatgatctccgatggatatcccagcactttgggagggatatagggtgaaaagagaaggcagaggagagagttttttgtttttgagtcagggtctttcttgctcagttgctctggctggagtgcagcagcatgatcatggctcactgcagccttgacctcctgggctcaagcgatcctcccacctctgttcccaagtagatgggaccacaggggtgygccaccatgctcagttaataattttcaaattttctgtagagataggatctcactatgttgcccaggctggtctccaactgctggcctcaagcaatcctcccacctcacgatcgcaaagttctgggattactggcgtgagccactgtgcccagcctgaaaactgtttttttttgtttgtttgtttgttttttgagatggagtttcactcttgtggcccaggctggagtgcaatggcacagtctcagctcactgcaacctccgcctccccagttcaagcaattctcctgcctcagcctcctg

SEQ ID NO: 141021 - DNA, 601 bp, Human
aattatggtttatattgtatgtgtattgtacatgcatgtttgtatatatacaaatacacatacatgatcaaatgttacgcagctctggagagtatgtagcccttgccattgtgaaatgatctccgatggatatcccagcactttgggagggatatagggtgaaaagagaaggcagaggagagagttttttgtttttgagtcagggtctttcttgctcagttgctctggctggagtgcagcagcatgatcatggctcactgcagccttgacctcctgggctcaagcgatcctcccacctctkttcccaagtagatgggaccacaggggtgcgccaccatgctcagttaataattttcaaattttctgtagagataggatctcactatgttgcccaggctggtctccaactgctggcctcaagcaatcctcccacctcacgatcgcaaagttctgggattactggcgtgagccactgtgcccagcctgaaaactgtttttttttgtttgtttgtttgttttttgagatggagtttcactcttgtggcccaggctggagtgcaatggcacagtctcagctcactgcaacctccgcctccccagt

SEQ ID NO: 141022 - DNA, 601 bp, Human
taaaatgaattatggtttatattgtatgtgtattgtacatgcatgtttgtatatatacaaatacacatacatgatcaaatgttacgcagctctggagagtatgtagcccttgccattgtgaaatgatctccgatggatatcccagcactttgggagggatatagggtgaaaagagaaggcagaggagagagttttttgtttttgagtcagggtctttcttgctcagttgctctggctggagtgcagcagcatgatcatggctcactgcagccttgacctcctgggctcaagcgatcctccyacctctgttcccaagtagatgggaccacaggggtgcgccaccatgctcagttaataattttcaaattttctgtagagataggatctcactatgttgcccaggctggtctccaactgctggcctcaagcaatcctcccacctcacgatcgcaaagttctgggattactggcgtgagccactgtgcccagcctgaaaactgtttttttttgtttgtttgtttgttttttgagatggagtttcactcttgtggcccaggctggagtgcaatggcacagtctcagctcactgcaacctccgcct

SEQ ID NO: 141023 - DNA, 601 bp, Human
cctaatgattgcattagatcattatatgtgatatgatatgtgtaataaggtatggtacaatattcgtaatatgaaatgatacgatattcattaggtcagtgtgaacctggtttggatcctaattcttttatttttattactttttatttactattataattttttaagattttttggatacagggtcttgctccgtcacccaggctggagtgcaatggctcaatcatatctcatggcagtcttgaactcctgggttcaagcgattctcctgcttcagcaaactatggcatatgtatatgayagactactactcagcaataaaaaagaacaaactactggtatttgtaataatgtaaataaatctcaaaaatgttgagagaaagaagccttacacaattgggttcatactgcatgaacctatttatatgaagtcctgggaaaggcaaatctaatctatggtggaagaaaaaatcagaatagttaactctgggagagtagaggtaggtattgcctgggaagggacgtgagggaactttctggggtaatggtaattaatattccatagctagataagggttttggattatgcaggtgtaggcat

SEQ ID NO: 141024 - DNA, 601 bp, Human
ggaaatgaaagaacttcagaggaataatggcctaatgattgcattagatcattatatgtgatatgatatgtgtaataaggtatggtacaatattcgtaatatgaaatgatacgatattcattaggtcagtgtgaacctggtttggatcctaattcttttatttttattactttttatttactattataattttttaagattttttggatacagggtcttgctccgtcacccaggctggagtgcaatggctcaatcatatctcatggcagtcttgaactcctgggttcaagcgattctcctscttcagcaaactatggcatatgtatatgatagactactactcagcaataaaaaagaacaaactactggtatttgtaataatgtaaataaatctcaaaaatgttgagagaaagaagccttacacaattgggttcatactgcatgaacctatttatatgaagtcctgggaaaggcaaatctaatctatggtggaagaaaaaatcagaatagttaactctgggagagtagaggtaggtattgcctgggaagggacgtgagggaactttctggggtaatggtaattaatattccatagctagat

SEQ ID NO: 141025 - DNA, 601 bp, Human
cagctcttatctttatatttcagtaagttattttgctgttttaacaaaaaaaaaacataaaaatccttgcatactttattcaattgtagaatgttaatgtttttcatttatcattgtaaaaccaaggacaattttataactttgttgtacatagttgttaaatgtagggcaatttgtctttaagtagggataaattagtctaaaaaaaaaaaggaatcctagatagtttttccttcaagtcaagaagcttgttgtttaaacttcttgtttaaaataaataaacaaacaaaattagccggtrtggtggcaggcactggtagtcttagctactcaggaggctgaggcaggaagattgctcgagcccaggaggtcaaggcgatggtgagatgtgatagggccactgcagtccagcctgggtgacagagagggaccctgtctcaaaataacaataaatgcagaaggaataaaagcatctgaaaacaccttttccccaacacttagtgaaatggatttaagctataatcatcaatagatgctaaaaccattagaaacactgatggaaattgtgtgaaggattgggcatattttttgtgctccatct

SEQ ID NO: 141026 - DNA, 601 bp, Human
aagaaagaaaatagaggctgggtgcggtggctcacgcctgtaatccctgcactttgggaggctgaggcaggtggatcacgaggtcaggagatcgaaagcatcctggccaacatggtgaaaccccgtctctaccaaaaattaaaaaaaaaatagctactcgggagattggggcaggagcatccctggaaccggagaggtggaggttgcggtgagccgagatcatgccactgtactccagccaggtgacagagcgagactccgtcaaaagaaagaacgagaaagaaggaaggaaggaaggaargaaggaaggaaggaaggaaggaaggaaggaaggaaggaagaaagaaagaaagaaagaaagaaagaaagaaagaaagaaagaaagaaagaaagaaagaaagaaagaaagaaatattacacatagtaaagtattactttataaaacttttgttatatatacatatgtggagttgtatatgtacgcatgtatatttggttgcaatgtaagatttatttctaccaagcacgattttaagaaacactgttttggggtcacttcaggagctaaaatgttaggattttgaaaggcaagacctcaacg

SEQ ID NO: 141027 - DNA, 601 bp, Human
agctaaggagttcaagaccagcctaggcaattcagcgaggcctcgtctctacaaaaaaacaaacaaacaaacaaacaaaaattaagcaggcttggtggcacacgcctatgctcccagctacttgggaggctgaggtgggaggactgcttgagcccagaaggttgagagtgcagtgaaccgtgttcatgccactgcactgcagcctgggtgacagagcaagacattgtctcaaaaaaaaaaaaaaaaggcaagaaagaaaatagaggctgggtgcggtggctcacgcctgtaatccctgcaytttgggaggctgaggcaggtggatcacgaggtcaggagatcgaaagcatcctggccaacatggtgaaaccccgtctctaccaaaaattaaaaaaaaaatagctactcgggagattggggcaggagcatccctggaaccggagaggtggaggttgcggtgagccgagatcatgccactgtactccagccaggtgacagagcgagactccgtcaaaagaaagaacgagaaagaaggaaggaaggaaggaaggaaggaaggaaggaaggaaggaaggaaggaaggaaggaagaaagaaagaaa

SEQ ID NO: 141028 - DNA, 601 bp, Human
ctccagcctgggcgacagagcgagactctgtctcaaaaaaataataaaataaataaaaataaaaatcaaagaatagcaggcaccgttgcttatgcctataatgctagcactttgagaggccaaggttggaggatcacttgagctaaggagttcaagaccagcctaggcaattcagcgaggcctcgtctctacaaaaaaacaaacaaacaaacaaacaaaaattaagcaggcttggtggcacacgcctatgctcccagctacttgggaggctgaggtgggaggactgcttgagcccagaagrttgagagtgcagtgaaccgtgttcatgccactgcactgcagcctgggtgacagagcaagacattgtctcaaaaaaaaaaaaaaaaggcaagaaagaaaatagaggctgggtgcggtggctcacgcctgtaatccctgcactttgggaggctgaggcaggtggatcacgaggtcaggagatcgaaagcatcctggccaacatggtgaaaccccgtctctaccaaaaattaaaaaaaaaatagctactcgggagattggggcaggagcatccctggaaccggagaggtggaggttgcggtga

SEQ ID NO: 141029 - DNA, 601 bp, Human
tcatttttggtggcaataagcatcttttaaaaatgaaagaattgtccaggcatgatggctcacacctgtaatcccagaactttgggaggccaaggcaggtggatcacctgaggtcaggagttcaagaccagcctggccaacatggtgaaaccccatctctaccaaaaatacaaaaattagccgggcatggtggtgcacgtctgtaatcccagctacttgggaggctgagacacgagaatcgcttgaacccgggaagcggaggttgcagtgagctgagatcacaccactgcactccagcctrggcgacagagcgagactctgtctcaaaaaaataataaaataaataaaaataaaaatcaaagaatagcaggcaccgttgcttatgcctataatgctagcactttgagaggccaaggttggaggatcacttgagctaaggagttcaagaccagcctaggcaattcagcgaggcctcgtctctacaaaaaaacaaacaaacaaacaaacaaaaattaagcaggcttggtggcacacgcctatgctcccagctacttgggaggctgaggtgggaggactgcttgagcccagaaggttgagagtg

SEQ ID NO: 141030 - DNA, 601 bp, Human
tccataactatccagggtattagactaaaagaactttaaggcatttaaggcaatatttgtaaaattgtgggccatgacctgatttgtgaataataaactcatttttggtggcaataagcatcttttaaaaatgaaagaattgtccaggcatgatggctcacacctgtaatcccagaactttgggaggccaaggcaggtggatcacctgaggtcaggagttcaagaccagcctggccaacatggtgaaaccccatctctaccaaaaatacaaaaattagccgggcatggtggtgcacgtctrtaatcccagctacttgggaggctgagacacgagaatcgcttgaacccgggaagcggaggttgcagtgagctgagatcacaccactgcactccagcctgggcgacagagcgagactctgtctcaaaaaaataataaaataaataaaaataaaaatcaaagaatagcaggcaccgttgcttatgcctataatgctagcactttgagaggccaaggttggaggatcacttgagctaaggagttcaagaccagcctaggcaattcagcgaggcctcgtctctacaaaaaaacaaacaaacaaac

SEQ ID NO: 141031 - DNA, 601 bp, Human
agaggccagcactgagctgacaatcagtggctgagatgatattccactgtgctgttcatggggctggggaacatcacacacacacacgcatgcacgcacacacgccattgttgctgtgacctgcctgagcactggatgcacctcaacaacaatgtcactgggataaccaagacccattaacaaaattctaagtgtaaaatacagggcaaaaagcaatggattaaaactccagagcctgacgccccatcctagatattgctctgaatcccatagtgacctggataagtcccatctctaaccstacctctcttcatccataactatccagggtattagactaaaagaactttaaggcatttaaggcaatatttgtaaaattgtgggccatgacctgatttgtgaataataaactcatttttggtggcaataagcatcttttaaaaatgaaagaattgtccaggcatgatggctcacacctgtaatcccagaactttgggaggccaaggcaggtggatcacctgaggtcaggagttcaagaccagcctggccaacatggtgaaaccccatctctaccaaaaatacaaaaattagccgggcatgg

SEQ ID NO: 141032 - DNA, 601 bp, Human
tttgagaagttatcagcaatccacatcagcactgcaagagccagagcagccagccacaccaactttcttgcctgttagttagttactttgcaatagcaaaagagatgcagagagatagctattgggataattctacaccctgaagttatacaattaccgcagcagaaccacaaagccaaactgggtttcagaaatctacctaagcacaaggcttattctgttattggggctcagaaaacaataccccaaagtatggcaccttggcatgctaagtactttgaactaaaggagatcggaaggycttagaagcaaatcttctttctctggccttctcctgctcttctgttgcccacccctccttctcccctgaagcaagtcaaaccagaattcatcttcccccagtgtgggtcatagaaattagaacccctctctcccaaagcaagccagaaaacctagaaaggtcacctctcccttctcccttctagaccctcattgcagaggggtcctgctccatacccagaaggaaggaatgccacccagaaaggccaagaagaatctgttgaggcaggccttgagggtttcccacttcagtccaccacca

SEQ ID NO: 141033 - DNA, 601 bp, Human
gtttgcttaagctagggaggttgaagctgcagtgagctgtgattgtgccactgcactccaaactggatgacagagtgagaccctgtgtcaaaataaagaaagaaaagaaaagaaaaattatccagaatttggatataaggcaaaagggtgactgcatttcctttccatgttataatggaggactgtccaatgggcccactgaggcttccttcattctccaggggagatattttgtttgacttactatttactattgattaagggaagaactttgaagttacagattaatttgtagattatkgcctgagagagaaacaaatgattgtcatacagagaagacaactctaaaggttgctttttcattcattgccctttatgatactaaccagttttatctctaaagataactttatttgaacatgactttcttgactgaccgtaaacctcccttcctcaaattctcctttgaattagctttaccatctagctagtttcctcagtaataagttaaataaatttttaaaaacttttattttaggttcaggggtacatgtgcaggtttgttatacaggtaaattgcgtgtcatgggggtttggtgta

SEQ ID NO: 141034 - DNA, 601 bp, Human
agaattaccagtttatcagtaagatctggttacgtagttcaaagcctaatttcctagaggtttagtttgttgctatgcactggtcagtgataaacactcagactttcactaaactttcaaaagtatttgtgcagaggtaccccagccttcaaaatacctcccccttttgatataaattgttgaagcttttttgtttgtttgtttgttttgagacagagtcacgctttgtcacccaggctatagtgcattgatacgatctcggttcactgcaacttccgcctccagggttcaagcaatcctyctgcctcagcctcctgagtagctgggattacaggcgcccaccaccatgcccagctaattttttgtatttttagtaggggcgaggttttgccattttggccagcctggtctcgaactcccaacctcaggtaatccacccgcctcagcctcccaaagtgtcaggattacaggcgtgagccaccgcacctaggctgaagcttttataaatcttctcaagacatctgtaacaacctacctgggtcggaggagcggagaagaatagactctttctctagcagccaagcaggtaatcctccctagt

SEQ ID NO: 141035 - DNA, 601 bp, Human
atttctttttttgagacaaagtccctctctgttgcccaggatggagtgcagtggtacaatcatggctcactgcagtctcaacctcccaggctcaagcaatcctcccacctcagcctcccggactacaggcatgtgccagcacacctggctaatttttaaattttttatagagatagggtctcgctatgttacctaggctggtatcaaactcctgggctcaagcaatccctccactttggcctcccaaagtgctgagattacaagtgtgagtcaccatgcctgacttgtcattttgattagygaggtgctatcattggctgtggaatatgctaagtaaataggaagagaaagcactgaagtcagttggtcaaccgcaaacagggttcaataccaattcaaagaattaccagtttatcagtaagatctggttacgtagttcaaagcctaatttcctagaggtttagtttgttgctatgcactggtcagtgataaacactcagactttcactaaactttcaaaagtatttgtgcagaggtaccccagccttcaaaatacctcccccttttgatataaattgttgaagcttttttgtttgtttgt

SEQ ID NO: 141036 - DNA, 601 bp, Human
agctacttgggaggctgaggcaggagaattgcttgaacccgggggggcggaggttgcggtgagccaagatcgcaccattgcactccagcctgggcaacaagagtgaaactctgtctcaaaaaaaaaaaaaaaaaaattatgatttagtacaaagagacaccagtgcagccttattacaccagggctggcagcagagatcaggatatacaggactcgacaagtaccttctgaagtaaaagtctcataaaagttgtcctgcatgtagttgtctcctcagctgagctcctcaggggacgaggaycagtgtgcctgtatccatctgctatggttggaatgtttgtccctctgaaactcatgttgaaatcgaatccccaatgtggtagtattgagaggtggggcctttaagaggtgttgagtcatgagggctcagccctcataagtagatcaatccactcatggattaatagattaataggttaatggattcatgggtcatcatgggaatgggactggtggctttataagaagagggagagagatctgagctaggacactcagccccctcaccatgtgatgccctgtgccccctcaggactctgca

SEQ ID NO: 141037 - DNA, 601 bp, Human
aacattctgagttttctggctgggtgcggtggctcacgcctgtaatcccagcactttgggaggctgaggcaggcagatcaccagatgtcgggagttcgagaccagcctgaccaacatggagaaaccccatctctactaaaaatgcaaaattagccaggcttggtggcgcatgcctgtaatcccagctacttgggaggctgaggcaggagaattgcttgaacccgggggggcggaggttgcggtgagccaagatcgcaccattgcactccagcctgggcaacaagagtgaaactctgtctcaaaaaaaaaaaaaaaaaaattatgatttagtacaaagagacaccagtgcagccttattacaccagggctggcagcagagatcaggatatacaggactcgacaagtaccttctgaagtaaaagtctcataaaagttgtcctgcatgtagttgtctcctcagctgagctcctcaggggacgaggatcagtgtgcctgtatccatctgctatggttggaatgtttgtccctctgaaactcatgttgaaatcgaatccccaatgtggtagtattgagaggtggggcctttaagaggtgttgagtc

SEQ ID NO: 141038 - DNA, 601 bp, Human
aagcctgccacatagcaggcattcaaaaatggcaatgccttcccaaatgcaattgaactaaaagcactatctgtggcattacctcttaaagaaacagacctatgaggctcatgtctgcatcacttctatcatttatgtaatgtagatggatgggaacccctcccccaatccatccatgctcaactccagggttacctgcactgttataactggccctccattctgatagaggagaggcttcatcttgggcagaaggactcccaaccacttgtccacagctgccaggtaatctggaaaacargaaaagtttaacacaagcttgtccaaccccagcctgtaagccacatgcagcccaggatggctttgaatgtggcccaacacaaattcgtaaactttttaaaaacattctgagttttctggctgggtgcggtggctcacgcctgtaatcccagcactttgggaggctgaggcaggcagatcaccagatgtcgggagttcgagaccagcctgaccaacatggagaaaccccatctctactaaaaatgcaaaattagccaggcttggtggcgcatgcctgtaatcccagctacttgggaggctg

SEQ ID NO: 141039 - DNA, 601 bp, Human
cacagtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctgtaatcccagctacatgggaggctgaggtgggagaattgcctgaactcagaaggcagaggttgcagtaagccgagattgccccactgcactccagcctgggcaacggaatgagactctctctcaaaaaaaaaaaaaaaaaaaaaaaaaggagcatccatggcatccttggtcaatgtccaatgaacatggttttatgtttcacctaagtaattttaccaacaccaaaaactgttaaagttcaatgtaccccacagtatattagtccttgcagagccaagaacacatagaagaaggagaatggggcaggaagtaagagaggaaacataacagccagccccaattgaccatatccttttccattccagggttatctgactgtcaaggcagtgccgataccaaagtgtttcagtccacgctgcatgcctgctgccagaaaacaatattgcag

SEQ ID NO: 141040 - DNA, 601 bp, Human
aagagcatccttggtcatagccgggcacagtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctgtaatcccagctacatgggaggctgaggtgggagaattgcctgaactcagaaggcagaggttgcagtaagccgagattgccccactgcactccagcctgggcaacggaatgagactctctctcaaaaaaaaaaaaaaaaaaaaaaaaaggagcatccatggcatccttggtcaatgtccaatgaacatggttttatgtttcacctaagtaattttaccaacaccaaaaactgttaaagttcaatgtaccccacagtatattagtccttgcagagccaagaacacatagaagaaggagaatggggcaggaagtaagagaggaaacataacagccagccccaattgaccatatccttttccattccagggttatctgactgtcaaggcagtgccgataccaaagtgtttcagtccacgctgcatgc

SEQ ID NO: 141041 - DNA, 601 bp, Human
gcctgaacctgggaggcagaggttgcagtgagccgagattgtgccactgcattccagcctgggcgacagagcgagactctgtctcctaaaaaaaaaaaaaaaaaaacctttactcttttccataagagcatccttggtcatagccgggcacagtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctstaatcccagctacatgggaggctgaggtgggagaattgcctgaactcagaaggcagaggttgcagtaagccgagattgccccactgcactccagcctgggcaacggaatgagactctctctcaaaaaaaaaaaaaaaaaaaaaaaaaggagcatccatggcatccttggtcaatgtccaatgaacatggttttatgtttcacctaagtaattttaccaacaccaaaaactgttaaagttcaatgtaccccacagtatattagtccttgcagagccaagaacacatagaagaaggagaatg

SEQ ID NO: 141042 - DNA, 601 bp, Human
aggtgggtgaatcacctgaggtcaggagtttgagaccagcctggtcaacatggtgaaaccctgtctctactaaaaatacaaaaacatagccaggcatcgtggtgcacgcctgtaatgccagctacttgggaggctgacacaggagggtcgcctgaacctgggaggcagaggttgcagtgagccgagattgtgccactgcattccagcctgggcgacagagcgagactctgtctcctaaaaaaaaaaaaaaaaaaacctttactcttttccataagagcatccttggtcatagccgggcacrgtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctgtaatcccagctacatgggaggctgaggtgggagaattgcctgaactcagaaggcagaggttgcagtaagccgagattgccccactgcactccagcctgggcaacggaatgagactctctctcaaaaaaaaaaaaaaaaaaaaaaaaaggag

SEQ ID NO: 141043 - DNA, 601 bp, Human
gaggctgaggtgggtgaatcacctgaggtcaggagtttgagaccagcctggtcaacatggtgaaaccctgtctctactaaaaatacaaaaacatagccaggcatcgtggtgcacgcctgtaatgccagctacttgggaggctgacacaggagggtcgcctgaacctgggaggcagaggttgcagtgagccgagattgtgccactgcattccagcctgggcgacagagcgagactctgtctcctaaaaaaaaaaaaaaaaaaacctttactcttttccataagagcatccttggtcatagcygggcacagtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctgtaatcccagctacatgggaggctgaggtgggagaattgcctgaactcagaaggcagaggttgcagtaagccgagattgccccactgcactccagcctgggcaacggaatgagactctctctcaaaaaaaaaaaaaaaaaaaaaa

SEQ ID NO: 141044 - DNA, 601 bp, Human
catagctgggcacggtggctcacgcctgtaatcccagcactttgggaggctgaggtgggtgaatcacctgaggtcaggagtttgagaccagcctggtcaacatggtgaaaccctgtctctactaaaaatacaaaaacatagccaggcatcgtggtgcacgcctgtaatgccagctacttgggaggctgacacaggagggtcgcctgaacctgggaggcagaggttgcagtgagccgagattgtgccactgcattccagcctgggcgacagagcgagactctgtctcctaaaaaaaaaaaamaaaaaacctttactcttttccataagagcatccttggtcatagccgggcacagtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctgtaatcccagctacatgggaggctgaggtgggagaattgcctgaactcagaaggcagaggttgcagtaagccgagattgccccactgcactccagcctgg

SEQ ID NO: 141045 - DNA, 601 bp, Human
agcatccttggtcatagctgggcacggtggctcacgcctgtaatcccagcactttgggaggctgaggtgggtgaatcacctgaggtcaggagtttgagaccagcctggtcaacatggtgaaaccctgtctctactaaaaatacaaaaacatagccaggcatcgtggtgcacgcctgtaatgccagctacttgggaggctgacacaggagggtcgcctgaacctgggaggcagaggttgcagtgagccgagattgtgccactgcattccagcctgggcgacagagcgagactctgtctcctaaaaaaaaaaaaaaaaaaacctttactcttttccataagagcatccttggtcatagccgggcacagtggctcacgcctgtaatcccagcactttggaaggccaaggcgggcagatcacctgaggtcaggagtttgagaccagcctggccaacatggcgaaaccccgtctctactaaaaatacaaaaattagccaggcatggtggcatgcgcctgtaatcccagctacatgggaggctgaggtgggagaattgcctgaactcagaaggcagaggttgcagtaagccgagattgccccactgc

SEQ ID NO: 141046 - DNA, 601 bp, Human
atccctctgtgagcagcaacctggcctctctcaagaagacatctcctcccaccacaaagcctcagaacggacaccctggccagtgcagccctctcagcacctctgtccaccgacacctgaaaggcaaggcagtgcccatgctcccaccctactatgatccatccccacaagctgcccatagtactgttcataagaaggaagcctggcccacactcccctagggagtgccactttgcatccctgggatgtccaggatgcagccacttttacataactttactcttttccataaaagcatccytggtcatagctgggcacggtggctcacgcctgtaatcccagcactttgggaggctgaggtgggtgaatcacctgaggtcaggagtttgagaccagcctggtcaacatggtgaaaccctgtctctactaaaaatacaaaaacatagccaggcatcgtggtgcacgcctgtaatgccagctacttgggaggctgacacaggagggtcgcctgaacctgggaggcagaggttgcagtgagccgagattgtgccactgcattccagcctgggcgacagagcgagactctgtctcctaaaaaaaa

SEQ ID NO: 141047 - DNA, 601 bp, Human
aggaggagggggacagagtcacctggcaggacccagggtcaagttaaagtcatctgaggttgctagggatggacacaagaagaaatatctccacacagtcaacttcattctcctttgcagaattaatacttgattatactttttgtggcatttccaaaaccaaaaggggcagaaaagttgtgagcagaaattgaaagtgattcaaggagaggcagagactgaaaaaaagagggcatcaaaagagggtttgcacctgaggccagaagaaaggaagaagacacagccatgcagagcaaagacrcacccaagtttcagacttgatatcttcatgtaggaaaatgtggttcctattagcttaaccagtacagacacaagatggtaaaaactaggggcacgtggggtgactcacacatccctctgtgagcagcaacctggcctctctcaagaagacatctcctcccaccacaaagcctcagaacggacaccctggccagtgcagccctctcagcacctctgtccaccgacacctgaaaggcaaggcagtgcccatgctcccaccctactatgatccatccccacaagctgcccatagtactgttca

SEQ ID NO: 141048 - DNA, 601 bp, Human
gcctcggcctcccaaagtgctgggattacgggcattgagccatcagccttggcccttttacagaaatcttcacacacagaaatactgtttacaggcctggcacagtggctcatggctttcatcccagcactttgggaagctgaggtgggcggatcatgaggtcaagagattgagaccatcctgaccaacatggtgaaacctcatctccactaaaaatacacaaaattagctggcgtggttgcccgcacctgtagtcccagctattcaggaggctgaggcaggaggatcacttgaacccagraggtggaggttgcagtgagccgagatctcatcactgcactcagcctggtgacagagagagactctgtctcaaaaaacaaaaacaataacaacaacgaaaagaattactgtctacaaatcccccggttccttcttatcaaagcaatcagcttctattccattccagagccgttcggtgggtatgtgatgtgcacaaatgcatgatgtgccctcatggctaccaggcagaggcgtggaaggccaggagactagagacacagtgtgtcagggatgaaactgctcccacatgtgcttcacaaaa

SEQ ID NO: 141049 - DNA, 601 bp, Human
tctgtaacacaacagtgttgagggccctaaatgttctcagacagggatttaagccttctggtctgactcatttttaccctggctgcaaacacgtagctcctccctggccatctcaaactctgagcactgagagagaaaaccagcatcaagaattgaggaaagccaccattttctacccttcaacatgaattaagacagagacagaaatcagcttttacagaaatctttattttttttgagacagagtctcacttttttgcccaggctggagtgcagtgagtggtgtgatcacggctcaccrcagccccaacctcccaggctcaagtgatcctcctgcctctgccccctgaatggctgggaacacgggtgcatggcagcatactcagctaatttttaaattttttgtagagatggagtttcactatgttgcccaggctggtcttgaactcctgggctcaagagatcctcctgcctcggcctcccaaagtgctgggattacgggcattgagccatcagccttggcccttttacagaaatcttcacacacagaaatactgtttacaggcctggcacagtggctcatggctttcatcccagcact

SEQ ID NO: 141050 - DNA, 601 bp, Human
tccttaagcaccagagacttttaaagatgttgatcttccaaacagtcataaataggcttattacctcatgatgaatgccctgttaattggatgaagttaagttgtgggtggaaggtcgtccactcctaattattttcaccttggatattatcaatggctttagctttttcaggtagaaactgagataaacatccacatatgcaaaccatcataggtggcactggctcagctaatccccccaaaagagaaacatctgcatatctgactgaatcatgacgatgaataaaagcacagacctggyttcctgtatctgtaacacaacagtgttgagggccctaaatgttctcagacagggatttaagccttctggtctgactcatttttaccctggctgcaaacacgtagctcctccctggccatctcaaactctgagcactgagagagaaaaccagcatcaagaattgaggaaagccaccattttctacccttcaacatgaattaagacagagacagaaatcagcttttacagaaatctttattttttttgagacagagtctcacttttttgcccaggctggagtgcagtgagtggtgtgatcac

SEQ ID NO: 141051 - DNA, 601 bp, Human
gcgagaattgcttgaacccgggaggcagaggttgccatgagcagagattgcgccactggattccagcctgggtgacagagaaaacaaacaaacaaacaaacaaacaaaaaaccaccagagagtaaatattttaggtgttgcagccatagaggtctccatctcaactactcaactctgccactatagtacaaaagcggccacagatgatatataaacagtgtggcgattccaatatacttttacttacaaaaaaatgtaggtggcagccataatttgcaggtctttgttttagagtaactgyctccattctgtaagctccttaagcaccagagacttttaaagatgttgatcttccaaacagtcataaataggcttattacctcatgatgaatgccctgttaattggatgaagttaagttgtgggtggaaggtcgtccactcctaattattttcaccttggatattatcaatggctttagctttttcaggtagaaactgagataaacatccacatatgcaaaccatcataggtggcactggctcagctaatccccccaaaagagaaacatctgcatatctgactgaatcatgacgatgaata

SEQ ID NO: 141052 - DNA, 601 bp, Human
ccccatctctactaaaaatacaaaaaaaattagccaggcatgatggcaggtgcctgtaatcccagctatttgagaggctcaggtgcgagaattgcttgaacccgggaggcagaggttgccatgagcagagattgcgccactggattccagcctgggtgacagagaaaacaaacaaacaaacaaacaaacaaaaaaccaccagagagtaaatattttaggtgttgcagccatagaggtctccatctcaactactcaactctgccactatagtacaaaagcggccacagatgatatataaacrgtgtggcgattccaatatacttttacttacaaaaaaatgtaggtggcagccataatttgcaggtctttgttttagagtaactgtctccattctgtaagctccttaagcaccagagacttttaaagatgttgatcttccaaacagtcataaataggcttattacctcatgatgaatgccctgttaattggatgaagttaagttgtgggtggaaggtcgtccactcctaattattttcaccttggatattatcaatggctttagctttttcaggtagaaactgagataaacatccacatatg

SEQ ID NO: 141053 - DNA, 601 bp, Human
agcctggccaacatggtgaaaccccatctctactaaaaatacaaaaaaaattagccaggcatgatggcaggtgcctgtaatcccagctatttgagaggctcaggtgcgagaattgcttgaacccgggaggcagaggttgccatgagcagagattgcgccactggattccagcctgggtgacagagaaaacaaacaaacaaacaaacaaacaaaaaaccaccagagagtaaatattttaggtgttgcagccatagaggtctccatctcaactactcaactctgccactatagtacaaaagcrgccacagatgatatataaacagtgtggcgattccaatatacttttacttacaaaaaaatgtaggtggcagccataatttgcaggtctttgttttagagtaactgtctccattctgtaagctccttaagcaccagagacttttaaagatgttgatcttccaaacagtcataaataggcttattacctcatgatgaatgccctgttaattggatgaagttaagttgtgggtggaaggtcgtccactcctaattattttcaccttggatattatcaatggctttagctttttcaggtagaaac

SEQ ID NO: 141054 - DNA, 601 bp, Human
caaccttggttttcttatcatcttgcttttccaggtcttatttatccattatcatcattgtatcatatactctaaaataaacaggcttgtaaaaaatgcgtacacataatttggttaggttttgagagagcgagaaaagcacaattgcgaggcagcttagagttctagtcacaggcacggctggcaggggcccaactgtctacatgtaaatctgagctctgccacttcctacccatgggactccacctgtaaagtgtacctaactcgatgggttatcatgaggattaactgagtcaatacrtgactagaaccttgcacagatctggcatctagtaagtgctcaaaatgttagcagctaagactctactcaagttctatgttacgaccaattaggaaaaaaaaaggtgggtgaaggctgggggtaggtgagacacacaaatgaaaaggcttgaaaaacccatagaaaaagtcatggctaggttcagaggaacaccgatgtttctagagcaggagtcaacaaactttttgaataaaacaccaggctgggcgtggtggctcacgcctgtaatcctagtactttgggaggctgaggcgggtggat

SEQ ID NO: 141055 - DNA, 601 bp, Human
aagttccttttgcaataatttagataaatgctaagaaaagctttgtaaatactggcaaagttcttttctcctcctttataagtgctacttacatgactgtgtctcctttttatcatctggctgtcaagaaattcagagctaaagatcttaaaagttagctccagcaactaaatggtctcacagcctctgtacctcatgttctcttgagctcacccccatgccccaacccaaccttggttttcttatcatcttgcttttccaggtcttatttatccattatcatcattgtatcatatactcyaaaataaacaggcttgtaaaaaatgcgtacacataatttggttaggttttgagagagcgagaaaagcacaattgcgaggcagcttagagttctagtcacaggcacggctggcaggggcccaactgtctacatgtaaatctgagctctgccacttcctacccatgggactccacctgtaaagtgtacctaactcgatgggttatcatgaggattaactgagtcaatacatgactagaaccttgcacagatctggcatctagtaagtgctcaaaatgttagcagctaagactctactcaagt

SEQ ID NO: 141056 - DNA, 601 bp, Human
tggtcatgaaaccatcctggaagaggaagtatttgctgcttacaagagtagaaaactcccattgatgagttccatgaaagttccttttgcaataatttagataaatgctaagaaaagctttgtaaatactggcaaagttcttttctcctcctttataagtgctacttacatgactgtgtctcctttttatcatctggctgtcaagaaattcagagctaaagatcttaaaagttagctccagcaactaaatggtctcacagcctctgtacctcatgttctcttgagctcacccccatgcccmaacccaaccttggttttcttatcatcttgcttttccaggtcttatttatccattatcatcattgtatcatatactctaaaataaacaggcttgtaaaaaatgcgtacacataatttggttaggttttgagagagcgagaaaagcacaattgcgaggcagcttagagttctagtcacaggcacggctggcaggggcccaactgtctacatgtaaatctgagctctgccacttcctacccatgggactccacctgtaaagtgtacctaactcgatgggttatcatgaggattaactgagtca

SEQ ID NO: 141057 - DNA, 601 bp, Human
tgcttagcctgagtgcctgggagagattgttagggaaggttccttggagggacagcccgaggtagctctagaagaaaaggctctgaacttgggaagggaatgggtagaggatattcctacatatttgacatcaccaacagctcaatttcatccacgtgcagagttggagagtgggagaagaatggtgagtgacaaaaatgaattaaatgctgccgtcattatctgcacagtcctgcctcccacaaggtttcatgaatgatccttctctcagagaggatccctctggcaatactttcagatytggggttcaagaagtaaaacagactgtagcacgcatgcccaggacagagacttcactggtcatgaaaccatcctggaagaggaagtatttgctgcttacaagagtagaaaactcccattgatgagttccatgaaagttccttttgcaataatttagataaatgctaagaaaagctttgtaaatactggcaaagttcttttctcctcctttataagtgctacttacatgactgtgtctcctttttatcatctggctgtcaagaaattcagagctaaagatcttaaaagttagctccagcaa

SEQ ID NO: 141058 - DNA, 601 bp, Human
catatcctttatgaaagccactctcctaaatgaagtctctcttaatattacttatggccagaagcatcctaaccacattgcccacccatctgtaactttcacttgcagcatctccacagtttacacagcactgtgtaaggaatctggcatagcctttgtagcatctgccaaaccacctccagccctgacagttcagtgttctaagttatgcagaaagacaacaaagcataaggtaagttcccagccagtggctgacctcaaggttggctacagccaaggcataaccccgagtgtcctgccraggtgggaggacagggagggcagaaagagcagagaagcgcgccccagacacagcctaaaaggtgactgcctcaaggtagagcttctcacagctggagatgcctacctgcttcttcatcttgggtgggccagcctagcccctgagatagcagtactccattttccaggctagctccaccagtgctgaaaatgcagctaccctggaagctcttggcctacagataaccctctgttactgaggggtgcaagtattctattctacctgttccttgaaaaatgaaaacatgaaaaatctcaatct

SEQ ID NO: 141059 - DNA, 601 bp, Human
ccaggctaatttcctcatttcagtcttctgtacatccctcttaagagaggcaaacattggctgtgcaatgcacatgaagtgccttttacctcagaggggagaacatcagggtctttatgctactcaaggaactggtcttttttgtgtgtgtgtatctttttttttttttgagacagggtcttgctctgttgcccagcttggggtgcagtggcacaatcacagctcaccgcagccttgaactcgtgggctcaagtgatcttcccacctcatcctccctagtagctaggactacaggcacttrccaccatgcctagcctgtaactttttattctgcagtgatttcaaacttacagaatgttgtaagaatagtacaaaaaaactctcctattcccttcacctagatttcccaattgttagcattttactagatatacactatcagtttctctataaaaatatacatttttctgagccacctgagaataaattgcagatgtgatggccctttatccctaaatacatcagtgttcattctctcagaacaaaggcattctttaaataaacacaatatacttctaaaaatcaggaaattatactgata

SEQ ID NO: 141060 - DNA, 343 bp, Human
aaaaaaaaaaaaaaaagcaacaccaggctaatttcctcatttyagtcttctgtacatccctcttaagagaggcaaacattggctgtgcaatgcacatgaagtgccttttacctcagaggggagaacatcagggtctttatgctactcaaggaactggtcttttttgtgtgtgtgtatctttttttttttttgagacagggtcttgctctgttgcccagcttggggtgcagtggcacaatcacagctcaccgcagccttgaactcgtgggctcaagtgatcttcccacctcatcctccctagtagctaggactacaggcacttgccaccatgcctagcctgtaa

SEQ ID NO: 141061 - DNA, 593 bp, Human
caagaccctctgataaccacttgctctgagatgggcctttggcttctctgtaaggccagctttcaggacagaatatgctgattgagaaagagcagaatctcattggctgtctttctcactattaagcattaggtggcattcagctctttaaacactgttctcatgagacccatcgggcaatgcccctctcccacacaaagcaatgaagctggcaaaagcctcagactggagggcccatctgccccaggcaccctggccttgtggttgtctattctccaacccctagcagtgacagtcacgytgtcacctcacatacaaattatgcttaaaacacaatcataatcaccttcaatttgttcctcccaacagaaaaatgccgtgctttttcatcgctgtgatgagaagcctggccaaagcaggaggaaaccggcatgtcacttcctctgcagcgctttgtattaggttggtgcaaaagtaattgtggtttttgtcatggttttcttttctttttttttttttttttgagatggagtttcgctctgttgcccaggctggagtgtagtggcgcaatctcagctcactgcaacctctgg

SEQ ID NO: 141062 - DNA, 601 bp, Human
tatttgccagttaattaagaaatcaaagggatgtgggggctctaattgtgtttacccctgaataatggaatatactctggattctaatttgtacatcagccattccaaaccacttgctctcaagttttcctcatgaaatgtcccattaggggtgtcttgtcttgcctctcgtgtcttctattttcccttcctcctctaaaacaaaaaagaatttctccacagagaaggaatgggctgccaaacactggggaaagaggaagcatgagcagtgtccacaccaacccgagcagagaatgccctrgccccacacttcacaacccagttcccacagcaggtatcccagggtggacgtggccccagccaagaccctctgataaccacttgctctgagatgggcctttggcttctctgtaaggccagctttcaggacagaatatgctgattgagaaagagcagaatctcattggctgtctttctcactattaagcattaggtggcattcagctctttaaacactgttctcatgagacccatcgggcaatgcccctctcccacacaaagcaatgaagctggcaaaagcctcagactggagggcccatct

SEQ ID NO: 141063 - DNA, 601 bp, Human
gcccatggctactgagggcaccctcccctcaggcaatgaacactcacaagttcacactcgccccacgggcaagtatatcatagagggaggaagccactgcttcggtcttgattgtggagtgaggttggccccagtgatctagccagccagtatagaattcagaattgatctaaaacaaaaaaagaacgtagcccttaggatagacttatgaccttccaatgccagggcttccctgcaatgccccatctatgacaggtgtaaagggggttgacatgctgacatgcactgcttaacccagagmcgccccccagtgagcacttccaataccagcaatgcctatgttcagtcctcaggttctaacctaaagtagatctcatcttatacaatgcaagtattcctgaaaagtggtgcctatattaaaatttagatagctgatcccctgtttaaacacagtaggaaagtcttgttgggcaaagaaactgggtagcaaaatatttttatagaataacagctccaggccgggcgcagtggctcatgcctgtaatctcagtactttgggaggccgaggtgggcggatcacaaggtctagagattgagaccc

SEQ ID NO: 141064 - DNA, 601 bp, Human
ccagcctggccaacatggtgaaaccccgtctctactaaaaatgcaaaaacttagccaggcatggtggtgcatgcctgtaatcccataatcccagctacttggaggctgaggcaggaggatcccttgaacctgggaggtggaggctgcagtgagttgagattgtaccactgcactccagcctgggtgacagagtgagactgtctacaaaaaaaaaagaaaaagaaaaagaaaaaaaaaagaaaatttaggagaggataaacaaaaaaaggaaaataaaattgtctgtgggcacacccctccycaaattaatcaacagaaacattctagcataagtttctacagatattaaagtgctcttaccattccaataggcaaaattggtcccacctataaacatgtacctacaaggaaacaaaagaacacggtacttcactgtgagcccatggctactgagggcaccctcccctcaggcaatgaacactcacaagttcacactcgccccacgggcaagtatatcatagagggaggaagccactgcttcggtcttgattgtggagtgaggttggccccagtgatctagccagccagtatagaattcaga

SEQ ID NO: 141065 - DNA, 601 bp, Human
gggccaggcatggtggctcacgcctgtaatcctagcattttgggaggccaaagtgggaggatcacttgaggtcaagagttcaagaccagcctggccaacatggtgaaaccccgtctctactaaaaatgcaaaaacttagccaggcatggtggtgcatgcctgtaatcccataatcccagctacttggaggctgaggcaggaggatcccttgaacctgggaggtggaggctgcagtgagttgagattgtaccactgcactccagcctgggtgacagagtgagactgtctacaaaaaaaaaaraaaaagaaaaagaaaaaaaaaagaaaatttaggagaggataaacaaaaaaaggaaaataaaattgtctgtgggcacacccctccccaaattaatcaacagaaacattctagcataagtttctacagatattaaagtgctcttaccattccaataggcaaaattggtcccacctataaacatgtacctacaaggaaacaaaagaacacggtacttcactgtgagcccatggctactgagggcaccctcccctcaggcaatgaacactcacaagttcacactcgccccacgggcaagtatat

SEQ ID NO: 141066 - DNA, 601 bp, Human
taaaaattattttgtccaggcgcagtggctcacgcctgtaatcccagaactttgggaggccaaggcaggtggatcacgaggtcaggagatcgagaccaccctggctaacacggtgaaaccccgtctctactaaaaatacaaaaacaaaaattagctgggtgtggtggcgggtgcctgtagtcccagctactctggaggctgcggtgggagaatgatgtgaacccgggaggcagagcttgcagtgagccaagatttgcacctctgcactccagcctgggcgacagagcgagactgcgtctcaaaaaaaaaaaaaaaaaaaaaaagtaagaaatattattttttaaaattacataggtaatccttatatgttagaaaatttagggccaggcatggtggctcacgcctgtaatcctagcattttgggaggccaaagtgggaggatcacttgaggtcaagagttcaagaccagcctggccaacatggtgaaaccccgtctctactaaaaatgcaaaaacttagccaggcatggtggtgcatgcctgtaatcccataatcccagctacttggaggctgaggcaggaggatcccttgaacctgggag

SEQ ID NO: 141067 - DNA, 601 bp, Human
cgttacagaaaaattttgtcataatttttcctacacaaaaaaatacagaaatgtaaagtggtgtggcctttttgggaaacactatggcagttcctgaaactctaaacatagagttaccatatgacacagccgttccacttcttggtatacacccaaaggaactgaaacaggaattcaaacaaatccttgtacatcaatgttcaaagcaacactataaccaaaatgtgcaaataacccaaatgtccatcaaccaatgaatggataaataaaatactgtacatccacacaagggaatactatkcagcaataaaaaggaatgaagcactagtacgtgcaacaacgtggatgagcgttgaacacattgggctaaatgaaagaagtcatacaggtgtatatatgtggttcacttatacgaaatgttcagaattggcaaacccacagggacagaaagtatattatttccaggggctgagaggagggagagtgtggaatgaatgctaatgggtatggagtttctttttggggtgataaaatgtttctgaattagataatggtaatggttacacaactttgtgaatacagtaaataccactgcatcata

SEQ ID NO: 141068 - DNA, 601 bp, Human
gcatcatctgtctttgcaaaaaaccaacaaaaatcaaagacgttacagaaaaattttgtcataatttttcctacacaaaaaaatacagaaatgtaaagtggtgtggcctttttgggaaacactatggcagttcctgaaactctaaacatagagttaccatatgacacagccgttccacttcttggtatacacccaaaggaactgaaacaggaattcaaacaaatccttgtacatcaatgttcaaagcaacactataaccaaaatgtgcaaataacccaaatgtccatcaaccaatgaatgkataaataaaatactgtacatccacacaagggaatactattcagcaataaaaaggaatgaagcactagtacgtgcaacaacgtggatgagcgttgaacacattgggctaaatgaaagaagtcatacaggtgtatatatgtggttcacttatacgaaatgttcagaattggcaaacccacagggacagaaagtatattatttccaggggctgagaggagggagagtgtggaatgaatgctaatgggtatggagtttctttttggggtgataaaatgtttctgaattagataatggtaatggt

SEQ ID NO: 141069 - DNA, 601 bp, Human
tctggatgatgtttcgcagagcaaaatacttctcagtgaggtccccagcctcactcagtggggcatcatagtcgtagctggtgggctgtgctgcatagggtgagttggcccctagaagacaaaaatgtgccactagttattactgatggtgcagctctgggacaagttctttgggatccatgagctcagcactgtagagagagaaaactagaagacacattaaaaccacttgttgggagacacagacgtgaccctcaggatgcaacgtttagaggaaggaatttctttctacaggtagcasttaccaggcaccttagagtttaccaaggactctttccatccactctctacagaagctcacagctgtgattctagcaggtatcacccccactggacaagcagggaatctgaagctccccacaaaaatctgctaacacctcacaagcagtaatggcagggcttatgatatgacccccatctctgactgttaatcctgtcaactctgaactttttcacgtcctcaagctgtggctgagaaaagctcagtggtgaagacacagatgactaggccatggatcagcagaaaacccagggcttatta

SEQ ID NO: 141070 - DNA, 601 bp, Human
cagagccacagtgagttcaaaagaggctctgtccaagatcagcccaccacagctcatacaaagcacccaccttctggatgatgtttcgcagagcaaaatacttctcagtgaggtccccagcctcactcagtggggcatcatagtcgtagctggtgggctgtgctgcatagggtgagttggcccctagaagacaaaaatgtgccactagttattactgatggtgcagctctgggacaagttctttgggatccatgagctcagcactgtagagagagaaaactagaagacacattaaaaccasttgttgggagacacagacgtgaccctcaggatgcaacgtttagaggaaggaatttctttctacaggtagcagttaccaggcaccttagagtttaccaaggactctttccatccactctctacagaagctcacagctgtgattctagcaggtatcacccccactggacaagcagggaatctgaagctccccacaaaaatctgctaacacctcacaagcagtaatggcagggcttatgatatgacccccatctctgactgttaatcctgtcaactctgaactttttcacgtcctcaagctgt

SEQ ID NO: 141071 - DNA, 601 bp, Human
tgcattaaataaagaaaccagagcttagctttacctcttttgatattgaagtacattagctgtgtctcaaggataggggctcccatatatccatgctgccttaatcggggctatagtctcaagaggatctgtgcattctctcccatcaccctacctctcacctgaacttttggaaagataatctggcctggaaggagaagaaaatggagacagaaatttccccgggtgaattctcaccatataagaagtgaatctgtaagtagcatttaacactgtattatatattgcagtttttaaatamatgtcttatatctcctactctcctataagcatctgctcatagactcactcttaaccacgtgggtacaagatgcaaacccaagtctagctgatgcctcccttcatccatccttttaaacaggagggctccaggcaggaagttgtccacagagccacagtgagttcaaaagaggctctgtccaagatcagcccaccacagctcatacaaagcacccaccttctggatgatgtttcgcagagcaaaatacttctcagtgaggtccccagcctcactcagtggggcatcatagtcgtagctggt

SEQ ID NO: 141072 - DNA, 601 bp, Human
taattcttatacactttggttactggaaacttacttttttcagatgatgcattaaataaagaaaccagagcttagctttacctcttttgatattgaagtacattagctgtgtctcaaggataggggctcccatatatccatgctgccttaatcggggctatagtctcaagaggatctgtgcattctctcccatcaccctacctctcacctgaacttttggaaagataatctggcctggaaggagaagaaaatggagacagaaatttccccgggtgaattctcaccatataagaagtgaatytgtaagtagcatttaacactgtattatatattgcagtttttaaatacatgtcttatatctcctactctcctataagcatctgctcatagactcactcttaaccacgtgggtacaagatgcaaacccaagtctagctgatgcctcccttcatccatccttttaaacaggagggctccaggcaggaagttgtccacagagccacagtgagttcaaaagaggctctgtccaagatcagcccaccacagctcatacaaagcacccaccttctggatgatgtttcgcagagcaaaatacttctca

SEQ ID NO: 141073 - DNA, 601 bp, Human
aaggttgaagaaatagtgtccaggttcaaaatctggtgttcctcattctgaaatcacatagtctgtatattgggccacacataaaaaggaaaatagtttatcttcttctctcttgcaaataaggacggagttattttctagtgagaaataattcttatacactttggttactggaaacttacttttttcagatgatgcattaaataaagaaaccagagcttagctttacctcttttgatattgaagtacattagctgtgtctcaaggataggggctcccatatatccatgctgccttaatmggggctatagtctcaagaggatctgtgcattctctcccatcaccctacctctcacctgaacttttggaaagataatctggcctggaaggagaagaaaatggagacagaaatttccccgggtgaattctcaccatataagaagtgaatctgtaagtagcatttaacactgtattatatattgcagtttttaaatacatgtcttatatctcctactctcctataagcatctgctcatagactcactcttaaccacgtgggtacaagatgcaaacccaagtctagctgatgcctcccttcatc

SEQ ID NO: 141074 - DNA, 601 bp, Human
taccacttattagacatatatgtgtcaggaactgtcctggatggcttacatacgttcttttcaagctttacagcacaaccagatgctgtaatcccagttttacaaattaacaatcagtagactgatttgctcatagactcactctttttttttttttaggtaaataaataattattgttcatttatttgactatgaaagaagaaaacaaacatttattgagtgccatttatttttaaactgtacaagtctgtgaggcaagtacggctacctctacttttatataaagggaatttacacaaytggcttaaggttgaagaaatagtgtccaggttcaaaatctggtgttcctcattctgaaatcacatagtctgtatattgggccacacataaaaaggaaaatagtttatcttcttctctcttgcaaataaggacggagttattttctagtgagaaataattcttatacactttggttactggaaacttacttttttcagatgatgcattaaataaagaaaccagagcttagctttacctcttttgatattgaagtacattagctgtgtctcaaggataggggctcccatatatccatgctgc

SEQ ID NO: 141075 - DNA, 601 bp, Human
aatatagtcaacaactgtaaaatatactttctttttatgcgcacattgaccattaatattggtgtatgtcaggctctaagactaggctcagcagctttcaagggattggtatcacagactatattctctaaccagaatgcaaaaagactagaaatcaaaaaaacaggaaagtacttatttccagtaatttaaaaaacacatatcaatggtgaagagaaatcaaaatagatatgtttagaagcaaacagtaagaaatagattgcacatcaaaacttacgagataaagccacagcagtacttsaaggaaatttataaccttaaatatttatattagaaaagaagaaaggctgcattaaaaagctaagcttcaaataaaggaaggaaataataaagataggaacagaaagcttcaaaacagaacaaacatacaagggagagcttgggagacattactataaattctgtggagattaaacccataataaaggaataacataagcaacattttaacaatacatttgaaaatttagatgaaatggacaaattataagtgtggtaagtctagattgtattttttatatttaaaaaatttgtaatattc

SEQ ID NO: 141076 - DNA, 601 bp, Human
taatctgatgaacatgtatgtagaatatagtcaacaactgtaaaatatactttctttttatgcgcacattgaccattaatattggtgtatgtcaggctctaagactaggctcagcagctttcaagggattggtatcacagactatattctctaaccagaatgcaaaaagactagaaatcaaaaaaacaggaaagtacttatttccagtaatttaaaaaacacatatcaatggtgaagagaaatcaaaatagatatgtttagaagcaaacagtaagaaatagattgcacatcaaaacttacragataaagccacagcagtacttgaaggaaatttataaccttaaatatttatattagaaaagaagaaaggctgcattaaaaagctaagcttcaaataaaggaaggaaataataaagataggaacagaaagcttcaaaacagaacaaacatacaagggagagcttgggagacattactataaattctgtggagattaaacccataataaaggaataacataagcaacattttaacaatacatttgaaaatttagatgaaatggacaaattataagtgtggtaagtctagattgtatttttta

SEQ ID NO: 141077 - DNA, 601 bp, Human
taggaagcagatcaaagatatcaatggcaccattaataaacttaatctgatgaacatgtatgtagaatatagtcaacaactgtaaaatatactttctttttatgcgcacattgaccattaatattggtgtatgtcaggctctaagactaggctcagcagctttcaagggattggtatcacagactatattctctaaccagaatgcaaaaagactagaaatcaaaaaaacaggaaagtacttatttccagtaatttaaaaaacacatatcaatggtgaagagaaatcaaaatagatatgttyagaagcaaacagtaagaaatagattgcacatcaaaacttacgagataaagccacagcagtacttgaaggaaatttataaccttaaatatttatattagaaaagaagaaaggctgcattaaaaagctaagcttcaaataaaggaaggaaataataaagataggaacagaaagcttcaaaacagaacaaacatacaagggagagcttgggagacattactataaattctgtggagattaaacccataataaaggaataacataagcaacattttaacaatacatttgaaaatttagatgaaa

SEQ ID NO: 141078 - DNA, 601 bp, Human
gacaagaaatttcaaactagatattttaaaaattcgattatatcctgtttataagggacacatgtaaagagaacaaaggatataaaaaggatgaaattacagcattgggaaagatacctcagaaaaataaataccaagcaaaagtatgcaggtaaatggtgttaatgaataacagaccaaaaaaagaaaaaaaaaaaaaaaaaaaggcttccaggcaaaaagccttattagaaatagagggttatataatccctttactattaagtactgaaggatgtaattctcaatttgcccacctaayaacataacctcagaactggcagagctacaaagggaaatacatgaggacaactctcactaaatagtagactgaactgacaaaaaattaggaagcagatcaaagatatcaatggcaccattaataaacttaatctgatgaacatgtatgtagaatatagtcaacaactgtaaaatatactttctttttatgcgcacattgaccattaatattggtgtatgtcaggctctaagactaggctcagcagctttcaagggattggtatcacagactatattctctaaccagaatgcaaaaagacta

SEQ ID NO: 141079 - DNA, 601 bp, Human
aggggcttccggggagctatgtgtttgtcacagggctgcgctcccgttgcctaaattcactgagctgtgtactacgagttgttcttttctgggggtatagatgtcacacttaaatggtaaccactaaaaaaattagaatgcagtgaataacttccaaagtagaagaggggggaaagaaataagaggaaaaaacaaaacaaaacaaaaaacctcaatctaaaagaaagcaataaagggaaagaaagagccaaaaaggtaaacgaatagaaattataaaataagataattgaaattcatctaygtatatcaagaagtacaatgaatgagaatgtataaatatatcagttaaaagacaagaaatttcaaactagatattttaaaaattcgattatatcctgtttataagggacacatgtaaagagaacaaaggatataaaaaggatgaaattacagcattgggaaagatacctcagaaaaataaataccaagcaaaagtatgcaggtaaatggtgttaatgaataacagaccaaaaaaagaaaaaaaaaaaaaaaaaaaggcttccaggcaaaaagccttattagaaatagagggttatataat

SEQ ID NO: 141080 - DNA, 601 bp, Human
ttgttaaatcatttgccaataaatgaactatgtgggtcaagtgaaatactatctgaagccattgtagtaatgccccatgggttttattttttaaggagagaactaaaatacatgaaaactaaacccagagaattaaaatacatgacaataataacatacaaatcaagagggctgtaattggagttacagtaagttaaagagggatgcaatatggagaaagtaaagatattgattaattttaaactattacaagacagccagacacaggagtgtatattgtaggaacttgctgcctaaaaaygagcaaaatgaatctctggtgatagaggtgaggacagctgtgagctcaggaatgggtatgtgtgtcaatgactagagagggacattagaggggcttccggggagctatgtgtttgtcacagggctgcgctcccgttgcctaaattcactgagctgtgtactacgagttgttcttttctgggggtatagatgtcacacttaaatggtaaccactaaaaaaattagaatgcagtgaataacttccaaagtagaagaggggggaaagaaataagaggaaaaaacaaaacaaaacaaaaaacct

SEQ ID NO: 141081 - DNA, 601 bp, Human
ccttttcaggaaagcctacagccaccaagcacctaaaactgcaacctggcgcatgcagagtacttgatgaatgtttgttaaatcatttgccaataaatgaactatgtgggtcaagtgaaatactatctgaagccattgtagtaatgccccatgggttttattttttaaggagagaactaaaatacatgaaaactaaacccagagaattaaaatacatgacaataataacatacaaatcaagagggctgtaattggagttacagtaagttaaagagggatgcaatatggagaaagtaaagayattgattaattttaaactattacaagacagccagacacaggagtgtatattgtaggaacttgctgcctaaaaacgagcaaaatgaatctctggtgatagaggtgaggacagctgtgagctcaggaatgggtatgtgtgtcaatgactagagagggacattagaggggcttccggggagctatgtgtttgtcacagggctgcgctcccgttgcctaaattcactgagctgtgtactacgagttgttcttttctgggggtatagatgtcacacttaaatggtaaccactaaaaaaattagaa

SEQ ID NO: 141082 - DNA, 601 bp, Human
ctccatgtgatctgttccccatctatatccctgacccctcatctcctcctttttttttttttttttttttttttttccgagtctcgctctgtcgcccaggctggagtgcagtggcgtgatctcggctcactgcaagctccacctcccgggttcacgccattcttctgcctcagcctccggagtagctgggactacaggcgcccgccactatgcccggctaattttttgtctttttagtagagacggggtttcactgtgttagccaggatggtctcgatctcctgacctcgtgatccacccrcctcggcctcccaaagtgcttggattacaggcgtgagccaccgcgcacagcctctcctacttcttaccccttcatttactgggctccagccacactggcctccttgctagtctttaaaaatgccatataccttcccaagttctcactggctgcattctgcctggaatgctcttgtccaggtggagatatgccacatggctctctcaccaccttaaaatttttgtttgagctccaccttttcaggaaagcctacagccaccaagcacctaaaactgcaacctggcgcatgcagagtacttg

SEQ ID NO: 141083 - DNA, 601 bp, Human
aatgctccatgtgatctgttccccatctatatccctgacccctcatctcctcctttttttttttttttttttttttttttccgagtctcgctctgtcgcccaggctggagtgcagtggcgtgatctcggctcactgcaagctccacctcccgggttcacgccattcttctgcctcagcctccggagtagctgggactacaggcgcccgccactatgcccggctaattttttgtctttttagtagagacggggtttcactgtgttagccaggatggtctcgatctcctgacctcgtgatccrcccacctcggcctcccaaagtgcttggattacaggcgtgagccaccgcgcacagcctctcctacttcttaccccttcatttactgggctccagccacactggcctccttgctagtctttaaaaatgccatataccttcccaagttctcactggctgcattctgcctggaatgctcttgtccaggtggagatatgccacatggctctctcaccaccttaaaatttttgtttgagctccaccttttcaggaaagcctacagccaccaagcacctaaaactgcaacctggcgcatgcagagta

SEQ ID NO: 141084 - DNA, 560 bp, Human
gaatctgctttaatagaatgctttaacaacggctctgctcaactcctcaatggattcccattacattcagagtaaaagccaaagtcttataatggcctgtaatgctccatgtgatctgttccccatctatatccctgacccctcatctcctcctttttttttttttttttttttttttttccgagtctcgctctgtcgcccaggctggagtgcagtggcgtgatctcggctcactgcaagctccacctcccgggttcackccattcttctgcctcagcctccggagtagctgggactacaggcgcccgccactatgcccggctaattttttgtctttttagtagagacggggtttcactgtgttagccaggatggtctcgatctcctgacctcgtgatccacccacctcggcctcccaaagtgcttggattacaggcgtgagccaccgcgcacagcctctcctacttcttaccccttcatttactgggctccagccacactggcctccttgctagtctttaaaaatgccatataccttcccaagttctcactggctgcat

SEQ ID NO: 141085 - DNA, 601 bp, Human
gtggcacatgcctgtagtcccagctcctcaggaggctgtggcaggagaatcacttgagcccgggaggttgaggctgcagtgagccaggactgcaccactgcactcagcctgggcgacagagtgaaaccctgtctctaagaacaatgacaacaacaacaacaacaaaaagttccaagaaattcagctcagtcaaaatcacaacacacacgcagaaacaagacatcatgaacaagaggtcacagaaacaacaaaaggcagaatgagacaaagaaagactctgcatactgaaatgatcaaataragatatataacagaagtatctctagtatgtttaaagaaataaaagaagaacatgtatacataaggaaaaagcaagagaatttaaaaatggctgagtaaaattcgaactgctaatgtgaacttatagaatgaaaaatataatttaataattcaatggaaaggttttaatcttagaatttatagctactaaagagaaagcaacaattgaagaacatatttcaaggcaatcagaatgctgcacagagaaaaagagattacgagctgtgaaggctagaatcagaaggtctaacaaattatctaa

SEQ ID NO: 141086 - DNA, 601 bp, Human
gagaccctggctctacaaaaaaaaaataaaaaataaattagctaggcatggtggcacatgcctgtagtcccagctcctcaggaggctgtggcaggagaatcacttgagcccgggaggttgaggctgcagtgagccaggactgcaccactgcactcagcctgggcgacagagtgaaaccctgtctctaagaacaatgacaacaacaacaacaacaaaaagttccaagaaattcagctcagtcaaaatcacaacacacacgcagaaacaagacatcatgaacaagaggtcacagaaacaacaraaggcagaatgagacaaagaaagactctgcatactgaaatgatcaaataaagatatataacagaagtatctctagtatgtttaaagaaataaaagaagaacatgtatacataaggaaaaagcaagagaatttaaaaatggctgagtaaaattcgaactgctaatgtgaacttatagaatgaaaaatataatttaataattcaatggaaaggttttaatcttagaatttatagctactaaagagaaagcaacaattgaagaacatatttcaaggcaatcagaatgctgcacagagaaaaag

SEQ ID NO: 141087 - DNA, 601 bp, Human
ggatgagataacagccaagaatgttctaaaatccacaaaagaaataatgccatagatttaggaagttcaaacaccctcaaacaagatgtatataaagaaaactatgcataggcataccataggaaaattcctaaaaatcaaagatgaaaaggaaatcttaaaagcactagagaaaaaaagacctataccatcaaaggaaaaccagtgacaggtgatttttcaaaagaaatgatggaggtcatacatacaaatatggaatggtattttgaaaatgctgatttttaagactgcataaactgayagaaataaaaaaatagccctaggagtagcttagacataacatctatctaagctgttcctagatcctttaccctcagaaactgtgatataataaatatttgttatgttgagctactaggtttaggggtactttgttacatggcaataggtagggagaaaataaatctcctttgaaaattcatatgcacagtcagccctctgatatattttgtagctaaaattcacactgcttctgtagtacaaaaaaaatccctcaatttaagattttaatttaaggcgtaatgttccctggtacctgcca

SEQ ID NO: 141088 - DNA, 601 bp, Human
tattgacctctagatgagaaaaaacccaacatataggagacaacactatctgataaaaaacgaatagaaaaaaaagccagggccgggcgtagtggctcatacctctaagcccagcactttgggaggccgaagtgggcagatcatgaggtcaggagttcaagaccagcctgaccaacatggtgaatccccatctctactaaaaatatgaaaattagccaggtgtggtggtgcacagctgtaatcccagctactcaggaggctgaggcaggagaatcacttaaacccaggaggtggaggttgyggtgagctgagatcacaccactgcactccagcctgggcaacagagcaagactctgtctcaaaaaaaaaaaaaaaaaaggaaaaaaaagccattgaaacagacccataagacatcatggtattggaataatctgaagaaagcttaaaattatgccaataaacatacaacaaaacaagatgaggaatttcagcagagaactggaaacaatttttaaaatctaatggaagctctagaactgacaaatgcaatcattgaaattgagtctataatatgggtttcactcagacagttgaaaagagg

SEQ ID NO: 141089 - DNA, 601 bp, Human
gacttcagagatcagaatggagaaagaaccctggtaaatacttcaagctctcagttgagacccctaagaaagtgaaccagaagcggaccaaccctcaagaagacagaagcccactttcaaattagcttaatccctgattgcatgaagatgatctctgtctactctaactgcctggtagaagtaaaagtaaatctcttttggaagaaaaaacatatataacccaaattatctctttcttttttgttttattgacctctagatgagaaaaaacccaacatataggagacaacactatctgatmaaaaacgaatagaaaaaaaagccagggccgggcgtagtggctcatacctctaagcccagcactttgggaggccgaagtgggcagatcatgaggtcaggagttcaagaccagcctgaccaacatggtgaatccccatctctactaaaaatatgaaaattagccaggtgtggtggtgcacagctgtaatcccagctactcaggaggctgaggcaggagaatcacttaaacccaggaggtggaggttgcggtgagctgagatcacaccactgcactccagcctgggcaacagagcaagactct

SEQ ID NO: 141090 - DNA, 601 bp, Human
ccacttatatgaaatatctagaataggcaaattcacagagacagaaagtagactaggagctactagaagctgaggagagggtgactggggagctattgcttcatggttacagagtttctgtctggaaggaagaaaaagttttgaaaatagataatggtgatggctgtataacattgtgaatataactaatggcactgaatttacatttaaatatggttaaaatggcaaattttgttttatatatattttaccacaattaattttttttttttttgagacagagtcttgctctgtcacccaygctggagtgcagtggtgtgatctcaggtcactgcaacctctgactcccatattcaagcgattctcctgccccagtctcccgagtagctggaattacaggtgtgcgccaccatgccagcctaatttttgtatttttagtggagatgggatttcaccattttggccaggctggtctcgaactcctgaccttagatgatctgcctgcctcggcctcccaaagtgctgggattacaggtatgagccaccacacctggcctaaaaaattaataatataacaaaaaacattgaatggtgtactttg

SEQ ID NO: 141091 - DNA, 601 bp, Human
aaataagccagatacaaaaggaccaatattttatgatgccacttatatgaaatatctagaataggcaaattcacagagacagaaagtagactaggagctactagaagctgaggagagggtgactggggagctattgcttcatggttacagagtttctgtctggaaggaagaaaaagttttgaaaatagataatggtgatggctgtataacattgtgaatataactaatggcactgaatttacatttaaatatggttaaaatggcaaattttgttttatatatattttaccacaattaattytttttttttttgagacagagtcttgctctgtcacccacgctggagtgcagtggtgtgatctcaggtcactgcaacctctgactcccatattcaagcgattctcctgccccagtctcccgagtagctggaattacaggtgtgcgccaccatgccagcctaatttttgtatttttagtggagatgggatttcaccattttggccaggctggtctcgaactcctgaccttagatgatctgcctgcctcggcctcccaaagtgctgggattacaggtatgagccaccacacctggcctaaaaaa

SEQ ID NO: 141092 - DNA, 601 bp, Human
tgaaataagccagatacaaaaggaccaatattttatgatgccacttatatgaaatatctagaataggcaaattcacagagacagaaagtagactaggagctactagaagctgaggagagggtgactggggagctattgcttcatggttacagagtttctgtctggaaggaagaaaaagttttgaaaatagataatggtgatggctgtataacattgtgaatataactaatggcactgaatttacatttaaatatggttaaaatggcaaattttgttttatatatattttaccacaattaattttttttttttttgagacagagtcttgctctgtcacccacgctggagtgcagtggtgtgatctcaggtcactgcaacctctgactcccatattcaagcgattctcctgccccagtctcccgagtagctggaattacaggtgtgcgccaccatgccagcctaatttttgtatttttagtggagatgggatttcaccattttggccaggctggtctcgaactcctgaccttagatgatctgcctgcctcggcctcccaaagtgctgggattacaggtatgagccaccacacctggcctaaaa

SEQ ID NO: 141093 - DNA, 601 bp, Human
gattttttccacattaggaaagttcactatttcagaaagaaaataattctaaaaataagcctaccagcaactccacttctaggtatgtccctagaggaatgacaagcagagacttatccatattgatatttgtactctgatgttcaatgcagcattattcaaatagccaaaagatggaaacaactgaaatggtcatcaccagatgaacaaaatgaataggtaattaaaatatcatatacgcatgcaatggaatattaagccataaaaagaaatgaaattctgacacgttacaacacaaacsttgaaaacattgtgctaagtgaaataagccagatacaaaaggaccaatattttatgatgccacttatatgaaatatctagaataggcaaattcacagagacagaaagtagactaggagctactagaagctgaggagagggtgactggggagctattgcttcatggttacagagtttctgtctggaaggaagaaaaagttttgaaaatagataatggtgatggctgtataacattgtgaatataactaatggcactgaatttacatttaaatatggttaaaatggcaaattttgttttata

SEQ ID NO: 141094 - DNA, 601 bp, Human
taaagtgatattttatgcaataaagcttatgtaaatatgtgttttaaaacttgatttgattttttccacattaggaaagttcactatttcagaaagaaaataattctaaaaataagcctaccagcaactccacttctaggtatgtccctagaggaatgacaagcagagacttatccatattgatatttgtactctgatgttcaatgcagcattattcaaatagccaaaagatggaaacaactgaaatggtcatcaccagatgaacaaaatgaataggtaattaaaatatcatatacgcatrcaatggaatattaagccataaaaagaaatgaaattctgacacgttacaacacaaaccttgaaaacattgtgctaagtgaaataagccagatacaaaaggaccaatattttatgatgccacttatatgaaatatctagaataggcaaattcacagagacagaaagtagactaggagctactagaagctgaggagagggtgactggggagctattgcttcatggttacagagtttctgtctggaaggaagaaaaagttttgaaaatagataatggtgatggctgtataacattgtgaatata

SEQ ID NO: 141095 - DNA, 601 bp, Human
caaatgatgttcaaatctattattttaaaatatttttagccatttttaggtaactttgggttcaggcattatttgggaggttttgtttccaaagtcactaaataaagtcatattgcttattaaaaaaataaacaaaaggtaaggaatgaagaatggtagaagtttcaagcagttaataaaaccaaatgatgtttttaaaaaaatgttgtaggctgggcgcagttgcccatgcctgtaatgccagcactctgggaggccaaggtgggaggattgcttgaggtcaggagttcgagagcagccygggcaacatagggagactccatcgctacaaaaaaattaaaaattagacaggtgtggtggcgcacacctgtagttctaactgctcaggaggctgaggcaggaggaccgcttgagtccaggggtttgaagctgcagtgagctatgattgcaccactgcactccaccctgggcaacagaacaagacactgtctcaaaaaaaaaaggtgatatttgtgattaatcatttaatctttttgttatggactgaacatttgtgtcctcccaaaactcatatgttgaaattctaattcttaaggtgatg

SEQ ID NO: 141096 - DNA, 601 bp, Human
atatgattcatgatgcccagatggactactatggcacccgcctggcaacctgctcatcagaaaaatccgtcaaaatcttcaaagtgcacaacagagggcagatcctcattgccaacctcagaagtcatgagagtcctatgtggcaagtggcctgggctcaccccacatatggcaatatcctggcattgtgctcctatgattggaaagtcattatctggaaagaggaaaacggcacctgggagaagacccacgacccctcaggatatgactcctccgtgaactctgtatgctaggtcccccrtgactacggcctgatcctggcctgtaggagctcagatggggccatcttcctgctgacttatacaggggaaggccaatgggaagtgaaaaagatcaacaacgcttacaccattggctgcaatgccatcagctaggcccctgctgttgtacctggaagcctcatagaccagctgttcaggcagaaacccaattacatcaagaagtttccatcaggtggctgtgacaacctcttcaaggatggccagtggaaggagagcagaagctggaagcacagtgactgggtttgagatgtggcctgggc

SEQ ID NO: 141097 - DNA, 601 bp, Human
tcaggctggtctcaaactcctgacctcaggtgatccgcccgcctcggcctaagtgctgggattacaggcgtgagccactgcgcctggtcatcatttacccaattttctatgtagatcttgatattctgatcagtgatattagctcattataatacagatattaagctttcatctgtctatcccatttactacaattttctaacttttcattttaatattgatgattttcattgatactagtttgattatcatatagcaaaatcctcatctttaccttagctaattaatgtttcagaaaagmaatgaacaaatataccaaaatgctatacttctaaaccattatttttccataataatttgtgctttaatcatacttttcagagcaatcagaaatgttgcttctcatacttaaccggacacattcaacacgggaagctgctcttttccctgtggaatccactagattcaatggtgaccagcttttccttcaccaagacctctaatgttttcatacattcatccaacaaactcttattaagaaagtactctgtgtcaggtcctatgcttggtactagacttataaacctattccagagagtga

SEQ ID NO: 141098 - DNA, 601 bp, Human
aaaattttttttttttttttgatacggagtttcgctcttgttgcccaggctggagtgcaatggcacaatctcggctcactgcaacctccacctcccaggttccagcgattctcctgcctcagcctcccgagtagctgggattacaggcatgcaccaccacgcctggctaattttttgtatttttagtagaaacgggttttctccatgttggtcaggctggtctcaaactcctgacctcaggtgatccgcccgcctcggcctaagtgctgggattacaggcgtgagccactgcgcctggtcrtcatttacccaattttctatgtagatcttgatattctgatcagtgatattagctcattataatacagatattaagctttcatctgtctatcccatttactacaattttctaacttttcattttaatattgatgattttcattgatactagtttgattatcatatagcaaaatcctcatctttaccttagctaattaatgtttcagaaaagaaatgaacaaatataccaaaatgctatacttctaaaccattatttttccataataatttgtgctttaatcatacttttcagagcaatcag

SEQ ID NO: 141099 - DNA, 601 bp, Human
attttcagcttctctcctagttatctttgtacctttaaaataatatccttatatctttatttattagttccatcaattagcatattaccctatgtcgcctcttttttctcgttttgtttttttgagatggagtctcaaacttcatgtctatagcattatccttttaaatttttattttttaaaagtaacactctgagtgtggggtgactaggtcaaaggatatgagtataagactcttaaaatagtgtatactcacattttcatcaagtatccatacttgcttatgtcatttacccaaaawttttttttttttttttgatacggagtttcgctcttgttgcccaggctggagtgcaatggcacaatctcggctcactgcaacctccacctcccaggttccagcgattctcctgcctcagcctcccgagtagctgggattacaggcatgcaccaccacgcctggctaattttttgtatttttagtagaaacgggttttctccatgttggtcaggctggtctcaaactcctgacctcaggtgatccgcccgcctcggcctaagtgctgggattacaggcgtgagccactgcgcctggtcatca

SEQ ID NO: 141100 - DNA, 601 bp, Human
tgatgccagccagagaagctgtctgcagtgcacctggtccagctgcagccttgcagagggctggcgcctgtgcgggcaacctggagctgctcaccctgcagcagcagcagccagcgtgtctgaccgtgcacagtggctcaaccccacgcttgctcacacaccccttgccgctttatgcctgacttgcccttggcaggtatgggatccaggcaggaagcatgaaccgagtgcagcctgccaggccgagtgggcagaacgaacccagtgggcccgagcaaaactcgggcaaaggcgccacagrccacagaggtttccagccagaaaagtgacacccggctcacgcctatattcccagcactttgggaggccgaggcaggcagatcacttgaggtcaggagttcaagaccagcctggccaacatggtgaaaccccatctctactaaaaatacaaaattagccaggcatggtggcacatgcctgtagtctcagctacttgggaggctgagacatgaaaatcgcttgaacctgagaggcggaggttgcagtgagctgagattgcaccactgcactccagcctgggtgacagagtgagattctatct

SEQ ID NO: 141101 - DNA, 601 bp, Human
aggatggggctgagcccacgtgctgtcgcacgctggctgggtgtgcaaacgttcagggtagcactgacatgccagccccctgccacctcagccccctctggactttgggcaccgatgagcacaggagggaggccgagggggtgctgagggcagctcagcactggcctgtaggcgtcccttggcacaaacagcccgggcgccatgaatggtggcagaaggtagacaggctcctgggtggaagggggcgagtccctggtgaagccccaccttcaagctggggagggcccgaagcctggggttygggccactagtctcatggaccagaggggtaacttgtggtgcttttccctgggcctgccaatggccgccatggtccaagcagcacctcctccccactgaagcccataacaactgctggctcagcaagaccagaagatggagagacaaggggagacaatcagctgcagagagaaactatcctctctgctgagaggatggagggaggatgggacaatctacccacagagaggcactaccctctctgctgagagctgaacactcgctgggacaccctggctatggagacaagctatccactgtg

SEQ ID NO: 141102 - DNA, 601 bp, Human
ctcagcctcccaaagtgctcggattacaggcgtgagccagcgcgcctggccacaaatcctctttttttaaactacttttattcttgtaacttttttgaaagtctgaaactatttttcaaaataaatccttattaaatgttaaatattatatctggacatatacacatgcacacacatatatgtgcatgtatgtatacaattatggagtaagaagatctgggagaaagtcccacgtcttagaaatgtctgtagccatccggcttttcaagtagagtgtactgtgagttctcaagatccttcyatttctttctttccttcttttttttttggtttccctttctaaaagtcacaatgctggcagcatcgcctctttgtagcccggagcagctgctgccatcacgctggctgtggcggaaggaggtcgtgggccgtggcggtgggagcagctgctgccatcacgctggctgtggcggaaggaggtcgtgggccgtggcggtgggagcagctgctgccatcacgctggctgtggcggaaggaggtcgtgggccgtggcggtgggagcagctgcagggccagtagtggcggcggagaggacccctgt

SEQ ID NO: 141103 - DNA, 601 bp, Human
agcctatcataggaaaaatattaatcttattgctaaagttctgtatcaatgttaaatttactgtggttacaagagagaatacttctccatattgttatgaaacatataacgaagtatttaaaggtaaaggccgtgatgtatgcaatcctccaatgatttagaaaacacacacacagacagagagagagaagaaacaagtctatgcacgagtgatgaagcatgtagagtaaaatgttgacacagataagtccgggtggagaatatacaaatcctcttttttttttttttgagacgaagtctyggtcttgttgcccaggctggagtgcaatggcacgatctcagctcaccgcaacctctgcctcccgggttcaagtgattctcctgcttcagcctcccgagtagctgggactacaagcatgcaccaccacacctggctaattttgtatttttagtagagatggggtttctccatgttggtcaggctggtctcgaactcctgatctcaggtgatccgcctgcctcagcctcccaaagtgctcggattacaggcgtgagccagcgcgcctggccacaaatcctctttttttaaactacttttatt

SEQ ID NO: 141104 - DNA, 601 bp, Human
gtacgtgacagactctgaagggagacagcctatcataggaaaaatattaatcttattgctaaagttctgtatcaatgttaaatttactgtggttacaagagagaatacttctccatattgttatgaaacatataacgaagtatttaaaggtaaaggccgtgatgtatgcaatcctccaatgatttagaaaacacacacacagacagagagagagaagaaacaagtctatgcacgagtgatgaagcatgtagagtaaaatgttgacacagataagtccgggtggagaatatacaaatcctcttttttttttttttgagacgaagtcttggtcttgttgcccaggctggagtgcaatggcacgatctcagctcaccgcaacctctgcctcccgggttcaagtgattctcctgcttcagcctcccgagtagctgggactacaagcatgcaccaccacacctggctaattttgtatttttagtagagatggggtttctccatgttggtcaggctggtctcgaactcctgatctcaggtgatccgcctgcctcagcctcccaaagtgctcggattacaggcgtgagccagcgcgcctggccacaaa

SEQ ID NO: 141105 - DNA, 601 bp, Human
ggtaacggttcttttttttttttcttgtgagttaatacatgtaggagttagggattataaaaggggaaaacctgaagacacagatggtcaaaacaaattgactttggctatgtcactcctctgactattaagtaaaacctctcttctttttcgcttttcctagaatacattgcccttaactcctatttatgattgatttctagcttttcccccagtgtccccatttaacgtataaaccacagaccataaaaattaggacatgactttgagatggaggtaagtatataatttagggcagagrtctatcaaaatgcctgtgattttggggaactcctaaaaaaggtaaatacgacaaagagccttggcagccataacaatgaggtggcatgttatttccacaaaggcacttgacactgtttaaaccactgataaaggaaccaagatgacccaaatgatccaagaatgcctactactcccacccatgtctcatctgctcatcctgtcaacaggcatgagtatcttctcacctctctctccccattttcccagaaacatcatttaccccattaggcttgcagaaaacaaattcgcagaaaaataa

SEQ ID NO: 141106 - DNA, 601 bp, Human
accatgttggccaggctggtcttgaactcctgacctcaggtgatcctcccgcctcggcctcccaaagtactgggattacaggcgtgagccaccatgcccagcccagttaggaatttcataaacacttcccatggttaccttgctgatgtgcagcatcaaggaaaaaaatctcatttacaatttcatcaagccagctactcatatgggtgttttcccacctgaacactaagaaattcaactcacggtaaaaacttattttctatataactgtgttctacataaacttaattcagttatatgmtgatttgctatcttcaactgtatatatttatttaaaaataaaaagtcatttctgctcacacaattttccttcacggtaaacagaatgtgcttttggtaataagctagcttggttttagcaatgttgttgttttgaacatttggagctattttctgttgcataaaaatagatttgtcatggctctgaaacaaacaaaccaaagttttccttaagtagctgtagcaatgaacaagtagaaggtgctccctttacaagagtgactgaagtctgattaatctaaagaaagatccttatcagaca

SEQ ID NO: 141107 - DNA, 601 bp, Human
ctaccagtcattgcctgtctacacactccagatgagatacagcgttttacatgcactagctcattgaatactcacagctaccctgtgaggcaggtactactgtccctgtgttgtggagactcacagaagtccacttgagtaatgacagagccaggatttgtagttagatttggctccaaaccccaggattttccatgactataatactggttaggattttttttttttttttttttttttttttttttttttgagagagtctcactctgtcacccaggctggtaggctggagtgcagtggygtaatcttggctcactgtaacctcctcctcccaggttcaagtgattctcctgcctcaacctcctgagcaggcatgtgtcaccatgcctggctaatttttgtatttttagtagagacggggtttcaccatgttggccaggctggtcttgaactcctgacctcaggtgatcctcccgcctcggcctcccaaagtactgggattacaggcgtgagccaccatgcccagcccagttaggaatttcataaacacttcccatggttaccttgctgatgtgcagcatcaaggaaaaaaatctcattt

SEQ ID NO: 141108 - DNA, 601 bp, Human
aggattgtgtattcttgcaacccaggatacttattctgatgcaataacaacaataataataacagctaccagtcattgcctgtctacacactccagatgagatacagcgttttacatgcactagctcattgaatactcacagctaccctgtgaggcaggtactactgtccctgtgttgtggagactcacagaagtccacttgagtaatgacagagccaggatttgtagttagatttggctccaaaccccaggattttccatgactataatactggttaggattttttttttttttttttttttttttttttttttttgagagagtctcactctgtcacccaggctggtaggctggagtgcagtggcgtaatcttggctcactgtaacctcctcctcccaggttcaagtgattctcctgcctcaacctcctgagcaggcatgtgtcaccatgcctggctaatttttgtatttttagtagagacggggtttcaccatgttggccaggctggtcttgaactcctgacctcaggtgatcctcccgcctcggcctcccaaagtactgggattacaggcgtgagccaccatgcccagcccagttagg

SEQ ID NO: 141109 - DNA, 601 bp, Human
acatcagtgggtttgaccaaacccctaaataaacctaaatcattcaaattccactcagtattgcttcccagtctccttcagtcctctccatctactccctaactcctgatgaaaactatgaatgatagtagtcttaaaaaggtttcaaacatacctattcggaagtccaacctgctcagagacctataaaagattcttaaaatgaatgaaaacgaaggctcagatgctgcctccttataaaccctctctgaacacccctgagtaaaacaactaagaagtaaaagtagtaaccagaggccarttacattcaactaagattagacatgctattattatatcaccttaatatttaatacttcctagttacttcaccctcctctgaacttgtgtgtggcatatcttccatgcctgtatcacttttcagttgctcatctttgtcttcctcaccagactgtcagctccttaaggataagatatgttccattctcagccccaatgcccagaacatagtaaatgcctggtaagtatttattatattcaatacaaaggattgtgtattcttgcaacccaggatacttattctgatgcaataacaacaata

SEQ ID NO: 141110 - DNA, 601 bp, Human
ctagtaataaagattaattagattggtcagtgaactcaatttataacttgtacagaattatgttgaagcaggttgggctacctcctgtatgagtgagaagaagtggggcaaaaaatataggcatgatcagcccaacacgcagcacttcaagctaaagagagcctggaaattcatggttcatttacctgggatctgatgcatttgcttaccattttggcccctgaattcagaatgggcactgcaaggcagtgcagaaagcacacttttgcaagtagaaaaaaggcgaggcattacctttgarggcctacctgtttcacctggataaatgtcaagggataaaggcttttgatgggcccagagggacacagaatgtccagagctgctcccactgtctttaactgaaaagaaacaaaagcagcattcacacactgcacccctcactggtcatcaggttacagagtcattccctaattatcaaagacatcagtgggtttgaccaaacccctaaataaacctaaatcattcaaattccactcagtattgcttcccagtctccttcagtcctctccatctactccctaactcctgatgaaaactatga

SEQ ID NO: 141111 - DNA, 601 bp, Human
acactgaaaaaaaaaaaaaaagatgtgctctgttctcttcaaaagcaggaaaaagaatctcaaagaacctagtctaccaaaaaacacagtccttatgccattgaactaagaacaaataattaaactgtctgttttgagtattaaaacagtgatcttccactgatgcctagtaataaagattaattagattggtcagtgaactcaatttataacttgtacagaattatgttgaagcaggttgggctacctcctgtatgagtgagaagaagtggggcaaaaaatataggcatgatcagcccamcacgcagcacttcaagctaaagagagcctggaaattcatggttcatttacctgggatctgatgcatttgcttaccattttggcccctgaattcagaatgggcactgcaaggcagtgcagaaagcacacttttgcaagtagaaaaaaggcgaggcattacctttgagggcctacctgtttcacctggataaatgtcaagggataaaggcttttgatgggcccagagggacacagaatgtccagagctgctcccactgtctttaactgaaaagaaacaaaagcagcattcacacactgcacc

SEQ ID NO: 141112 - DNA, 601 bp, Human
acaccccgaccttttcaaaaatgtccatgtcatgagagagagacttaggaacagtttcagacggaagaagactaaggagaatataattaatgtgtgattatggattggaaactggattgagaaaagattaagctgtaaaggacgttattgcaatgaccagggacacttgactatagaatttatattagataataggattgcatcaatattaaatttctcatgtgtgatcattgtattgtggttctgcaggataatgttctttttcttaaaagatgtatgctgtggagtgacatggtgctgrtaactcaaatggttagaaaaagaaaagcagttgactacatacacagagagaaaaaggcaattaaaacactgttaacaattggtgaatctaggtaaaaagcatatgggtgtttattgtactattcttgcaactttttttggatttaaaattttccaaaacaaaatgctgggaaaaactttaaaaaaataaagatgaggcagtgtctggagatcaaacacatacacatatacaaacactgaaaaaaaaaaaaaaagatgtgctctgttctcttcaaaagcaggaaaaagaatctcaaagaac

SEQ ID NO: 141113 - DNA, 601 bp, Human
gttaccctagacatgtatgaaagcgatgtttctcaaaccataaggaatgaaaatcttcctccacctcccgaaaaaattaaatttgaaaaaggaaactggtttaatttttaggtcatcgaatatctatcataatagtaaactgcaaggaaccatgaacagtgtcttatcaagcatccctttcccataagaggaacctggaccctgaatgggttaagttacttgcccagggtcatacaggggattatatcatacatagcaaaagttatggatgttagctccaaaaacaaaactaagtaaaacyaacaaaaaaacaaggcaaacaaacagcaaagccaagagatgaagttctgctcagcaaaactgtctccaagttcatgggctaaatctgctttaacatacaaaacaaaaggcaatgagctgggtgcagtggcatgcacctgtagtctcagttacttggggaggatctcttgagcccaggagtttgaggctagtccgggcaacatagcaagacctcatctctaataataataataataacaacaaagtccatcagaactgttttaagtggaggaacgggggaaagaaacagttaagagactag

SEQ ID NO: 141114 - DNA, 601 bp, Human
cacgaaaatcatacaacagaatgaggaaaaacaacaggtattttatcaacaacatattcctaactttttaaaaggttagactttaaaaattgaccttacaatgatcataattcactaagacaacacccaagttagaagcgaagaaacagtcaccatcaatagagcagaatgtcttagtaatctgctcccactgaaatgaaagctgttgattacaagagaatgggaaatattttaaaatcttctgaacaaattttcttggtgaagaaaatcttttcctgtgttccttcctgtgaccatttcrgtgagaggactggaagtcctgaaatgcatctgcttttgttatgaaacacggttctttgtgcatttcagtaatagttgtcacgagcagtccttcagaatataatttctcatgtaggataaaggcacgaagttcaacaaactttgtacagtggcaggtacaaaattgaattggaaatggaccccacccttaaggagcaaagaaagcacaggcaacatcagtcacagaagggcggccttggctggggagaccccgaaggcttctgagagggtggcgcatcaagcacagccctctgggttaaga

SEQ ID NO: 141115 - DNA, 601 bp, Human
atcactgcttcctaaacaggaaaactgccagacacagctcagagcatggaacggtctaagctggtttcctttgccctggaatgttttactgccaactacttttagtggaaaattccaggggaggattcttactagagtagctgcttcgtgttctgacagcacaaaagtcactcacaaaaaattgcttctgaacaacatggagagataagacaaaatcagacaaaagagataaaatcagagaagttaggtggagtattctcacctcaaaatacttgacatgatgcattaaccacgaaaatcrtacaacagaatgaggaaaaacaacaggtattttatcaacaacatattcctaactttttaaaaggttagactttaaaaattgaccttacaatgatcataattcactaagacaacacccaagttagaagcgaagaaacagtcaccatcaatagagcagaatgtcttagtaatctgctcccactgaaatgaaagctgttgattacaagagaatgggaaatattttaaaatcttctgaacaaattttcttggtgaagaaaatcttttcctgtgttccttcctgtgaccatttcggtgagaggac

SEQ ID NO: 141116 - DNA, 601 bp, Human
ctaccttaaaatcgttgatatatgcaccatagttcacacgtcccatgttctctaccagaaggtccagagtggctccagctttccctgttatgttcagagtgatcacattgtttcgctcaaggactccctgggggatctgtggggttcaagaccaaatgacaattgaattgagggtaagaaggtcagcaaggagaggcagcatgctcagttaatttagcactcattttcttgccttgaagtgtcaccagacttggaaagaaatgctttgatagcatcttagcccaagttaccggccaggtcrgaaagatcccccaatcactgcttcctaaacaggaaaactgccagacacagctcagagcatggaacggtctaagctggtttcctttgccctggaatgttttactgccaactacttttagtggaaaattccaggggaggattcttactagagtagctgcttcgtgttctgacagcacaaaagtcactcacaaaaaattgcttctgaacaacatggagagataagacaaaatcagacaaaagagataaaatcagagaagttaggtggagtattctcacctcaaaatacttgacatgatgcatt

SEQ ID NO: 141117 - DNA, 601 bp, Human; identical to SEQ ID NO: 25925

SEQ ID NO: 141118 - DNA, 601 bp, Human; identical to SEQ ID NO: 25926

SEQ ID NO: 141119 - DNA, 601 bp, Human; identical to SEQ ID NO: 25927

SEQ ID NO: 141120 - DNA, 601 bp, Human; identical to SEQ ID NO: 25928

SEQ ID NO: 141121 - DNA, 601 bp, Human; identical to SEQ ID NO: 25929

SEQ ID NO: 141122 - DNA, 601 bp, Human; identical to SEQ ID NO: 25930

SEQ ID NO: 141123 - DNA, 601 bp, Human; identical to SEQ ID NO: 25931

SEQ ID NO: 141124 - DNA, 601 bp, Human; identical to SEQ ID NO: 25932

SEQ ID NO: 141125 - DNA, 601 bp, Human; identical to SEQ ID NO: 25933

SEQ ID NO: 141126 - DNA, 601 bp, Human; identical to SEQ ID NO: 20561

SEQ ID NO: 141127 - DNA, 601 bp, Human; identical to SEQ ID NO: 20562

SEQ ID NO: 141128 - DNA, 601 bp, Human; identical to SEQ ID NO: 20563

SEQ ID NO: 141129 - DNA, 601 bp, Human
taaaaatataaaaattagctgggcgtggtcgcatgtgcctgtaatcccagctacttgggaggctgaggcagaagaattgcttgcatccgggaggcggaggttgcagtgagccgagatcacaccaccgcactccagcctaggtggcagggcaagactctgtctcaaaacaaaaacaaaaacaaaacaaaaaatgtatccttggaggtctggcacagtggctcatgcctgtaatccaagcgctttgggaaggtgaggggaggatcccttgagtccaggagttcgagactagcctcagcaacayagcaaaatgcagtctctaaacgtacatatatatatatgtattttttttttttgatacaggatccctcttgtcactcaggctggagtgcagtggcacgatcacagctcgccacagccttgacctcccaggctcgggtgatcctcctacctcagcctcccaagtagctgggatttcaggcgcctgccaccacacctggctaatttttctattttttgtagagatgggtttttgccatgttgcccaggctactctcgaattcctgggctcaagcaatccaactgcctcagcctcccaaagtgc

SEQ ID NO: 141130 - DNA, 601 bp, Human
gcctataatcccaacacttccaggaggcagaggcgggtggatcacctgaggtcaggagttcgagaccagcctgaccaatatggtgaaaacccatctctactaaaaatacaaaaatcaggccaggcgcggtgacttgcacttgtaatcccagcactttgggaggccgaagtgggcagatcacaaggtcaggagttcgagaccagcctggccaacacagtgaaaccccatctctactaaaaatacaaaaaaaaaaattagccaggtgtggtggcacacgcctgtagtcccagccactcgggcrgctgaggtgggagaaccgcttgaacgcaggaggcagaggttgcaatgagctgagaccatgccattgcactccagcctgggtgacagagtgagactccatctcaaaaaaataaaaataaaaacaaaaattagccaggcatggtggcatgcgcctgtaatcccagctacttgggagactgaggcaggagacttgcttgaacccagaggcggaggttgcagtgagccaagatcatgccactgcactgcagcctgggtgacagagtgagactgcgtctcaaaaacaacaaaaacccacacaaaa

SEQ ID NO: 141131 - DNA, 601 bp, Human
cttatgccatctcgtgctttaaaaagcatctctatgccaatgagttatcaatctgtaaccccagccctaaactctaaactggtattatccaatgaacaccagccatctccctaattgaatattttctttgtaagcaggataagcaggttacacttttccacgtccaaaccaaaacccttcctgcccttctccagttggcttaggcatcaagaaatgcttcaaccatctaccttgctgcaacagccaaaaactcgggggcattcttgattcttctccttccctcctttccacgtgcagcagraggtcctgctcatttgataccccaaaatactctgaatggagtcactccccgccctcggatccactgtctccccggtcatttcccatgtgtcccactctgctcaaaaccctacattggccaggcgcagtggctcacacctataatcccagcactttgtgaggacgaggcgggagaattgcttgagcccaggagtttgagaccagcctgggcaacataatgagaccccaccttaatttgaaaaaacaaacaaacaaaaaaaccctacactggcttcctgtcaaacttaggataaaacctctt

SEQ ID NO: 141132 - DNA, 601 bp, Human
gtttcaccgtgttagccaggatggtcttgatctcctgacctcgtgatccgcccgccttggcctcccaaagtgctgggattacaggcgtgagccaccatgcccggccacccccaactttttgaatgaagaaaggaaggaatgtgcacacagtggatcctgacctgcatccctgttgaatctctactctctgtaatgagtccccaagcttagccccatggccctggcctccaaagggggaagaaggagccccagcctaggctcaaatttgtgcccataataataatattgacatttgttgagyatattttatgtgcttgacattatgccatgcacttcaaagcattgttagatcatttattcctttcaaaagcctatgtgtcgggctgggcatggtggctcatgcctgtaatcccagcactttgggaggcgggcgcccaaggtgggcagatcacctgaggtcaggagttcgagaccagcctggccaacatggtgaaactccatctctactaaaaatacaaaaattagccaggtgtggtggcgcatgcctgtaatcccagctactcgggaggctggggcaggagaatcgcttgaacccgggagg

SEQ ID NO: 141133 - DNA, 601 bp, Human
aggccatgatgcccacaggtcccacacctgccacacaccccgggtccggagtctgccctggactccttggcaccttcacttccatttgtgcctcatgtaacctctctggttctccagaagcccaggagcacatttctctcccagcaccaaccctgctatgggctcacaggctacaatgctttaaaacttattcctggctgggcacggtggctcacacctataatcccagtgttctggaaggctgaggagagaggattgcttgagcccaggagttcaaggccagcctggacaatatagcgaraccctcatctctacaaaaaaaaaaaaattgttttaattagctgggtgtggtggcacatgcctatagtcccagatactcaggaggctgaggcaggaggattacttgaggccaggagatcgaggctgcagtgagctgtgatcacatcactgcactccagtctgggcaacagagtgagaccctgtctcttaaaaaaaattttttttaaaaaaaccttattcctacatttgttagctctcttcgtccttacagtagcccagttaggtggatgtttctgttatccccatttccagatgaggaaac

SEQ ID NO: 141134 - DNA, 601 bp, Human
ggccaaagccacccggggttaatgaaggcttctggatggaacttcggaacaggtcttgtgttttgatctgagactgaggacaccctcaaatgcaagatgtttaaagggtttgagactgaggagctgtcagtgttctgagaggccccctgggtcaggtactctcgggcactccctgagggcagagccctagggagatagagaggaacccatcacagacataggcagcagggagcagggagccatgcatcaaacacactggaacacatggaggcgagtctgacttttttttttttttttttttgatacaaggtctcactccagttgcccagactggagtagtgcagtggcgtgatctcagctcactccagcctcaacctcctgggctcaggtgattttgccacctcagcctcccaagtagctgggactacaggtgctcaccaccacaaccagctaattcttgtatttttagtagagactgggttttgccatgttgcccaggctggtctcaaactcctttactcaagtgatcagccccccacggcctcccagagtgctgggattacaggcgtgagccgccatgcccagcctggtccgattatta

SEQ ID NO: 141135 - DNA, 601 bp, Human
caaagccacccggggttaatgaaggcttctggatggaacttcggaacaggtcttgtgttttgatctgagactgaggacaccctcaaatgcaagatgtttaaagggtttgagactgaggagctgtcagtgttctgagaggccccctgggtcaggtactctcgggcactccctgagggcagagccctagggagatagagaggaacccatcacagacataggcagcagggagcagggagccatgcatcaaacacactggaacacatggaggcgagtctgacttttttttttttttttttttgayacaaggtctcactccagttgcccagactggagtagtgcagtggcgtgatctcagctcactccagcctcaacctcctgggctcaggtgattttgccacctcagcctcccaagtagctgggactacaggtgctcaccaccacaaccagctaattcttgtatttttagtagagactgggttttgccatgttgcccaggctggtctcaaactcctttactcaagtgatcagccccccacggcctcccagagtgctgggattacaggcgtgagccgccatgcccagcctggtccgattattaaca

SEQ ID NO: 141136 - DNA, 601 bp, Human
tgcattttgaaatgagaccttgggcttgggaatcaatgactgtgggtttcacaggctctccccaggcagtcacaaatggcctggtttgtctgacagacaggaggtggcatagctctgggacacaggccctctgacagctctgccgcttctctcccacctgcaggaggcctactgcgcgtatgccatcatcctcatggcgctcttctggtgcactgaggccctgcccctggccgtcactgccctcttccccttaatcctgttccctatgatgggcatcgtggatgcctctgaggtgagccccatccataggagaaagcgttctgggcagtgcgggaggccagggggtgggttccctcagcccttgttgacaaaggaagcctcaccataggcagggcacatggattaggggttcctgactctgcatgaggaagaagtcagctagaaggctgcgggctggggtggggaggggtgcagaattagtgctgcgagttcattcaaggtgagagtgattagccagccgtaggtgggaggtggaaggcctagtgacacagaaaaggggccttgagggccagctaacacactcatatacttctagttcagt

SEQ ID NO: 141137 - DNA, 601 bp, Human
ggcccagggatcatactttgagaaccactgtctagtttttagaaaccgcactaaagtatctatctcccagtccatggcttgaaacatgaatggaatcacggtagattatctcccaactaattattcctgaggggagataaagtgagtttgacaagaagaggggaacctggttgatattaaatgatagataatccaggccgggtgtggtggctcatgcctgtaatcctagcactttagggggccaaggcgggtggatcacttgagctcaggagttcgagaccagcctggccagcgaggtgamacctcatctctacaaaaaatacaaaaattagccaggcatggtggtgcgtgcctgtagtcccagctacttgggaggctgaggtgggaggatggtttgagccaaggaggtggaggttgcagtgagctgtgattgtgccactgcattccagcctgggcaacagagccagaccctgtctccaaaaagttaaatttattttttttaaatggcagatcattcagagaccatttccatccagtttcgagagcccaggggaatgccagtctgtgggaatgtcagtgactgcatcccataacctcgggg

SEQ ID NO: 141138 - DNA, 601 bp, Human
ggagggccttgcagccctggccccgttccccagagctggccctgtacctgcccccacctgggctctcccttgttcccagataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgtgagtgacaaggggtgggccaccttgggggatctgcacaytcactgggaggtgaatggggctgggcagttctcggggcaatgtcacacggcagcccatgttcctccttcaggctcttcccccaaaacggcaacgtggtgaacttcgcctcctggttcagcttcgccttccccaccatggtcatcttgctgctgctggcctggttgtggctgcagatcctcttcctgggcttcaagtaagtggcaaagttggtgagagaagcccaggtccctgcccttagccctgggagcttccagttgggtgcagatgtggaaaatgatattatcaccatcccaatgaga

SEQ ID NO: 141139 - DNA, 601 bp, Human
tactgggtagagagtattatcccatttcacagatgcgcaaattgaggcttcaggagtggttcgcaactagatttgtcagtgctggggctgcaaaccaggtcacttgatgccccttcccataatggtccaccgtcctttgataggtgcttaaggggcacacactgagcatggttagttacagaagcacctgctgtgttcctactgtatactgggttgtgtgtaaggcactgagaatactagaaggcactgggcacagtccctgtccttgtagcccatcaggtggatgatgatatggtggggkcacgacagagggaagcccagatgctgcaagagcacagagaacacagtgtctagttcagcccaggtgagtgaagattccagaacaccatggaggagatcatgcctgggctgaatcttgcaggactagaagtcagccaggtagagaatgggtgaagaaattccaggcagcaggagcagattgcacaaagcacagaggcaagacaagacgtgttcgagggaactctagttctgcaggactaaaacacaaacagcaaaaaggagcatcaggtcatgaagctggagaagtaggcaggggaaggtt

SEQ ID NO: 141140 - DNA, 601 bp, Human; identical to SEQ ID NO: 19817

SEQ ID NO: 141141 - DNA, 601 bp, Human; identical to SEQ ID NO: 19818

SEQ ID NO: 141142 - DNA, 601 bp, Human; identical to SEQ ID NO: 19819

SEQ ID NO: 141143 - DNA, 601 bp, Human
ggggggtcctggtggggcgcaaaggcagaggcagccagggcagagctctgccccaggcacttgcaggttggaagtgggacctctaggcccaccagatttggagctcaggagccggcatcaggggccgggggtcccagggcaggctgtcttctggtgtggtccctagccttccatcagaagctgtaggtgggtcattctagccatcatgccagcacagatctgtcttcctctttgagacctgaagggcaggaagagggtctgggacggtgtgggagtggccataggggactagggtgggtcmtggctggactcgccgtctgggagttgctgagaggtgtccggttctctgagtgaggcctggtctccccccttgcacccctggcccattttcttagttccactgccaaggctgcgggccaggtgccaattccctgtcacctgaccgcacagatgcaattggccaaaagaacttgctgccccacgtgcagggccactcccctcaccacctcaggagcacctttccctggtcataggctgggagcatggctgccccaggcacctcgacctgcgcccatgagcatcccagacccagcaggagccg

SEQ ID NO: 141144 - DNA, 601 bp, Human
cagggggaaggccttggggggacgaaggccaagggcctcgtctggccctcgactgactctgcatgccaggtcttagggggcaggcaaggtccccaagaatgtgggacccacattcaaaagtagcccttcagaggccgctagagcatgatgggtgctggcctcctctggctgtgcagctatggacctccccctgcctaggggggttgggtatggcagaggagggggtctgcccatcttggggtctggatgtgactgtgggtctcctggaggagggacgtggggtgggcacactgatggaggycccctcgccctcgcacagtggatatctggtccgtgggctgcatcatggctgagctgctccagggcaaggccctcttcccgggaagcgactgtatccttggcccaggttggggagcagggtcaaacagggcccctcctgtagggtagggaccagcgctggccccttctggcgggtcttgcctcctctgccccccatgctatgctactttgggctggccatcctcacctataggagagcgggctctgggcagcgccccaaagttttgggtctgggggcccaggaggggtctgtggctggccc

SEQ ID NO: 141145 - DNA, 601 bp, Human
gcccctgcagcacccacagtggtcctgcccacctcccgtggcctgagcatgccccaccaagacaggcgtctgcctcggagctggggacagaggcggctcccgggtggtggtggccatctccgggctctgccctcctccgcctggtgccctggacttggtcgcagcccctcccccgcccaggccagatcccctctgccccagacctcgcttcctctgccaggaccctgggtcccagtgacctttgatactgactcccctcagactcaccccgggggtgctgtgcgtgagagagagccccctycccaccgcacccctgcagtgctgtgcgtgagagagagcaccctccctgcctcctgctagggtcttccctgctcaggagcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctcc

SEQ ID NO: 141146 - DNA, 601 bp, Human
agtggtcctgcccacctcccgtggcctgagcatgccccaccaagacaggcgtctgcctcggagctggggacagaggcggctcccgggtggtggtggccatctccgggctctgccctcctccgcctggtgccctggacttggtcgcagcccctcccccgcccaggccagatcccctctgccccagacctcgcttcctctgccaggaccctgggtcccagtgacctttgatactgactcccctcagactcaccccgggggtgctgtgcgtgagagagagccccctccccaccgcacccctgcrgtgctgtgcgtgagagagagcaccctccctgcctcctgctagggtcttccctgctcaggagcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctccagataacagcgtggggg

SEQ ID NO: 141147 - DNA, 601 bp, Human
agctggggacagaggcggctcccgggtggtggtggccatctccgggctctgccctcctccgcctggtgccctggacttggtcgcagcccctcccccgcccaggccagatcccctctgccccagacctcgcttcctctgccaggaccctgggtcccagtgacctttgatactgactcccctcagactcaccccgggggtgctgtgcgtgagagagagccccctccccaccgcacccctgcagtgctgtgcgtgagagagagcaccctccctgcctcctgctagggtcttccctgctcaggarcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctccagataacagcgtggggggtccatgctccgacatggctgggggaggctggtccatgtcctgggctgcggcggggctgcg

SEQ ID NO: 141148 - DNA, 601 bp, Human
tcaggagcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctccagataacagcgtggggggtccatgctccgacatggctgggggaggctggtccatgtcctgggctgcggcggkgctgcgtctgtcctacaggaggagtccaggatgggcgggtcccaggtgcgggtgtggttgatgctgggggacgtgggtgagtcaccaatacacagacagtgaagcagaagttgaagggtcagggtccagcctggggacggggcgcgttgtaacctgggattctgtcgctgtcttgcagagctgcctcctggtgacctcggggttttcgctgtacctggggaacgtgttcccggctgagatggattacttgcgctgtgctgcaggctctgtaagcagcttcctccacgcctctgccagtgc

SEQ ID NO: 141149 - DNA, 601 bp, Human
gcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctccagataacagcgtggggggtccatgctccgacatggctgggggaggctggtccatgtcctgggctgcggcggggctgcrtctgtcctacaggaggagtccaggatgggcgggtcccaggtgcgggtgtggttgatgctgggggacgtgggtgagtcaccaatacacagacagtgaagcagaagttgaagggtcagggtccagcctggggacggggcgcgttgtaacctgggattctgtcgctgtcttgcagagctgcctcctggtgacctcggggttttcgctgtacctggggaacgtgttcccggctgagatggattacttgcgctgtgctgcaggctctgtaagcagcttcctccacgcctctgccagtgcccaagc

SEQ ID NO: 141150 - DNA, 601 bp, Human
ggtttctttgttctgagatgtgcaggtttctgtcacctgtacctcattcaaacctcttcatatgggccgggcacagtggctcatggctgtcatgccagcactttgaggggtggaggtgggtggatcacctgaggtcaggtgtttgagaccagtctgaccaacatggacaaaccccatctctactaaaaatacaaaaattagctgggcgcggtggtgggtgcctgtactcccagctactcaggaggctgaggcaggagaatcgcttgaacctgggaggcggaggttgcagtgagcccagatygtgccactgcactccagcctgggcaacgagagtgaaacttcgtctcaaaacaacaacaacaagaaaaaaacaaaaaactcttcatatgactttagtttcacgtagagttcatcacctttgagaattactgatgaagcaggcctgaaccttgctctgcagacgcctgtgcagggaattgcgtgttgattctgagcctgcggctgcgtcctgccagagctggcagcatctgccctcaggggactgggacctgtgccccacatcctcccaaagcttcatgttgtgtttttagaaacttacaca

SEQ ID NO: 141151 - DNA, 601 bp, Human
ttctgtcacctgtacctcattcaaacctcttcatatgggccgggcacagtggctcatggctgtcatgccagcactttgaggggtggaggtgggtggatcacctgaggtcaggtgtttgagaccagtctgaccaacatggacaaaccccatctctactaaaaatacaaaaattagctgggcgcggtggtgggtgcctgtactcccagctactcaggaggctgaggcaggagaatcgcttgaacctgggaggcggaggttgcagtgagcccagatcgtgccactgcactccagcctgggcaaygagagtgaaacttcgtctcaaaacaacaacaacaagaaaaaaacaaaaaactcttcatatgactttagtttcacgtagagttcatcacctttgagaattactgatgaagcaggcctgaaccttgctctgcagacgcctgtgcagggaattgcgtgttgattctgagcctgcggctgcgtcctgccagagctggcagcatctgccctcaggggactgggacctgtgccccacatcctcccaaagcttcatgttgtgtttttagaaacttacacagtgccaaggccggtggaggcacccact

SEQ ID NO: 141152 - DNA, 601 bp, Human
ggaggttgcagtgagcccagatcgtgccactgcactccagcctgggcaacgagagtgaaacttcgtctcaaaacaacaacaacaagaaaaaaacaaaaaactcttcatatgactttagtttcacgtagagttcatcacctttgagaattactgatgaagcaggcctgaaccttgctctgcagacgcctgtgcagggaattgcgtgttgattctgagcctgcggctgcgtcctgccagagctggcagcatctgccctcaggggactgggacctgtgccccacatcctcccaaagcttcatgytgtgtttttagaaacttacacagtgccaaggccggtggaggcacccactgatcctcagagcaagggaggacagacaaccgctgtcccctggtcctctgtgaaccccggccactgcctccccagcgtcccggcagctagagcaccatgctggctgacccctgggctctggcccgcaagccatggaccccatgcccctctggcccgcaagccgcgcaccccatgcccctctggcccgcaagccgcggaccccatgcccctctggcccgcaagccgcggaccccacgcccctcctgcttcagc

SEQ ID NO: 141153 - DNA, 601 bp, Human
ctgggcaacgagagtgaaacttcgtctcaaaacaacaacaacaagaaaaaaacaaaaaactcttcatatgactttagtttcacgtagagttcatcacctttgagaattactgatgaagcaggcctgaaccttgctctgcagacgcctgtgcagggaattgcgtgttgattctgagcctgcggctgcgtcctgccagagctggcagcatctgccctcaggggactgggacctgtgccccacatcctcccaaagcttcatgttgtgtttttagaaacttacacagtgccaaggccggtggagrcacccactgatcctcagagcaagggaggacagacaaccgctgtcccctggtcctctgtgaaccccggccactgcctccccagcgtcccggcagctagagcaccatgctggctgacccctgggctctggcccgcaagccatggaccccatgcccctctggcccgcaagccgcgcaccccatgcccctctggcccgcaagccgcggaccccatgcccctctggcccgcaagccgcggaccccacgcccctcctgcttcagctggtcccgagctctcccctcctctcgcttccacatgcctgc

SEQ ID NO: 141154 - DNA, 601 bp, Human
cggccactgcctccccagcgtcccggcagctagagcaccatgctggctgacccctgggctctggcccgcaagccatggaccccatgcccctctggcccgcaagccgcgcaccccatgcccctctggcccgcaagccgcggaccccatgcccctctggcccgcaagccgcggaccccacgcccctcctgcttcagctggtcccgagctctcccctcctctcgcttccacatgcctgctgggtctctggcccctgccctttctctagggacactgttggtgactgtccccagcagcgcccccraaatgtcttaaaaacaaagtggatgccccgccccgtgctgtcctgggtctctgctcccttagaacaaagccctttggggcaggtgacccgtcccactctgctgccctctctggaagcttctccgtggcctttatcctcaccatgggagccgcccttgtcccagtggagctgtgagctgtgccccttcagcctcagcggctgccggatatgggcaagtgcccacccccgcccagccttggccccactcggccctgcccccggcctttcttctctaccctgggccctcgtggcacctgagtg

SEQ ID NO: 141155 - DNA, 601 bp, Human
gtccccagcagcgcccccgaaatgtcttaaaaacaaagtggatgccccgccccgtgctgtcctgggtctctgctcccttagaacaaagccctttggggcaggtgacccgtcccactctgctgccctctctggaagcttctccgtggcctttatcctcaccatgggagccgcccttgtcccagtggagctgtgagctgtgccccttcagcctcagcggctgccggatatgggcaagtgcccacccccgcccagccttggccccactcggccctgcccccggcctttcttctctaccctgggycctcgtggcacctgagtgggtgctgagctgagcctggctgtcctggccctagctctgcccctcgctcaggccccgacggggcttcttctgcctcctcacccagcactgctgtgctcagcccctcagggcctgcacccccgactcagggcccggggtcccatggctgcaggagcaaggccctgcacggcaagggccacaggcctgggctggcccgactccatccacctccctgtccctgacgtcccaacctccctccctggccctggactcctagccttggtgtggccctgtggggacaag

SEQ ID NO: 141156 - DNA, 601 bp, Human
acctccctccctggccctggactcctagccttggtgtggccctgtggggacaagaaggctgaggacaagaaggctgtgggactcctttctgcctccctcacatgcagagtcttgctacttcctttgctccttccttcctctttctttctttctttttttctttctttctttctttgacggagtcttgctctgtcacacaggctggagtgcaatggcgccgtctctgctcactgcaacctccacctcctgggttcaagcaattctcctgcctcagcctcctgagtagctgggactacaggcrcccgccaccacgcccagctaattttttttgtatttttagtagagatggggtttcactatgttggccaggctggtctcaaactcctgactctgatccacccgcctcagcctcccaaagtactgggattacaggtgtgagccactgcaccagacctcctctttctttctttctttctttctttctttctttctttctttctttctttttttgagacaaggtctcactctatcaccgagtattcacagctcactgcagcctcgaactcctgggctcaagagatcctcccagctcagcctccgg

SEQ ID NO: 141157 - DNA, 601 bp, Human
acaagaaggctgtgggactcctttctgcctccctcacatgcagagtcttgctacttcctttgctccttccttcctctttctttctttctttttttctttctttctttctttgacggagtcttgctctgtcacacaggctggagtgcaatggcgccgtctctgctcactgcaacctccacctcctgggttcaagcaattctcctgcctcagcctcctgagtagctgggactacaggcacccgccaccacgcccagctaattttttttgtatttttagtagagatggggtttcactatgttgrccaggctggtctcaaactcctgactctgatccacccgcctcagcctcccaaagtactgggattacaggtgtgagccactgcaccagacctcctctttctttctttctttctttctttctttctttctttctttctttctttttttgagacaaggtctcactctatcaccgagtattcacagctcactgcagcctcgaactcctgggctcaagagatcctcccagctcagcctccggagtagttgggactagaggtgtgagccactgcacccggctgatactttttccttttttgggtaat

SEQ ID NO: 141158 - DNA, 601 bp, Human
tttttagtgaatggcctgaagtgtggtttatctgttaccttttttcttttattattcaaagaaggaaaacccctcctgccttgtttttcagattcccaactttcagatattgtttgtttccacgtttgctgtgaccactacgtgtttaatttggtttggatgcaaactagtcctgaacccatcagcaataaacgtgagttcacacgagcttcgcgcagacgcctgacacccacagccccactcccacgaatggtgtcagcaaatgtttgttgagctggaaataggtggtaaatgttattcrcagctcgtgagtttgactaaagttgagagatttatgcatccaaagaaaataattgtctttattgaagtctcgtgattctgcgggacagatttattggtaaacaatgtcttttccaacagtccttaaaaattaacagtgacataatactatgtttcatccaatctgtgtaagacagttgttcaatgcacctctaaacaaaaatgtgaaattgtagggggcagaggttgtgggagccgagatggcgccactgcactccagcctggaagacagagcaagactccgtctcaaaaaaaaaaaaaa

SEQ ID NO: 141159 - DNA, 601 bp, Human
gagtttgactaaagttgagagatttatgcatccaaagaaaataattgtctttattgaagtctcgtgattctgcgggacagatttattggtaaacaatgtcttttccaacagtccttaaaaattaacagtgacataatactatgtttcatccaatctgtgtaagacagttgttcaatgcacctctaaacaaaaatgtgaaattgtagggggcagaggttgtgggagccgagatggcgccactgcactccagcctggaagacagagcaagactccgtctcaaaaaaaaaaaaaaaaaaaaaaagacaaaaatcccaaaggaaaccaggacctcatccgagatactgcaaggagggcctcctgctttgtgtgacatgtggaatgcacttgatgattggggaaagctggaggaggcttgagtatgtcctggccactctcgttgggcaggaaaaatgagcagacacaggaggacccagtgggaacacccacactgcctttttgttttgttttgttttgtttttgagaaggaatctcgctctgtcgcccaggctggagtgtagtggcgccatctcggctcactgcaacctctacctcccgggttcaa

SEQ ID NO: 141160 - DNA, 601 bp, Human
aaaaatgtgaaattgtagggggcagaggttgtgggagccgagatggcgccactgcactccagcctggaagacagagcaagactccgtctcaaaaaaaaaaaaaaaaaaaaaaagacaaaaatcccaaaggaaaccaggacctcatccgagatactgcaaggagggcctcctgctttgtgtgacatgtggaatgcacttgatgattggggaaagctggaggaggcttgagtatgtcctggccactctcgttgggcaggaaaaatgagcagacacaggaggacccagtgggaacacccacacygcctttttgttttgttttgttttgtttttgagaaggaatctcgctctgtcgcccaggctggagtgtagtggcgccatctcggctcactgcaacctctacctcccgggttcaagcaattctcctgcctcagcctctggagtagctgggattacaggcgtgtgccaccacactcggctaatttttgtatttttagtacagacaaggtttcaccatgttggccaggctggccttgtactcctgacctcaggtgatccatccacctcggcctcccatagtgctgggattacaggtatgagccac

SEQ ID NO: 141161 - DNA, 601 bp, Human
gcaattctcctgcctcagcctctggagtagctgggattacaggcgtgtgccaccacactcggctaatttttgtatttttagtacagacaaggtttcaccatgttggccaggctggccttgtactcctgacctcaggtgatccatccacctcggcctcccatagtgctgggattacaggtatgagccaccgcgcccggcctgtgacgcttctttattaagacggagagcagatggggtgtggtccctgggtcagtggcttgtatctgaactgctcagaggcaagttactcactgtagctgtyggctggccctgggaggagctgtctcttcaggatcaggaaggagccagaggtcaaagcaccagaaatacagaaaataaaagacaaggttaatgtcacacttttctgaattttagagttctccttatgcttttgtctttttgatctgtcatttttttttttttttgagacagtctcgctctgtcgcccagactggagtgcagtggctccatctcggctcacggcaacctccgcctctcgggttcaagcaattctcctgtctcagcctcccgagtagctgggattacaggcgtgcgccaccgt

SEQ ID NO: 141162 - DNA, 601 bp, Human
agccgagattgcgccatttgctctccagcctgggcaacaagagcgaacctccgtctcaaaaaaaaaaaaaaaaaattgtcagacagctacactgactttttaaaatgtatgcttctatgaatattaacacacatataaattcatgtcactgccaatacggtcagggcctgcagtcgtttcattaccctccaaaaaaccttatgttctcagtgcttgacaatcatgcatgaagctactctaaacattccgtgaaggcttttgtgggaacaaggagcgttcagaatggggtcggtagaccagrgcccaaggccaaatccagccctggcctgtgtttgtacagcctttgcactaagaatggttttaaaaactaaaagaccccaaaggcccatgtgaggcaggagagtgtgcagcccacagtgcctcacagctggccctggatgggaaaagtggggaccgtggctgagagtcctgcgcagcctgcccgtgaggtggtccggtggacgctgaagcgcggtggcgtgagaaaggcgggcccggtgctgaagcgtgtgtgccccttggcagatcaacttcaacctcatcctgctgctcctgctggagc

SEQ ID NO: 141163 - DNA, 601 bp, Human
atgtgaggcaggagagtgtgcagcccacagtgcctcacagctggccctggatgggaaaagtggggaccgtggctgagagtcctgcgcagcctgcccgtgaggtggtccggtggacgctgaagcgcggtggcgtgagaaaggcgggcccggtgctgaagcgtgtgtgccccttggcagatcaacttcaacctcatcctgctgctcctgctggagctgctcatggcggccacggtgatcatcgctgcacggtccagcgaggaggactgcaagaaaaagaaggtgggtgcagcttctgaccccrcagggcagggggtgcagaggcatcaccccagggtgagcgaggtgggtctcagcgtcaccctcggagggccgatctgggctgctccagggcattcccatgagacccctctctcctgggtctcagaaaccccggccaggaggggctctggagctgggtgaggggttggcggccgctggctacagggaggtgaagacagatgctgtaccctcccctccccctaagcctgactcagtccagtgctcgtccccaggggatcaccaggagacaccacatctgctaattttcatatgcaaggacaat

SEQ ID NO: 141164 - DNA, 601 bp, Human
ggccctggatgggaaaagtggggaccgtggctgagagtcctgcgcagcctgcccgtgaggtggtccggtggacgctgaagcgcggtggcgtgagaaaggcgggcccggtgctgaagcgtgtgtgccccttggcagatcaacttcaacctcatcctgctgctcctgctggagctgctcatggcggccacggtgatcatcgctgcacggtccagcgaggaggactgcaagaaaaagaaggtgggtgcagcttctgaccccgcagggcagggggtgcagaggcatcaccccagggtgagcgagrtgggtctcagcgtcaccctcggagggccgatctgggctgctccagggcattcccatgagacccctctctcctgggtctcagaaaccccggccaggaggggctctggagctgggtgaggggttggcggccgctggctacagggaggtgaagacagatgctgtaccctcccctccccctaagcctgactcagtccagtgctcgtccccaggggatcaccaggagacaccacatctgctaattttcatatgcaaggacaatgtgtgtgaacatttcctcaagcccaaagatccacgggcgcct

SEQ ID NO: 141165 - DNA, 601 bp, Human
tccacccacccaggccttccaaagtgctgggattacaggtgtgagccaccgcacctggcctctttctccttcttactttcaacttttcttgccttgtactttggtataattgttataagcagcacgtaactgtattttgttctttatcttgtcattctctctccctagctttttgaatgtagcccatttcctctgagagttattactgataaatttctacttatttttaccatcttttgagttttccattttccctgattttgcctttttccctccttccctgccttcttttgaattggcrgaggctccgtccttccttttccctctaattttggatgggaaatttttcagtattcttttgggggttgcccttcatattctaatacgctccttgataaacagaccatgcggggtctgtcccccttccctccgccttggccttgttgtctagcttgtgacatttagtgacattttgcctttttactccaacaatgggacagcctcctgtgtgcttgactgtgtctgtgtgtgtttcccagtgccttcacttccccttatttagcatttcagtcctctcttaggttccatttccgttctgctt

SEQ ID NO: 141166 - DNA, 601 bp, Human
gatccttcacgggagcaggttttcgggcgtgtgtttcttccccagccctccctgagtctggcggtgctggttgcggcccctccctgagtctggcggtgctggttgcggcccctccctgagtctggcggtgctggttgcggcccctccctgagtctggcggtgctggttgcggccctgatggtgccgggcagatgagtccacaaccagggcttaggccagcagggttcttggctttgtccaggaaagaattcaagggcgagctggaggtgacagacagcagctttgtttgcagtggcagtakagcagggctctccaaccggcaggtgcctcgagcagcagctcagagacagctctgcctcctatttatacccacttttaagtatatgctaattaaggggcagattatgcagaaatttctagaaaaggggtgctaacgtccaggtggttggatcattgccacggaaaggggtggtgacgtccagtgttgccgtggcaatggcaaacccacatggcacgggtgggtgtgtcctatgggaagctacttctgccccaggcctgttttcccgagtcccttcgatggggtccagggtctgagcaccgc

SEQ ID NO: 141167 - DNA, 601 bp, Human
gaggctgggggtccatccaggtgggctcctccacggttagatctggggccagcccactggaccctgctcctgggggtccatgtctgcacagtgcattctgggaatctgggggtgtctccacttccttatgagccgatgctgtcctgtcccctccaggtcgtcgaggtaatcgcaggcatctctgccgtcctcggggggatcattgccctgaacgtggatgactcagtttcaggcccacacctctcagtgacgttcttttggatcctagtggccgtgagtaacccctctggcccgcccgccrccgctctgggccacactgctcagatcctgcgtggctgggccccgagctcagtcttggtgcattcagacagagagtcaccacagagggtcctcgctggcccccaacttcagaagaactggggagttaaggattaaatgagtcaaagtattaactgcttttatattagtttgtgtgattattttatattatttttcctgaaaaaaataccaattatttttattattctaatctttttaacatatgaatgtcaggctgtagatgtttattattctatataattttctaatatataatgcattt

SEQ ID NO: 141168 - DNA, 601 bp, Human
atctgggggtgtctccacttccttatgagccgatgctgtcctgtcccctccaggtcgtcgaggtaatcgcaggcatctctgccgtcctcggggggatcattgccctgaacgtggatgactcagtttcaggcccacacctctcagtgacgttcttttggatcctagtggccgtgagtaacccctctggcccgcccgccgccgctctgggccacactgctcagatcctgcgtggctgggccccgagctcagtcttggtgcattcagacagagagtcaccacagagggtcctcgctggcccccmacttcagaagaactggggagttaaggattaaatgagtcaaagtattaactgcttttatattagtttgtgtgattattttatattatttttcctgaaaaaaataccaattatttttattattctaatctttttaacatatgaatgtcaggctgtagatgtttattattctatataattttctaatatataatgcatttatattacactatgtgtttcatacaatgcagcatatttctgttattactttacattaaatgttactgcagcagatgtgtcacacagcacctgacacatgccaca

SEQ ID NO: 141169 - DNA, 601 bp, Human
agcatatttctgttattactttacattaaatgttactgcagcagatgtgtcacacagcacctgacacatgccacatgctcaatacatgggcattgttttatttattttatttatttatttttttgagatggagtctcactctgccacccaggctggagtgcagtggctcaatatcacctcactacaacctctgcccctccccgggttcaagtaatttgcccacctcagcctcccaagtagctgggattacaggcgtggaccaccatgcccagctaatttttttgtatttttagtagagacsgggttttgccatgttggccaggctggtcttgaactcctgacctcaagtgatctgcctgcctcggcccccaaaagtgctgggattacaggtgtgttccctcagaacagtgagtctagagcaacccctccacaccccagatcccctcacagcctgtagcccacccagagccaccacccacctgcctccggacgcagaccccacgaggttctcagcaccttgccgcgtagtggcctgcacaccggtgttgacggccagcccctggtttgtctcatgctgtgtggacttttagattttgcccct

SEQ ID NO: 141170 - DNA, 601 bp, Human
tgaaacgcagggattacatcccgaagctgagggaggacagagaccacatacctccaaaaagttgagaatgaaaggcacttgccctacccccttccctgtccctgcagtcagccctcatcacagaggcccctcccatcccgcagacccctcctgcctcgggggtggctctgctctctccatcttcccggagagcaccccctgcccatcaggtgctgccccctgggcgcccctaaatccacccacactcccaaccctctcttcagggcaggagaccccaggaggagaggagagcgctgaggcrtgcgtggtgagggacccagctccacctgcctgagtctggcctgggtgcggcagaggggcccaggccctgcaccatgggctggaggcaggtgctcggggctggagttgggggctgggctgcaggcctggacccttccagggcagggcccttgattgagctgccccagcccctatggctgagcttcctggccctctagggcaggggccggagtggccatgctgggtgaacggggaaactcccgccctcccatggctcactggggccctgaataggccaccctgaagccaccatcccttcctg

SEQ ID NO: 141171 - DNA, 601 bp, Human
ccagctccacctgcctgagtctggcctgggtgcggcagaggggcccaggccctgcaccatgggctggaggcaggtgctcggggctggagttgggggctgggctgcaggcctggacccttccagggcagggcccttgattgagctgccccagcccctatggctgagcttcctggccctctagggcaggggccggagtggccatgctgggtgaacggggaaactcccgccctcccatggctcactggggccctgaataggccaccctgaagccaccatcccttcctgtgccctcactgctgcwtacagctagaaggccctttcagaagcaccaagcccaggagagacccctgtattgacacctcagcctccctggccagggccacacccacctcagcagctggcttggggcctttgcactggcagcccctcagctccccagtcttctccctgctgcccaggctcccctgctcggagcccatctctgtcctgcccaccctctcaccacagcccctggctgatgcagccccctccccagcaggccgggctggggtgctggcacctggacaccttcggggggatgaagaggatgaagagcatgcat

SEQ ID NO: 141172 - DNA, 601 bp, Human
tgcagccccctccccagcaggccgggctggggtgctggcacctggacaccttcggggggatgaagaggatgaagagcatgcatcctccctctgcctacattgtgcggaactaaggcaggctcctcacaataagtgggaaaagggcatttcttggttataaaaaggaagaggtgcccatccaacagaggaacctacagatccccctaacccagtgagtcaagtcagcgtcatcaggaaggggcagtccacaccctggggcactgcagagtctcctccgaggctccccaaggctcatcgtgargaaatcctgtcccacacggaggcccgactgcagctgacgggctgcaccccccagaagcgaccaggtaacggaggtgacagaggctgagggactccccaattaacagggacccacaaggagactacgagctcaatggcagaccgaatccggatcaggagcaaacaaacaaacagctctagaaataacatgaccagggccaggtgcggtggctcatgcctgtaatcccagcactttgggaggccgaggcgggcggatcacctgaggtcaggagttcgagaccagcctggccaacaaggcgaa

SEQ ID NO: 141173 - DNA, 601 bp, Human
cacctggacaccttcggggggatgaagaggatgaagagcatgcatcctccctctgcctacattgtgcggaactaaggcaggctcctcacaataagtgggaaaagggcatttcttggttataaaaaggaagaggtgcccatccaacagaggaacctacagatccccctaacccagtgagtcaagtcagcgtcatcaggaaggggcagtccacaccctggggcactgcagagtctcctccgaggctccccaaggctcatcgtgaagaaatcctgtcccacacggaggcccgactgcagctgaygggctgcaccccccagaagcgaccaggtaacggaggtgacagaggctgagggactccccaattaacagggacccacaaggagactacgagctcaatggcagaccgaatccggatcaggagcaaacaaacaaacagctctagaaataacatgaccagggccaggtgcggtggctcatgcctgtaatcccagcactttgggaggccgaggcgggcggatcacctgaggtcaggagttcgagaccagcctggccaacaaggcgaaaccccgtctctactaaaaatacaaacattagcctggtg

SEQ ID NO: 141174 - DNA, 601 bp, Human
attgtgcggaactaaggcaggctcctcacaataagtgggaaaagggcatttcttggttataaaaaggaagaggtgcccatccaacagaggaacctacagatccccctaacccagtgagtcaagtcagcgtcatcaggaaggggcagtccacaccctggggcactgcagagtctcctccgaggctccccaaggctcatcgtgaagaaatcctgtcccacacggaggcccgactgcagctgacgggctgcaccccccagaagcgaccaggtaacggaggtgacagaggctgagggactccccrattaacagggacccacaaggagactacgagctcaatggcagaccgaatccggatcaggagcaaacaaacaaacagctctagaaataacatgaccagggccaggtgcggtggctcatgcctgtaatcccagcactttgggaggccgaggcgggcggatcacctgaggtcaggagttcgagaccagcctggccaacaaggcgaaaccccgtctctactaaaaatacaaacattagcctggtgtggtggtgggtgcctataatcccagctactcaggaggcttgaacctgggaggtggaggtt

SEQ ID NO: 141175 - DNA, 601 bp, Human
cagggcctcggggcctcaattccgccctgtatctggggccaccacctgcttcacagggacctgggacccactctgtccctgagcccattttagaatctgtcctgggtttatgagacatgcttttcggatttgcatcagaactgcattgagtttaacaggtgaatttaaggagaattcaaagtcctgttactttgagctgacccagtaggagcttatctccaacacgacttctgaggctcaggcacgtgtagctagatgtatttcttagatacctagtgtttttttgtttttttgttttttkttttccagtataagtggttttgcacccaaatcattagaagacctgtattaagctgtttgctccaggtcaacatgcgtgtgctgatggggaatggagtcactgcctgatggggggatggagtcactgtctgatgggggatggagtcactgtctgatgggggatggagtcactgtctgatgggggatggagtcactgtctgatggatggatggagtcactgtctgatggaggatggggtcactgcctgatgggggatggagtcactgtctgatgggggatggagtcactgtctgatggggga

SEQ ID NO: 141176 - DNA, 601 bp, Human
tcttcacttctcttgtgtttgcttcacccactcctactccaattattttgtttcctgtgacatttaatatatctcctacttcatgttgtcttacaatatgcatataattgttcacgattacaagagacaatattaccacccaggggccatctcctgagtgagcctgaggcttcccttttatcttcagcatgcattctgctagcaggggacggccacacgccatcgaagtcggcccctttctgtgtggggttatcctctgggttcgataccccattaagtttaatggcctctggttgtattscattttagggcttggtgctttttttcttttttaaaatggtattttttgaatatataaaatatttatgtggttcaaaagccaaactataaaagacgagctcagaaaagctgtggtctcatgcctgactgacctgctcctcttatgggcaaccagatgataatttttttttctttcttacaaaatagcttgtatactagaatcactattctgtaccttgccatttttttttttttaagatagagtctcactctgtctcccaggctggagtgcagtggcacagtcttggctcactgcaacctc

SEQ ID NO: 141177 - DNA, 601 bp, Human
cctactccaattattttgtttcctgtgacatttaatatatctcctacttcatgttgtcttacaatatgcatataattgttcacgattacaagagacaatattaccacccaggggccatctcctgagtgagcctgaggcttcccttttatcttcagcatgcattctgctagcaggggacggccacacgccatcgaagtcggcccctttctgtgtggggttatcctctgggttcgataccccattaagtttaatggcctctggttgtattgcattttagggcttggtgctttttttcttttttaaaatggtattttttgaatatataaaatatttatgtggttcaaaagccaaactataaaagacgagctcagaaaagctgtggtctcatgcctgactgacctgctcctcttatgggcaaccagatgataatttttttttctttcttacaaaatagcttgtatactagaatcactattctgtaccttgccatttttttttttttaagatagagtctcactctgtctcccaggctggagtgcagtggcacagtcttggctcactgcaacctctgcctcctgggttcaagtgattctcctgcctc

SEQ ID NO: 141178 - DNA, 601 bp, Human
gtggcacatgcctgtaatcccagcagtttgggaggccgaagcaggcagatcacctgaggttaggagaccagcctggctaacatggtgaaaccccgtctctactaaaactacgaaaattagctgggcgtggtggcgggtacctgtaatcccagctactggcgaggttgaggcaggagaatcgcttgaacctgggatgtagaggttgcagcgagccgagatcgcgccactgcacgccagcctgggtgacagagggagactgtcgcaaaaaaaagttttatgttaacttgagaagagctgttckttctgtttcttctcttactttttgtagcagtgacattggatagatgtttggctcttttgtgtgttaacatttagttgctttgtttttcttgagccaacacgggaaagctatccatgggcacagagggttttgggtgctccgtggtcactctctggccccctgcatcctcggccgctccctccatcctcttccctgccgagctcaccgcgctgcctcctgccccttccttcctagcagctggtgctcaggggtgaagctgttgggggtctgtgcaccccatccccccaggacggctgcccc

SEQ ID NO: 141179 - DNA, 601 bp, Human
gtgcaccccatccccccaggacggctgccccctgtctcctccgctcaggatcctgctgacacggaacggtcagcgcttctgcctcccgcggacattctctctggctctgggactgagccttgcgcgtgttggagcaggaggggtggagcgacttgaccactagcagccagcactgtccacggggcctggcagtggctcggtcacttttattcctgtatgttgaacacaagctgatggaatttaaagcagaattgacctcattaattgagctagaatgattatcatcaggttgttgaaatarcaatgcgtttgggttactggggctccgactcgagccctggcacctgctctttgtgaaggccgtgggcacgagggagctttggtctcctgggctggagggcggctgggccactctgctcacacctccttccgcctgcagccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggg

SEQ ID NO: 141180 - DNA, 601 bp, Human
agtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactkcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctt

SEQ ID NO: 141181 - DNA, 601 bp, Human
agtacctgttatgttttttcatggtttacgaggcacagagttgtttcacttttcattttggttcccaagatgcattcaagggcctggttcaacctgtagaatacctgtagggcccattattttatgagtgtttccatcctccaccgaaccatccctaccagtgtctgcattttccctggcccttttactctctgatagtttttgtaaactctaagttattgatcatttggtgtcatttttttctttgttattaaagaaactttgttcatattccaggctgaaagactggaattcttaggctttttttttttaaggctgttttcacacatcttcttgcctattaaaaaaagtaagcttgtgtgttctgccatgtattatcatcttaccaatcaaatgtcttaaagatttttctctgaaattttactgattaaagtatttaaaatcagagacttcctcaattcattgatgaaatgcttttacagctagaatattatataacaagaccaaaaggtattaatacaaaccaaatacttaaagaggcagggacatacaaatcttagaaatataatactaaaaactaattttctgttactaagagcta

SEQ ID NO: 141182 - DNA, 601 bp, Human
tacgacctcactccagcctgggcaacagagggagactccatctcaaaaaaataaaaaagagagagaagaaaatgcatttcctcactctcctgaatacaatgctaatgatgggtgaaaaaccaaaacgatccaattgtgcttactttttttatgccgcagatcagattcattatgactttaaggatacactgttaaagagggaaaggaggcaggaaacactaaccctcatgtcccaacctggaagggaaacaggcactggggaaaaaaaaagcctatacctctgttgatggtggtattagcratgtcatcattgtcaagattgtttctgaaatctaaaggactgtctagagacagaacaatttccacaaatgttagactgtaaaaaatcagtgagcctgacgataatcctcgttaaaactccagagtaaataaggatgagaattttaaagaggaagcatggtatctcttgtcacttcagcaaagtgtatcttatttatctgttttggtcaagacaggaaaacaaaaactaaagcagaccaacagcaatagctggttcctaccaggagcaaagtccctggctgaatggccccttctccagcag

SEQ ID NO: 141183 - DNA, 601 bp, Human
ttgcttgaacctgggaggtggaggttgcagtgagccgagatcgtacgacctcactccagcctgggcaacagagggagactccatctcaaaaaaataaaaaagagagagaagaaaatgcatttcctcactctcctgaatacaatgctaatgatgggtgaaaaaccaaaacgatccaattgtgcttactttttttatgccgcagatcagattcattatgactttaaggatacactgttaaagagggaaaggaggcaggaaacactaaccctcatgtcccaacctggaagggaaacaggcactggggaaaaaaaaagcctatacctctgttgatggtggtattagcgatgtcatcattgtcaagattgtttctgaaatctaaaggactgtctagagacagaacaatttccacaaatgttagactgtaaaaaatcagtgagcctgacgataatcctcgttaaaactccagagtaaataaggatgagaattttaaagaggaagcatggtatctcttgtcacttcagcaaagtgtatcttatttatctgttttggtcaagacaggaaaacaaaaactaaagcagaccaacagcaatagctggttcct

SEQ ID NO: 141184 - DNA, 601 bp, Human
acaaattctaaggacaagctttctccaaccaccacctagtttcactgagaaagaaaatgcagggctgggcacagttgctcacacctgtaatcccagctctttgggaggccaaggcaggtgttatcacttgaggtcaggcgtttgagaccagcctggccaacatggtgaaactccaactctactaagaatacaaaaattagtcagatgtggtggcaggtgcctgtaattccagctactcgggaggctaagccaggagaattgcttgaacctgggaggtggaggttgcagtgagccgagatcrtacgacctcactccagcctgggcaacagagggagactccatctcaaaaaaataaaaaagagagagaagaaaatgcatttcctcactctcctgaatacaatgctaatgatgggtgaaaaaccaaaacgatccaattgtgcttactttttttatgccgcagatcagattcattatgactttaaggatacactgttaaagagggaaaggaggcaggaaacactaaccctcatgtcccaacctggaagggaaacaggcactggggaaaaaaaaagcctatacctctgttgatggtggtattagc

SEQ ID NO: 141185 - DNA, 601 bp, Human
tatgctacaggagggtaatgcctagatttaaatggaacttgccaacaaattctaaggacaagctttctccaaccaccacctagtttcactgagaaagaaaatgcagggctgggcacagttgctcacacctgtaatcccagctctttgggaggccaaggcaggtgttatcacttgaggtcaggcgtttgagaccagcctggccaacatggtgaaactccaactctactaagaatacaaaaattagtcagatgtggtggcaggtgcctgtaattccagctactcgggaggctaagccaggagmattgcttgaacctgggaggtggaggttgcagtgagccgagatcgtacgacctcactccagcctgggcaacagagggagactccatctcaaaaaaataaaaaagagagagaagaaaatgcatttcctcactctcctgaatacaatgctaatgatgggtgaaaaaccaaaacgatccaattgtgcttactttttttatgccgcagatcagattcattatgactttaaggatacactgttaaagagggaaaggaggcaggaaacactaaccctcatgtcccaacctggaagggaaacaggcac

SEQ ID NO: 141186 - DNA, 601 bp, Human
cacatggtatatgctacaggagggtaatgcctagatttaaatggaacttgccaacaaattctaaggacaagctttctccaaccaccacctagtttcactgagaaagaaaatgcagggctgggcacagttgctcacacctgtaatcccagctctttgggaggccaaggcaggtgttatcacttgaggtcaggcgtttgagaccagcctggccaacatggtgaaactccaactctactaagaatacaaaaattagtcagatgtggtggcaggtgcctgtaattccagctactcgggaggctargccaggagaattgcttgaacctgggaggtggaggttgcagtgagccgagatcgtacgacctcactccagcctgggcaacagagggagactccatctcaaaaaaataaaaaagagagagaagaaaatgcatttcctcactctcctgaatacaatgctaatgatgggtgaaaaaccaaaacgatccaattgtgcttactttttttatgccgcagatcagattcattatgactttaaggatacactgttaaagagggaaaggaggcaggaaacactaaccctcatgtcccaacctggaaggga

SEQ ID NO: 141187 - DNA, 601 bp, Human
ggtggactctaaagagcagccctagggttccagctcagctgctaaggcccaaagaccacagcaagctcacaagatgatgcctaatgtacatataatttctacactcaattagaagcagaatatgattgctgttgctatttttgcattcaaagtggaatcacatgtttgaattaaccaacagcaggacagagacttgctacacatggtattgattgttttctctcctatttcctcccacaagaaacaaaaggagaccaggaaattgtgcactaatgaagcacactctatccattcacagagsctgggtaacattaagggtgagaagctgcagataatggagaaagatcagtgtccaaacatttgggagtggaggcgggaagaagcaatgaagccatagcccgcccagtgtggccactccacagctagagttccctggaaaattatccagcagaggggaaataaccataaatgcttaggttacaactgacccagaagagtccttccaagcacaaaaggcctcctcttttctctgcattcatgcctccaattccctggccttcccaccgcagacacagcactcaacagtcacgcccacaccctg

SEQ ID NO: 141188 - DNA, 601 bp, Human
cacagtggctcatgcctgtaatcccagcattttgggaggctgaggcagacagatcacctgaggtcagaagttcaagaccagcctggccaacatagtgaaaccccgactgtactaaaaatacaaaaaattagccagacatggtggcataggcctgtagtcccagctattcaggaggctgaggcaggagaatcactcgaacccgagaggcagaggttacaacgagccgagatcacaccacggtattccagcctgggcgacaaagtgagactgtctcccaaaaaaaaaaaaaaaaaaaaaaaamagtcggcaaggggtgggaggaattgatttaaacaagcccataggaatccttagttccaaagcgcattgccagcacagttcaaaagttcataaggctgggtgcggtggctcacacctgtaatcccaacactttgggaagctgagacgggtggatcacttaaggtcaggagttcaaaaccatcctggccaacatggtaaaaccccatctctacaaaaaatacaaaaattagctgggcatggtggtgcgcgactgtaatcccagcttctcaggaggctgaggtgtgagaattgcttgaaccca

SEQ ID NO: 141189 - DNA, 601 bp, Human
tcaaagcagtacaagcacttagggtaggagtaaggtatacaggatactttcacttatttacttttctattttggaactgttggcataaagagaagtggttctcataagcaaggaagatggcaccctgaggtagatgtactgtcttcatgcagagatgacttgtccaaaggttgtgggctcagcagggattcggacccagatctgactccaagtctaagtcttttccatcattggatgctcccctatccctactctacaacaaagctgagagacaggaactctctgtactatacacagtctyagcacaggcaactatgctatctgcctgaagatgcttagactctggcttaacataaagtccttttaactcatggagatgtgacaatatatccaaatgtacccaccaccaatatcatcgtatcagactaatgcacatgaatatattgcccagttgtagaaaggactaattgggccgggcacagtggctcatgcctgtaatcccagcattttgggaggctgaggcagacagatcacctgaggtcagaagttcaagaccagcctggccaacatagtgaaaccccgactgtactaaaaatacaaa

SEQ ID NO: 141190 - DNA, 601 bp, Human
agtgaataatcagtggaaatccatacaacagactataattcagttttcaaaatggttgaacaatattcaaagcagtacaagcacttagggtaggagtaaggtatacaggatactttcacttatttacttttctattttggaactgttggcataaagagaagtggttctcataagcaaggaagatggcaccctgaggtagatgtactgtcttcatgcagagatgacttgtccaaaggttgtgggctcagcagggattcggacccagatctgactccaagtctaagtcttttccatcattggmtgctcccctatccctactctacaacaaagctgagagacaggaactctctgtactatacacagtcttagcacaggcaactatgctatctgcctgaagatgcttagactctggcttaacataaagtccttttaactcatggagatgtgacaatatatccaaatgtacccaccaccaatatcatcgtatcagactaatgcacatgaatatattgcccagttgtagaaaggactaattgggccgggcacagtggctcatgcctgtaatcccagcattttgggaggctgaggcagacagatcacc

SEQ ID NO: 141191 - DNA, 601 bp, Human
aaaataaacccaacttcccatcccttccagatcaagggccaatggaaagaggagagtgaaccagtgcccaagctccaaaggggcagcccaatcagcagtgcgctcacagggagggcttagcctgggccatctcttcctattcctgctctcttccccatcggacatcagtggctctagcataataaggtcaggagcaaagtgacacccctatttcagatgaaaagaggacttctccacatcagtgctgcgttttcatggtcctcttcccttccccttctgagctgggccccttctcttcccrctgaccctcctgcccttctgctttgcccccacacaccatctgttttgggctgttgcctttacttggtccatcaatgggcacaggctaccctgtcttccctgaaatggcaaatttttaattgaacctgctgccagcctcatacactgtcctgtttgtcatttatttcatgccaagcctgcccatttcctcccttagtactctctcctaacccctggaaatttgctctaccgacgatctctcaaaaggtcaccagtgcagcctgggcaacacggtaaaaccctgtctctacgaaaaatacaa

SEQ ID NO: 141192 - DNA, 601 bp, Human
tccctgtgttgcctaggctggtcccatttcctccttttaaaaatattcatactgtgccttatgaaataccatacaaaggtattttgtactttctgagaccctaagtaaaaagccattaggttcattttgcttttaatgaggatgtgtgaaaaaaagatgaagtcagaggcaaggctcaaacacctgcatgccaccaaatcctacacaaatgccacccaaagataggctggatgcaaactgaagtccaagcttcttaaacaccaagacaaagagggacataatcaactacaagattcagagktcctctaaaagaaagtcagcctgaacatggtttcccctttccagtcccgaagtctgcaaggatcttatgatgaagtcacaggggaccctccacatagacagtaaaggtgaactccatattttacataattgtaatgcaatctgagagcatggatgagggagaaaataagttaccctgaaagcattacatcttccatcagagtgctatgccccaacacaaaggtctcttggagataatacagtaaaggcttgctacagacaaccaggctctaacaaaataaacccaacttcccatcccttc

SEQ ID NO: 141193 - DNA, 601 bp, Human
cagtggcatgatcatagctcactgaagcctcaacctcccaggctcaagcgatcctcccacctcagcctcctgagtagctaggactataggcatgtgccactacagctacctttttaaaaatgttttgtagagatggggtctccctgtgttgcctaggctggtcccatttcctccttttaaaaatattcatactgtgccttatgaaataccatacaaaggtattttgtactttctgagaccctaagtaaaaagccattaggttcattttgcttttaatgaggatgtgtgaaaaaaagatgargtcagaggcaaggctcaaacacctgcatgccaccaaatcctacacaaatgccacccaaagataggctggatgcaaactgaagtccaagcttcttaaacaccaagacaaagagggacataatcaactacaagattcagaggtcctctaaaagaaagtcagcctgaacatggtttcccctttccagtcccgaagtctgcaaggatcttatgatgaagtcacaggggaccctccacatagacagtaaaggtgaactccatattttacataattgtaatgcaatctgagagcatggatgaggga

SEQ ID NO: 141194 - DNA, 601 bp, Human
ctattatgagaaactggctagccaggagtggctacatatgacctggaagtttaggagaggcaggttagctcccatctaaatatttagatggaagtcatatagaagagagagttgatttattctgagtgacacacagaggacaggccagggaaatatatggagaaattcctgagagatggactagaagcaaacaggcatggaaaaatatcatgttttgagtgccaatgaagcacaggcaggaagagatgacctccaagaaagcttgttggagaacattctctcactgggaagaaggccagcygggtcttgaattttagagatctgtagagattttgctgaaaggagatcttagctgaagccccacaggtaaaaagaggtgaaaatagagatgttcctcaagtttttgttttctttgtctcaccactagaatatttaagagtctaacaaactcattcccgcatttgtaggtatcagctctttgccactctccagattgtcaagcactgtctcttcagcaggacctctaggtgcctccaaaataacccttgagtcaggagcatgggtaacactgaagaactgtcatttatctttccataacgac

SEQ ID NO: 141195 - DNA, 601 bp, Human
ttattcaaaatatatgtcaaatcctgccccaaagttttagaactagtaacacttactcagtgagttgagtaagttaaaaagccaacactatcttggtctgcatagttatacaattcttcataaaatagtattgcttatttgtttaaatcaaaacagccccatgaggtaaccaaggaaagcattatttataagaaacgggtgcgcatggagttcatgtgagccataaaacctcccagagtgatcatcaccatactttatagactggagaagtcaatttgacaaagcaaggattagaatcctycttctacacagagttaccttgtctacctggccaagtgattctgttggttaaaacaggaggagctaaagctttgtaatcaaaggaagtcagttaccaatcccagtgtactctggtaggttaaaccacatctgtggcaatactatgatcaattctgagtgatgcattctgaagggacactgataagctgacatcagtttctagaaggagtaaactaggtggggaagggattagaaaaaccatatatagcctattatgagaaactggctagccaggagtggctacatatgacctggaagttta

SEQ ID NO: 141196 - DNA, 601 bp, Human
acacacaaggcatgtccaagaacacctgcccatgtcccctccttgaggggaggtcaggctcctgttcatcttagtaatcctcatgcccatgcctgatacatagtgggcactcaatccatgatttttcacccactgacaggattaccagcctagggaaatgcctcagatttaaagatctatcttgtttcggaaaggcatctgcatttgaatgtcactgccttttatgggcgtcacatctccttgatctgccaatctggtaatcttagatggcccactagggatataattgcattactttctsataaaagttccttatgtctagggcactcctgaagtccagtttagtaaccctagaaggagggtacagtcagaaggaacaccatgcccactgtgctgattatgtcatggcagaggaaactcgtggtgatgtgtacctcaatgtttggatttagatgtgttctcttctgttttggtcattaatgacttggaaactacttggcatacttattaaggaaactgggaatcagaaggatctttcttacgttaatacacagtttattcaaaatatatgtcaaatcctgccccaaagttttagaactag

SEQ ID NO: 141197 - DNA, 601 bp, Human
ttgaggtcaccacagaatctaagactcattccatggcacgaacgtgctaaagatttgatgcggaggaactagacatttaaaagctgtggaaaatcatgctcgcctcaggtaaacagaagtaaagtccaggagcattttaaagccaggtcctcctctcagaggtacaactgtgtcttcagatcaaggtatcagcatatggcaccaaccagcacaaatttttcccctccaaatgtctataatcaggtaaatacaaaaacattatgactcaatatacaaatattgtgagactgacaagaaattraagcttcaaaaattactaggacgggtgcagtggctcacaccagcaatttgggaggccaacactggaggatcacttgagtcctttgagactagcctgggcaacatagtgagaccctgtctctacaaaacccacaaaaattagctgggcatgatggcacacacctgtggttccagcaacttgggaggctgaggtgggaggatcacttgagcctgggaggtcaaggctgcagtgagcagagactgtgctactacactccagcctgagtaacagagggagaccctgtctcaaaaaaaatataaa

SEQ ID NO: 141198 - DNA, 601 bp, Human
attcaacattagcttctgtttttcaagtgttccgtgtgttccttagattcttctttcatcttctttctccattaatccttctttctgtccttcatctaaatggctagttcatatcaggcacagttcaaaggcaaagtctctgtcctaaaagcttacattctagcagaaagagacaaatattaaatacggtgtattaaagagttcacaaaaatatatataaaatagggtgtttaaaataaagagagaacaatgggggctaccatggtcccaaaataggaaccaaatagatttccatctcaaggtatcaagattcctcctctccttccttctcactatcacttgctattcttggtatctcatgcaaggacaatgaacaggtttcaacattttcatctaccctgtctctccgcaatgaatcctataaacatttactgaagatcacacgctttcaagtcaaacttcaaaaccctgtgttcccaagttccagtgtgaccttggcaagtaactgaacccaggtcaccccatttcttgtgggtagactccttccttccagggccactgtgaggatgaagcctgttcaataggaatggaacccaccgca

SEQ ID NO: 141199 - DNA, 601 bp, Human
tttttcacatggattccttctcacaatgtattatcatcacagagcttgttcaaacctggaagcagacaattcctggttattgtccccagtgattacaacagtctccctaatttcagctgtggctccccgttttgagccaccaggataatcctgcattactccaaactctctaagtaaactcgtattcaacattagcttctgtttttcaagtgttccgtgtgttccttagattcttctttcatcttctttctccattaatccttctttctgtccttcatctaaatggctagttcatatcagrcacagttcaaaggcaaagtctctgtcctaaaagcttacattctagcagaaagagacaaatattaaatacggtgtattaaagagttcacaaaaatatatataaaatagggtgtttaaaataaagagagaacaatgggggctaccatggtcccaaaataggaaccaaatagatttccatctcaaggtatcaagattcctcctctccttccttctcactatcacttgctattcttggtatctcatgcaaggacaatgaacaggtttcaacattttcatctaccctgtctctccgcaatgaatc

SEQ ID NO: 141200 - DNA, 601 bp, Human
tggtttctaccaatggtgaaaaaaatcttaagacaatacaaaaacttgggaccctccaaagctcaactctacccaacaaaatcttattcctttgtactaaatctagcaagggataggaggtaactaggaacaatgtctaaaacaactcttggagaaggtgatcatgaaaacaaggttaagaaacactgagataacactaaaatgtacaagtctctccccccacaaatcacactccattcccagagggaagggcctatccttcagccaattattcttccagcccacaggcacacatatcacrtatcactattaatcatatatccaagagctctggactaagaccaccttcagaaacacaaccccgagggcctatgtgtcctaacagtgaaggcagacactagagcagatacaagcctaccagctgctgggaaacagccatgcccctccctggctctgaaatttgagaagcttccccctaagaaccctcagaaagggagaaagagtaaagggagacctagcttcaaaaagcacctccacagctgacccaaaagctcgattcctgcgctgttgaatggtacttctcggtgtacgccgagagcat

SEQ ID NO: 141201 - DNA, 601 bp, Human
gcgattggcctgctctgctctcgctcctccgacagcttcacctgctcctcttcatgttcctgtgcctgggtccagggctcatcctgttgtggtcgtggtggcggcttcagcccttagagcttcccttggctctctcctcaggacagctaagagcaccagtgtggagtcacccttcagttcaaatgcagatcagtcctttcttgtttcatgacctttctttagccctcactttcttttgtaattctaaaataataattggttttttgttgttgtttgtttgtttttttgagacggagtctcrctctgtcacccaagctggagtgccatagcgtgatcttggcccactgcaacctccacctcccgggttcaagcgattctcctgcctcaacctcctgagtagttgggattacaggtgcccaccaccacacccagctaatttttgtatttttagtagagatggggtttcgccatgttggtcaggctggtcttgaactcctgacttcaggtgatccgcccacctcagcctcccaaagtgctgggattacgcccagccaattccaaaataataatttttttaaaaaaattaggctgggccaggcat

SEQ ID NO: 141202 - DNA, 601 bp, Human
tacattcagcgattggcctgctctgctctcgctcctccgacagcttcacctgctcctcttcatgttcctgtgcctgggtccagggctcatcctgttgtggtcgtggtggcggcttcagcccttagagcttcccttggctctctcctcaggacagctaagagcaccagtgtggagtcacccttcagttcaaatgcagatcagtcctttcttgtttcatgacctttctttagccctcactttcttttgtaattctaaaataataattggttttttgttgttgtttgtttgtttttttgagacggagtctcgctctgtcacccaagctggagtgccatagcgtgatcttggcccactgcaacctccacctcccgggttcaagcgattctcctgcctcaacctcctgagtagttgggattacaggtgcccaccaccacacccagctaatttttgtatttttagtagagatggggtttcgccatgttggtcaggctggtcttgaactcctgacttcaggtgatccgcccacctcagcctcccaaagtgctgggattacgcccagccaattccaaaataataatttttttaaaaaaattaggctggg

SEQ ID NO: 141203 - DNA, 601 bp, Human
aataaaaattactcttccaagttgttgataaacatccttttctttattcttcttcaagatttattttcttggccttcccaagctgctttcgcagactttctgcctggctctttcaaatccacagcagcccctctctttatatgcccaccttcctttcttaaacacgcacacattctccaagcagtgcctgacagccttctttgcatcaaggagcacttacaaatgatccagagaccgaggagaatactgtctaggcacacctgctggagactcctccccgaaactctccaacatccctctwgccagatacaatcaacatgtgaagataatgaagaccaagaaaaaagcctcctagggcataggatacagctgatcctcctccctacattcagcgattggcctgctctgctctcgctcctccgacagcttcacctgctcctcttcatgttcctgtgcctgggtccagggctcatcctgttgtggtcgtggtggcggcttcagcccttagagcttcccttggctctctcctcaggacagctaagagcaccagtgtggagtcacccttcagttcaaatgcagatcagtcctttcttgtttcatg

SEQ ID NO: 141204 - DNA, 601 bp, Human
agtaatctttggccaataaaaatgatttactatcttcatctaaaaagctttaatttctcaacatctggcagaaaaacgctgacattttctttctctcaacaaaagaaagttagcttaaaataattgcttaaacttacctcattaatacttcatggaaatttcactctaatttacttaaaaattactcttcctgacagggcgcagtggctcacgcctgtaatcccagcattctgggaggccaaggtgggcagatcgtgaggtcaggagatcaagaccatcctggctaacacggtgaaacccygtctctgctaaaaatacaaaaaattagacgggtgtggtggcgggcgcctgtagtcccagctacttgggaggctgaggcaggagaatggtgtgaacccgggaggcggggcttgcagtgagctgagatggtgccactgcactgcagcctgggcaacagagcaagactccgtctcaaaaataagaaataaaaataaaataaaaattactcttccaagttgttgataaacatccttttctttattcttcttcaagatttattttcttggccttcccaagctgctttcgcagactttctgcctgg

SEQ ID NO: 141205 - DNA, 601 bp, Human
actgcgtccagccgatagacacgtttaagtcttgactatatttttacactggggtcttgttctgggtgcctagaaaaataaattctcactatataaactggaggtggtggtatgaaaggggataggcaaagaagaaaaggagaaaagagtactcctcaagcattaactatggaaagcaaatactaattgtaaggtgattttttttttccccaaaagtgagggcgttctcaactaggagatatattttgatcaatctgaagaaaaacataatatgctagggtgagaggagttctgccttggsgccatgcctggctccatctatctttgctatgggcctgggttagttcctctaacttctctcgatccaagaggaagtctaaactggatgcctgcactaggtccgttcctactctcagctatctacacaatttggtcaaataataaaaaactgaagaagtattttctcgtttcttcaaatgtagagaaaaattatgttagagtagtttgggatatttcacaggatggtgatggtaattctcataccaaatgacatcaattaatatttaagcagaaaaacattaaaagcatatttatgcatcct

SEQ ID NO: 141206 - DNA, 601 bp, Human
aagtgctgagattaaaggcgtgagccactgcgtccagccgatagacacgtttaagtcttgactatatttttacactggggtcttgttctgggtgcctagaaaaataaattctcactatataaactggaggtggtggtatgaaaggggataggcaaagaagaaaaggagaaaagagtactcctcaagcattaactatggaaagcaaatactaattgtaaggtgattttttttttccccaaaagtgagggcgttctcaactaggagatatattttgatcaatctgaagaaaaacataatatgmtagggtgagaggagttctgccttggcgccatgcctggctccatctatctttgctatgggcctgggttagttcctctaacttctctcgatccaagaggaagtctaaactggatgcctgcactaggtccgttcctactctcagctatctacacaatttggtcaaataataaaaaactgaagaagtattttctcgtttcttcaaatgtagagaaaaattatgttagagtagtttgggatatttcacaggatggtgatggtaattctcataccaaatgacatcaattaatatttaagcagaaaa

SEQ ID NO: 141207 - DNA, 601 bp, Human
tacaaaagaaaatccagtaagtttatattttcatattaagacgactaactttgcagtgtttcatggatcaagtctggcctggaggttagtttataaaagacagtcttaaatacaatttgttttccaggctagtctcaaactcctggtctcatgcaatcctcccgcatcagcctcccaaagtgctgagattacaggcatgagccaccaccccctgcctccattactcctattatacctcagataaatattcttggataatatatctcctccaacacatcaaataaacccatttttatggcayttttagaaaataaaacaaaaattggcagacacattttttaaaaatatttttttttgagatggagtcttgctctgtcacccaggctggagtgcagtggcgtgaactcagctcactgcaacctccacctcccgagttcaagcaattctcctgcctcggcctcccgaatagctaggattacagtcacacaccaccacgccacgctaattttcatgtttttagcagagacggggtttcaccatgttggccagcctggtctcgaactcctgacctcaggtgatccgcctgcctcggcctcccaaa

SEQ ID NO: 141208 - DNA, 601 bp, Human
cacagctgaggcaggcatagtggctcacacctgtaatctcggcactttgggactgagctgggtggatctcttgagtcaggagttcgagactagcctgcacaacattgagagaccttgtctctactaaaaataaaaaattcagctgggcttgacgatgcatgcctgtcatcccagtgacttggaaggctgaggtaggaagatcacttgagcccacgagatcgaggctacagtgagccatgatcacaccactgcactccagcctgggcagcagagtgagaccctgtctcccgccccactgccaaaaaaaaacccacagctgggaagaaggaaagatccagtatcatttgtcttctcattcagcactggtgaaaatgccaagtatacataggaaatgctcaggagatagagatcatgagcttgggaatcaattacatcattggaaatgggaatgaaggtagaaatgtctgctgtgtccataagacatagggaggtttaatcattggaagaaatgaaatggcatcttgacattttagtcacaaagaagtcccacaagttccagtctacaccactcacggaggaaccaagcagaactgtgggaaat

SEQ ID NO: 141209 - DNA, 601 bp, Human
ggaaagaactggaagagcagaaacagattctggagggctgtaactcactcgcagaggatgatgccatcctttaagcccagctggaagttggggccaatgctcatgcctgtcacctcttctatccaattgcgaagatcttcttctgcctgatgatcatacttggaagcaatctgaaatacaggttaactcactttagaagaatttcacaaaagcatcagaaactgccgactcacaacgcgctctgctttcactagccattaagaccacagctgtgaagtgtagtaaatgacactcaatagakctcaatggcaaacttaaccgttacaacttcagtaactaataacaaatttttggtgaagaccgtgtcatacaaaattttgaacagaccatggagaggctgggactgacaaggagagaacatcaatcaagagacatcagatttcatgatccacaggaagtgacaaggatttaatggtatgttacaatatggcactcaaactttaaggtttaagtcattaatcaccctattccaaaaaaagctggggaaaggattctgacacatgcagttattttacagagtatctcacctggccaatacata

SEQ ID NO: 141210 - DNA, 601 bp, Human
gagagaaggctgtggaaagaactggaagagcagaaacagattctggagggctgtaactcactcgcagaggatgatgccatcctttaagcccagctggaagttggggccaatgctcatgcctgtcacctcttctatccaattgcgaagatcttcttctgcctgatgatcatacttggaagcaatctgaaatacaggttaactcactttagaagaatttcacaaaagcatcagaaactgccgactcacaacgcgctctgctttcactagccattaagaccacagctgtgaagtgtagtaaatsacactcaatagatctcaatggcaaacttaaccgttacaacttcagtaactaataacaaatttttggtgaagaccgtgtcatacaaaattttgaacagaccatggagaggctgggactgacaaggagagaacatcaatcaagagacatcagatttcatgatccacaggaagtgacaaggatttaatggtatgttacaatatggcactcaaactttaaggtttaagtcattaatcaccctattccaaaaaaagctggggaaaggattctgacacatgcagttattttacagagtatctcacc

SEQ ID NO: 141211 - DNA, 601 bp, Human; identical to SEQ ID NO: 23370

SEQ ID NO: 141212 - DNA, 601 bp, Human; identical to SEQ ID NO: 23371

SEQ ID NO: 141213 - DNA, 601 bp, Human; identical to SEQ ID NO: 23372

SEQ ID NO: 141214 - DNA, 601 bp, Human; identical to SEQ ID NO: 23373

SEQ ID NO: 141215 - DNA, 601 bp, Human; identical to SEQ ID NO: 23374

SEQ ID NO: 141216 - DNA, 601 bp, Human; identical to SEQ ID NO: 23375

SEQ ID NO: 141217 - DNA, 601 bp, Human; identical to SEQ ID NO: 23376

SEQ ID NO: 141218 - DNA, 601 bp, Human; identical to SEQ ID NO: 23377

SEQ ID NO: 141219 - DNA, 601 bp, Human; identical to SEQ ID NO: 23378

SEQ ID NO: 141220 - DNA, 601 bp, Human; identical to SEQ ID NO: 23379

SEQ ID NO: 141221 - DNA, 601 bp, Human; identical to SEQ ID NO: 23380

SEQ ID NO: 141222 - DNA, 601 bp, Human
aaagtttatgcaagttttttttttaacggaaaatttccccgtcctttcctgctgtcattcctatttgaatgtatacacttaggcttttatggaacagcacttctgaaaacttcaacagtttcttttatcctggaaaggatttggtcccgtaatagggatttgggggactgtattctggtggtttcagagaggagaaacatatttactattcataatgtttcgggaacgtaccttttgcgatatttttacatgtactcttgtgaaagagttgtactcaatttgaggtgagaacttgcctttygtaataatctaattaaagttattgattgcttgtgaaatcagggaaaaatgattaattttaatcattttgataggcaggtggttgtctatcacttaatttttataatttaactttttaaaatgtgactttcctgttgtactgaagtagagaacacatctgcttatattgaccatatccaatattttactctcagtattgacaaaaggattaaatgattcatttttaatcctttatgacgtcttgaaagtagttttaaaatatatcctgccatttcagtacacaagcagaaaaatccctagg

SEQ ID NO: 141223 - DNA, 601 bp, Human
catttcagtacacaagcagaaaaatccctaggaaaaagcatatttgattcttaaaactagtactagttttttttttttctacttgtttggtgtgctgaatactctagcaagtaaaatgaaagccaagttgtctattttttcccttgtgtatttatttttacattgtatgtgtgattgctgtcataagtctttcacaagattatccagcacagatagctataatttctttttacaactcttaaaaaggaaaaagaacctttatcaacattgcctttctaatgaaaattgcaaaagatttcarcagggtctgcctaaacatttgtttacactacagaagtggggatcgttccaaaaacctaataacacattacagtctgtcttcttggggagagttgattcttttctaggatatatttagatttctgattgacatgatggaatagaagtgcagctgtagcaagcagtatgctaaataattcaactttggaatatgctaaattcagtttaatgtgtgagtcagaaagctatagtgaaaaagcatttccattgtgtaatgaagatgatttgtttttaaaaatcatgtattgacgtgttaccttaa

SEQ ID NO: 141224 - DNA, 601 bp, Human
atttagatttctgattgacatgatggaatagaagtgcagctgtagcaagcagtatgctaaataattcaactttggaatatgctaaattcagtttaatgtgtgagtcagaaagctatagtgaaaaagcatttccattgtgtaatgaagatgatttgtttttaaaaatcatgtattgacgtgttaccttaaatttaaaaatttacctttttttcttgtattatgctattcttaaaagtggttaagaatctacattttcgcccaagaattctccctagttggggttgtagactttatacatttrtaatctcatattgcttaattattccaaagaagttttgttttgagagattacatttttaaagaaattcttaaggtttatatgttttaggtgtttgaagtgtgtgcctatacactaatcataataggacatttttatacttttctgtcagcattgattaggaatgtagaatatatccaaatggaataagtaatgtacattttaaagtgatatgattctcacatgttgaagtttgggtttttagtgataagtttaatgaattagactttgcttcaggacatttcacttgttcatttctcacct

SEQ ID NO: 141225 - DNA, 601 bp, Human
aactgaaagtagtaaaagtttgaaagagtatctgagaatttgcgtcttcagctgttgagttgctccaagctgtcttacgttgaaggaatttttaaaaaattcctgtccttctcacactagtagctttgtaagataacatgaaaatagatcactggaaaagatgagggaaagaccaacactcaattttttactatttgattcaatagacataaaattattttgtcaaattgcaatgaaggtacttaaatgctttgaatttccatacttaactaatgttaaccattaggagcagttttggcayaagtccatggaccacagtttgagaacctttgctctaaagcctaaaccagtctctgttggaaagtggacgtaagtagtaaataatcgtttatacagatattttttccgaagggacacatctaatttgcactgcaaaatttatcacataatcaaatgcttttcaagttaggattttattaatacttttctttaaattaatatatcttttatttctgttttccttctgccaccccacaattacttattgaatactaccaattatttggcatcatgctaggtactactaaggatattaagataa

SEQ ID NO: 141226 - DNA, 601 bp, Human
cacataaattcatgttatgacagaacctttcaggagtacatcactttgtaaaataagataagcctatatgaagattattgttgcttcaaagaaatttttacttcttttttgtttttttaatagctgtcttgttaacatctgtcttttaagctgaaaaatgtgcaaagtattttttcccctaatgtacaccatggacttttctggttgtagttttgagatacacggcatagggtgacagatagtgatgtgtgttaattttactcacaaatttttaaaaaaatatttttctgttttggaaagrtgagatccttagaaatagggccatgaatagtccataaggtctctgtacaaattagaaaaaggcactccttccttaaaaagcattactactgtctgccagaaaaagtatcacagtaaacatacgaatttatggtatttacaataagaatggccctctagtatgttgtgtactgaacaacctacctaactgtatgtaaatggtggccctgcttgggagccatttcctttatcctttaatattctctttgtgtaaaatgggaatgataactaatacatgatagcaaataatgtaaaatatctc

SEQ ID NO: 141227 - DNA, 601 bp, Human
ctctctatttagaaggtattatgtccagttattgatatctgttagcccaatgtgtttaaaattaaagtcaatgaaatttttgaaattaaatttatggctgctccttttcaaccattttgttgagagtatagtttttacgtatggcaactctttgaataatattaaatattaaccttggacctacttgaaagcagtgttctcagccttaaatgtttttaaaggtagttatatatttaaaaaaaattcttaatccaagccctccatggttaaaaatagcttggattggattttctttcttttyttttttttttttttttttgagacagagtcacgctgtcaggctggagtgcagtggtgtgacctcggctctctacaagctctgcctcccgggttcaagcaattctcatgccttagcctcctgagtagctgggattacaggcgtgtgccaccacgcctggctaatttttctgttttttgtagagacaatgtgttgccatgtgggccaggcttgtctctaactcctgacttcaagtaatccccgtgccttggcctcccagagtgctgggattacaggcatgagccaccatggtcggctggcttg

SEQ ID NO: 141228 - DNA, 601 bp, Human
ttatgtccagttattgatatctgttagcccaatgtgtttaaaattaaagtcaatgaaatttttgaaattaaatttatggctgctccttttcaaccattttgttgagagtatagtttttacgtatggcaactctttgaataatattaaatattaaccttggacctacttgaaagcagtgttctcagccttaaatgtttttaaaggtagttatatatttaaaaaaaattcttaatccaagccctccatggttaaaaatagcttggattggattttctttctttttttttttttttttttttttgagacagagtcacgctgtcaggctggagtgcagtggtgtgacctcggctctctacaagctctgcctcccgggttcaagcaattctcatgccttagcctcctgagtagctgggattacaggcgtgtgccaccacgcctggctaatttttctgttttttgtagagacaatgtgttgccatgtgggccaggcttgtctctaactcctgacttcaagtaatccccgtgccttggcctcccagagtgctgggattacaggcatgagccaccatggtcggctggcttggatatccttaatgtctag

SEQ ID NO: 141229 - DNA, 601 bp, Human
tctgagttggttaagtgattcttaggtgctagacactgtcaaacgccttatattaattacctgttgattcctacaaccctaaaactaataacaatatgatatttattgcttcatttttaatttttaagaggcagggtcttgctttctcacccaggttggagtgcagtgccacagtcatagtttactgtggcctcaaactcctgggcacaagcgatcttcctgcctcagcctcccgtgtagctgggactacaggcgcctgccaccacgccggccaattttttttgtatttttagtagagacrgggtttcaccctgttagccaggatggtctcgatttcctgacctcatgatctgcctgccttggtctcccaaagtgctgggattataggcgtgagccaccgtgcctggccatgttggtgaatttgatatgcagaacttagaataatgcctttctgaagtttttagggaggtcaggggaagtgagttaacttaataataggacagtactatgctttttggcatcagattatttctaaagaaggttgatgaaaacagcttaacatttgaaatacttaaagttgtaaatcattcaaaatgtctaa

SEQ ID NO: 141230 - DNA, 601 bp, Human
ggcattctcccagaagagcaaatccctgaagttagaagtgagagcatgtatactaaaaggagtctggttcaacataatgattgaaagacttcaagaactgatgacttaaattgatttactgttttttgccacctatgtttcatcattggttcacaatacaaaatatgcctttggggcattagtcaatataccaaaactataaaatataattttaaatactatgacccaaaaggaaattttatgccttgtcttttctggattacagaaggtatttagggtgtgtgaattttttttttttttcttttttgaaacagggtcttgctctgtcatccaggctggagtacagtaacgcagtcatggctcgtgacatcctcaatctcctggacttaagcaatcctctcacctcagcctcctgagtagctagaaccataggcacgacccatcacactcgactaatttttttactttttgtagagacgaggtcttgccatgttgcccgcggtggtcttgaactcctggactaaagggatcctcccaccttggcctcccaaagtactggaattacaggcatgaactaccatgcctagcccatttttttttc

SEQ ID NO: 141231 - DNA, 601 bp, Human
caagaactgatgacttaaattgatttactgttttttgccacctatgtttcatcattggttcacaatacaaaatatgcctttggggcattagtcaatataccaaaactataaaatataattttaaatactatgacccaaaaggaaattttatgccttgtcttttctggattacagaaggtatttagggtgtgtgaatttttttttttttttttttttgaaacagggtcttgctctgtcatccaggctggagtacagtaacgcagtcatggctcgtgacatcctcaatctcctggacttaagsaatcctctcacctcagcctcctgagtagctagaaccataggcacgacccatcacactcgactaatttttttactttttgtagagacgaggtcttgccatgttgcccgcggtggtcttgaactcctggactaaagggatcctcccaccttggcctcccaaagtactggaattacaggcatgaactaccatgcctagcccatttttttttccttataaaatttcctttctaaatacgaaaaggggagaaacatttttattagtgcttcttgtatctttatagtctttcagctacgttttttt

SEQ ID NO: 141232 - DNA, 601 bp, Human
ttaaattgatttactgttttttgccacctatgtttcatcattggttcacaatacaaaatatgcctttggggcattagtcaatataccaaaactataaaatataattttaaatactatgacccaaaaggaaattttatgccttgtcttttctggattacagaaggtatttagggtgtgtgaatttttttttttttttttttttgaaacagggtcttgctctgtcatccaggctggagtacagtaacgcagtcatggctcgtgacatcctcaatctcctggacttaagcaatcctctcacctyagcctcctgagtagctagaaccataggcacgacccatcacactcgactaatttttttactttttgtagagacgaggtcttgccatgttgcccgcggtggtcttgaactcctggactaaagggatcctcccaccttggcctcccaaagtactggaattacaggcatgaactaccatgcctagcccatttttttttccttataaaatttcctttctaaatacgaaaaggggagaaacatttttattagtgcttcttgtatctttatagtctttcagctacgttttttttgccacatcattta

SEQ ID NO: 141233 - DNA, 601 bp, Human
gaaggagggaacctttaatacatcaagattaaagttaactttaaattataaatgagtcattttaatatgtgggagtgagaatcttaaaacataatgaaaacctccaaaagaaaagtgaattaggaaatacatgcctgcttacctgtctttcacaccccaattttagaagaaaaatacttgggatggattgagtagggggcaagagagaaaaaaatatattacagtaaatatcactgaaaaatgttcaatttgtggaaatgaatacaaataaaattttatcaatcaacttttttttttttttaaagagacaggatctcaccatgttgcccaggctggagcacagtggctattgacaggctcgatcaggcacacttcagcctagaactcctgggctcaagggatcctcctgcttcagcctcatgagtagctgggactatagatgtgcactagtgagcccagctcaacagttagttttaaaggcatagaaatgtttttatgttcagagaaaagtatcagcgctgatacagggccgtggtagctaaaagtcaattaaatttgaaatgtaactagtacacagctttgcagaccattgaatagacta

SEQ ID NO: 141234 - DNA, 601 bp, Human
actcctgggctcaagggatcctcctgcttcagcctcatgagtagctgggactatagatgtgcactagtgagcccagctcaacagttagttttaaaggcatagaaatgtttttatgttcagagaaaagtatcagcgctgatacagggccgtggtagctaaaagtcaattaaatttgaaatgtaactagtacacagctttgcagaccattgaatagactaccaaatcaagcacctttgcagtaaaacctttgtagagacttgaaattatttgaattttttccatgtcacaaaattataccaayttgtagttgattagaccacaaaatataggtatgcttatgttggttgaatttatgtatttgatttgccctgcaattttcttatgaactcttacaattttttttttttttttgagatggagtcttgctctgttgcccaggctggagtgcagtggtgctatctcggctcattgcaacctccgcctcccgggttcaagcgattctcctgcctcagcttcccaagtagctgggattacaggcatgcaccaccatgcctggctaatttttgtatttttagtagaaacagggttgcatcctgctggc

SEQ ID NO: 141235 - DNA, 601 bp, Human
agcactttaggaggcccaggtgggagaatcacttgagcccaggagtttgagaccaacctgggcaatatagtgagaccctctctctacaaaaatagaaagaaagagggaagaaggaaagagaaagaaatcccaagtatggaaacattacatcaaattttaggggtacaggagtatgccaactagtaagcaattatcttagctccagacccacctttctatgctctgctttgtgactggacctagtactctgcaagccacatgtttctttgctagctgactctccattagactctgttgccagtatggggctatcgtgggagattgcatggatggaggaagagaaagggttttctcttactttctcttgtctttcagttcctttgaacaacccagcaacacttcttcaccctggttgcatcagttttcctgtagcagagactgaacgcggtttgcattttctctaatacaccaccagcctgaacccgcaccccatccccccactctggcagtgtggatcccaacccttggggccctcctccaagcgcagatatattagtactagcttatctatgcccattcttccgaggcctgagtttcagtt

SEQ ID NO: 141236 - DNA, 601 bp, Human
gttgtttttaatagaggatatatcagatgaatggattttaagtagtatctttttactagtgtgtatacgggaaggatatgtatatttgtatgtgtgtatatgcaaatgtgtgtacttacagagagggaatgagggacacagagagataggcatatagtaggttagggaattgtaatagaaactcagaaagaaataatggggtagctactgcatacatgtacagtacttctttcctatgaggtagaggtactatactagagaacttttaaaccatataaataaattttagattgaaaaatgwttgtatcaaagttgtaatatgagggtacagaagagtcaagtgaaatgaaaggaaaagaagagggaaagagccagagggaatattgtgggtttttcacaatattggttccactttttcaacttcttcagttgaatcaaaggtcataaattacgtgaaataaaacagggccatttataagagatccaagtttgagaaatttcttagacctgtgtagttagaaaaaagcaatctctaattatatttacctatagagtttatgttctccagatgtgtgacaattacatagtacttggacagtat

SEQ ID NO: 141237 - DNA, 601 bp, Human
ttaactgaactcttgacccaacacgtacattttctcaaaaataagtgatttgttcagtttacttaatttcttcagtgaagcggaactgttccaagtagtacatcccaatttggagctctgggtgttacaaagttcttttacatagaaacaaaatgtgcctccccttttgctcttaccaagcagtcatagtttccctacagtatgatgccattccttcaagttttcctgaaatgttttctagtttctttagttttatcctactgttatgaagcaccctaaataaaacactagaaaccagaaytagtcctttgaacaatgttttacaaactgtggtgtgtgactctgagcatcaagaaatcaacattttaaaaattaaaataaaagaaaaaatcagaatatacggtataagggctaatatctttttgtgaaacctgtttcagatatactgattatacaactattaactggattgcaaagtaaaatgtacttcttactgtgtttgcagtcagaaactcttttgagtcactactttagagtatgctattgtgagataggtaaaatttcacccaataatatcaatatacgtgcaaaattctgtatt

SEQ ID NO: 141238 - DNA, 601 bp, Human
acacccaatatcactgagtataagcatcaccacaacttagcctaccattagatctggagttgtataagaattttttaaataccatgattcaaccggtcaaacacccttacaacaaagaactgggcaaaacagtcctataatggtccacttacaaactatttgatttcataaaattccagtgagacaaaaaatctgggcagaggtcataacattttttaaaaaattagaactagaagagaccttgtaagaaatttaactgaactcttgacccaacacgtacattttctcaaaaataagtgawttgttcagtttacttaatttcttcagtgaagcggaactgttccaagtagtacatcccaatttggagctctgggtgttacaaagttcttttacatagaaacaaaatgtgcctccccttttgctcttaccaagcagtcatagtttccctacagtatgatgccattccttcaagttttcctgaaatgttttctagtttctttagttttatcctactgttatgaagcaccctaaataaaacactagaaaccagaactagtcctttgaacaatgttttacaaactgtggtgtgtgactctgagca

SEQ ID NO: 141239 - DNA, 601 bp, Human
cagcctggccaacatggtgaaaccctgtctctactaaaaatacaaaaatcatgtgggcctagtagtgcaagcctgtagtagctactcgggtggctgaggcaggacaattttgcttgaacccaggaggtggaggttatagtgtgctgagatgatgccatttcattccagcctgggcaacagagcaagactctatttccaaaaaaaaaaaaaaaaaaaggcattcataaagaaacaaaaataaggtttataaacaaaggaacttggagtcaagcccaggctgtctgactagaattcatatcamaactatgctacatttctcaaagacaaacaaattaaattattagagaataagtgtggctggtaaatcctacctcagattcacctgtgctgtttattaaaatttcagactcctgagcctaatcctagacccactgaatcattctccaagagcagtttggactttcattttaacaagcatcctaaggagagtactttatctacgtactctaaagtctgagaaccaccaggatagacatatcttgcagaactcaacttgtatgacactccagaagtcatttcgtaacatttaggtgcacctcta

SEQ ID NO: 141240 - DNA, 601 bp, Human
ttaatttgataagcaggaaaaaaaagatagcaacaggaaataccatacaaaccccaattttaatcctacaaggtttttgtttccttcaacatacataaattcaggcctgttttcatcctactcttgtttctcaaatgttcttgaactaaagaagttgtctaattactttaaagctttttttgtaccagtgaaaatttaagctaactgttgagacacaaaagcattcataggccaggtatagtggctcatgcctgtaatcccagcactttgggaggctgaggggggcaaatcacttgaggtsaggagttcaagaccagcctggccaacatggtgaaaccctgtctctactaaaaatacaaaaatcatgtgggcctagtagtgcaagcctgtagtagctactcgggtggctgaggcaggacaattttgcttgaacccaggaggtggaggttatagtgtgctgagatgatgccatttcattccagcctgggcaacagagcaagactctatttccaaaaaaaaaaaaaaaaaaaggcattcataaagaaacaaaaataaggtttataaacaaaggaacttggagtcaagcccaggctgtctgact

SEQ ID NO: 141241 - DNA, 601 bp, Human
ttacaatatcatacaaagtaaacggcaaaggctttcccatgattcttgagcactttcacagcacgtatcaggggttcagtaagtgtttacaagtcaagcataagtagaataaacagtcatttcagagaaacagagattgatttaaaaaaaaccataactcaatgtctatatagtagctatagagttacatggttgcagtatgcccaggggaaccagtatttccagcacatgtccttttccatacttttaaagtagcctaagtaatgtgctgtgagcctttgactgagttggatttcaaaaygtgttttagggttttgaacattaacatttatgatagtagccatatactgacatttagtggaacacagttccttattgtttcatcagaaactgacatttgaaaaattacttctagtgatgttgagtctactaaagcaatctaccaatcacaattgataatcattcctctcctagaccaaatataaactgaaataaaacactgatagtgaggaaaccatggtgagaattaagcatgagaatcctagtatcttgtctggttaaagagttgcctacggtctagattttctgttttatgcataag

SEQ ID NO: 141242 - DNA, 601 bp, Human
gctagagtgcagtggtgtgatctcagctcactgcaacctctgcctcccaggttcaagtgattctcctgcctcagcctcccgagtagctgggattacaggcgggtaccaccacgcctggctttttttttttttttgtatttttagtagacatggggtttcgccatgttggccagactggtctcaaactcctgacctcaggtgatctacctgctttagcctcccaaagtgctgggattataggcgtgagccactgcgcccagcctgtaatcacaagcattgtaaaccaaaactttttttttcytgagtgcagcagaaaaaagcaaaggctatttgaatgtattttaatgaataatttacaaggataatgagaaaatattagtacatataaatcagatacatattaacttacatttacaatatcatacaaagtaaacggcaaaggctttcccatgattcttgagcactttcacagcacgtatcaggggttcagtaagtgtttacaagtcaagcataagtagaataaacagtcatttcagagaaacagagattgatttaaaaaaaaccataactcaatgtctatatagtagctatagagttacat

SEQ ID NO: 141243 - DNA, 601 bp, Human
taggtctgtgtgtggaaataagttcttagcttctttgggtagatactaaggagcataattgctgattttatgacaatagtatatttagttttataatcacaagcattttattcttatttatttatttatttaattttattattattatttttttgagacagagtctcactctcttgctcaggctagagtgcagtggtgtgatctcagctcactgcaacctctgcctcccaggttcaagtgattctcctgcctcagcctcccgagtagctgggattacaggcgggtaccaccacgcctggctttttttttttttttgtatttttagtagacatggggtttcgccatgttggccagactggtctcaaactcctgacctcaggtgatctacctgctttagcctcccaaagtgctgggattataggcgtgagccactgcgcccagcctgtaatcacaagcattgtaaaccaaaactttttttttcctgagtgcagcagaaaaaagcaaaggctatttgaatgtattttaatgaataatttacaaggataatgagaaaatattagtacatataaatcagatacatattaacttacatttacaatat

SEQ ID NO: 141244 - DNA, 601 bp, Human
atgagccaccgcgcccagcctgtttttttttttttaaatatactttttttttagagcagttttaggttcacaagaatatcaagtagaaggtagattgaacagatttctcattcactccctacactcacatccacacagcctcccccattatcaacatacccaccacagtggtatacatttgttacacttgatgaacctacattgacatgtcataatcacccaagtccagtttatcttagggtttactcttggtgctgcatagtttatggatttagaaaaccatataataacatgtatccaycattacaatatcatatgcagtagtttcattgacatacaaatcctgtgctctgcctattcatccctccgtccctgctaacccctggcaacaactgatctttttactagtttttttactagactagcaaaactatagtctacatagttttgttttttccagaatatcaaatagttgatatcatacattatgtagctttttcagattggcttcttttacttagaaatatgcattcaagtttcctctatgtcttttcatggcttgatagctcatttcttttaagcactgaataatattatattg

SEQ ID NO: 141245 - DNA, 601 bp, Human
tgcttatgcttgctttgggtggatgctgcttctaagccttccctttatcctttccatctccttcatcttaatctttctactgctctgaagtttgacacataaattacatgacatgatgacatcatcatgaagaacagcaagttgaagttctattctgactcttatataatagccagcactgacctcttataactccatcttggagtttaagtaaaattatgctaaaaaagaatttctgtatttcccacatttagtgtctgagcaaagaaaggcttattctaatgcctaacaaaatctatcrcttccgctatgtaacaaaataaacagaaaagactggactttaccagaaactttcatttcttctctttcatcaggatttatcttttctactgcatgagatacagtgcattccaagacatctggaaactcctataataaacacaatatttaaaacaaatataaaatttaatgcttctgattaattataaaattttctattatccataatgccttttagaatcagagaacctataagacaacagagttctctacctgaggtctgggtgggcttcacaagggttgtaaagctctgaaataaagg

SEQ ID NO: 141246 - DNA, 601 bp, Human
atgagccaccatgcccagcctggtactacactattaaaaagtctcctgctagaaccatttaacaatctaatacatctgcctagaacacaaacatgatttttgttagtttgttaagtgtgatggtttcagctacagagcaaatagttcttaaaggtaaaggatcaaatacaagtaaatacctttaatgttaaagtataaaatatggctatgaatcagacacattttgaaagagaagaattgacagcttccagtagctacactggttaatttacattctgaatcatctaagtctctccaatastttcttgtcctcattctggctatcatcaaggagaaggggaaatactttctctaggtcttcctgtccataagaaactctgaaagctctgaaaaggagaaggctgaagaagaagtaaaaggaataaagaaatactgagagtaaaggtaaaacgctagtaagtgactttcctaataattttgtaggttattagaccagagagtgggaataattaatttatgacactcactccatatcaagttgtatgaactgacagtcttacacatctttgaataacagcaaaatatctgttatatataaaat

SEQ ID NO: 141247 - DNA, 601 bp, Human
tgccaccatgcccagctaattttttgtatttttagtagagacgcggtttcaccatgttggtcaggctggtcttgaactcctgacctcaggtgatctacccacctcggcctcccaaagtgctgggcttacaggcatgagccaccatgcccagcctggtactacactattaaaaagtctcctgctagaaccatttaacaatctaatacatctgcctagaacacaaacatgatttttgttagtttgttaagtgtgatggtttcagctacagagcaaatagttcttaaaggtaaaggatcaaatrcaagtaaatacctttaatgttaaagtataaaatatggctatgaatcagacacattttgaaagagaagaattgacagcttccagtagctacactggttaatttacattctgaatcatctaagtctctccaatactttcttgtcctcattctggctatcatcaaggagaaggggaaatactttctctaggtcttcctgtccataagaaactctgaaagctctgaaaaggagaaggctgaagaagaagtaaaaggaataaagaaatactgagagtaaaggtaaaacgctagtaagtgactttc

SEQ ID NO: 141248 - DNA, 601 bp, Human
gtagccttttgtccaggcacagtggctcatgcctaaaatcccagcaccttgggaggccgaggtgggggaattgcttgagtccagaaattcaagcccagcctgggtgacatggtgaaaccctgtctctgcaaaaaatagaaaaattagctaagtgtggtggtatgcgcctgtagtcccagctactcggaaggctgaggcaggaggagagcttgagtccgggaggtggagactgcagtcaggttgagatcatgctactgcactccagcctgggcgacagaacaagactccatctcaaaactaaaaaaatcaagtggccttttggtccagtctttgctatactagataggattatatatattactatttagaatgtctcaaaagatcttttctgtgtagtttaatatttgtgaacctcaaaagaccagatgttcaggaaatgatcccttcacttttttttccccattggtacagagataaagttttctgaaaataaaatgagggcatataggttttgaactaaccattaagaatagttcagataacactgtatttttatcactgtccacatttaaaattatgtatcaacaaatacctttttgta

SEQ ID NO: 141249 - DNA, 601 bp, Human
attgtctgtctcctcccattagaatataaattccatgagggttggtttttgtctgacttgatcctttatctctagtacccagaacaatggctggcaaatggtgctcaaacgtctattaaatgcatcaatcaatatggaaagattccactggggtcagaagcaacctacagatagggattaagtgagcatcttcacagtttgatttcggagtgctaaaggacccacctactcccaaactgctgtgatacctgaatagcattaacagtaaacgctcaatcaatgttagctattttcatgtgcsaggtacttttctgagtactttacatgtattaactcagttaatccacatgctaaccctatgagatagattctattatctctttatggggggaaaccaaggcagagaggttcggtaagttggccaaggtcacaccactagtaaatggtagttttcatatatagaacacaaatgtctccttggaaaagtaacattaatatggatttgtttatcagattttctaacagagaagaccctgagggaaagagacataatacagattggatttaatcgaaatggggggcggggaacaaataaaaatgg

SEQ ID NO: 141250 - DNA, 601 bp, Human
ctcgtgcgcttgaatgtcaggaatgctttcctgaagagcttcttggaaacttgcttcagaaagcagttctaaaagaaacaacaacaaacaaaactccagcgtgttaaattggaaaacaaaaaagcactttagtatgtaggtaagcatttaacataacaaaagaaacacctcaacatttaatatataatatgcttattcttcatgtgtgtgctatgaatctgaaccagaatattagaaattcccaggcagttatttaaaaagtatctacacctgtaccccagcctatttaattcttaacttytggtgagtggagcctagacatctgcagttttttaaagatctccaggtgattctaatgtatagtcagggaaaatacaggaaagtctaaagaaaaaaaaagtaactgataatcctatcaattggagatgatataacattgtcatgcatttccttacaacttttttggtgtatatgagtatatatcttcatatatatatatatatcttcatccatatcttgaatctctatatatctctagatcttatatctgtatgtgtgtgtgtatatccatatcttacaaaattagaaatcacactgtagt

SEQ ID NO: 141251 - DNA, 601 bp, Human
tatcagcatgattacatttcttgatatgaatacaatattgctaaaattcatcctaaaattgcttttaattctttaaccgtaactattttttacattaagtggaatttatggtaaattataaacttcaggtgtatttttgacaactctatatctctacatgttatattcatgatagatttattgagatatatataccataaaatttatccatttaagtgtataaatgagtagttagtgtagtcacagagttgtgtggctatcaccactacctagttttaggaaattttcatctctccaaaawaatcctgtactcattagcagtcattccttattaccctcttcccccaatccctggcaaccacaaatctgtttctgtccctgttgacttacctgttctggacatttcaaataaatgaaatcatataatatgtggctttttatgcctagcttctttcacttagcacaatgttttcaaggttcatcatgttgttgtatcagtattgcattcctttttattgctgaatagtgttctttgtatgcatataccacattatgtttatcagttcatcagttggtggacatttaggttgcttctactttt

SEQ ID NO: 141252 - DNA, 601 bp, Human
atggagctagtgaaaatgaaaaaactcttgagagaggtaagattatcttcttttaaatccctctacactcacagtaagctctcaatctttactgtggcttcaaggctctgtcctttataagccctgcctaccttttaaacttctctcattcttgttccctttgctacagcaatactgccatcttgctgtgaaatgtgcacaccgattttatttccaacactgtatttttgtgctcgttgttccttgtgcttcactccctcccctctgctacccactttaaataatcacatggctttttttwatttatgtctaagcttaaatgtcaagagacttttcagaccatcctgtgtgaactgttcttttttttcccctcatgaccctgtctagtctgtctgtaataatttatttattggtttattttttgtctatgtttctcccgctagaatgtgagctgcataagtgaaagaaccttgtctgtctttgaattttatgaggaagagagagtgaattgacagactgtatattggaaatgttaaatggtaaatctaggaatccaaaagtttcctctatttaatatcaggcaaaattctgttcaggattt

SEQ ID NO: 141253 - DNA, 601 bp, Human
gatctgcctccatgacccaaacacctcccaccaggccccacctccaacactggggattacatttcaacatgagatttgggtggagacagatacccaaattaaattattaagtgttcaactttcaaggttatgtaagattagaacagtaaaatcataacactttggttatactataggtcaaatgttttctctgtaggtcaagaagattactaaatttttgtctttaaatcatcacctgtcatacaaaaaaccttgttcagtgccagtttttaaatagttttctcttgtttctgaagtattwtttcattttattttatgtgaaatgctagggtactgctatacagctaccctaaatggtgttgctttgttatagttaaatactgttgataaacactagattaaatttcaaaagacaaacccttttattacattgagatgttaacaagtcacattagtgtggagtatatttgattaaatatttttaagatatgcaaaatgatatctggattcatcagttatttcattcaggaagtgagctgcttatacgaatagttgtataattcgttcctttgcttttttatcaagattatcttcattattt

SEQ ID NO: 141254 - DNA, 601 bp, Human
ccacctccaacactggggattacatttcaacatgagatttgggtggagacagatacccaaattaaattattaagtgttcaactttcaaggttatgtaagattagaacagtaaaatcataacactttggttatactataggtcaaatgttttctctgtaggtcaagaagattactaaatttttgtctttaaatcatcacctgtcatacaaaaaaccttgttcagtgccagtttttaaatagttttctcttgtttctgaagtattatttcattttattttatgtgaaatgctagggtactgcyatacagctaccctaaatggtgttgctttgttatagttaaatactgttgataaacactagattaaatttcaaaagacaaacccttttattacattgagatgttaacaagtcacattagtgtggagtatatttgattaaatatttttaagatatgcaaaatgatatctggattcatcagttatttcattcaggaagtgagctgcttatacgaatagttgtataattcgttcctttgcttttttatcaagattatcttcattatttgataaacatttttaatgattattaaaataatgccgta

SEQ ID NO: 141255 - DNA, 601 bp, Human
gcacgtgtgtgtagtactcagttttaaaatttaattatgaaattttaaaaaattgtttttcattttttgtatgagtttctgaaccattttttaaaaccattattttggtatactttacacttacagaaaagttgaaaaatagaataaggggctgggtgtggtggctcatacctgtaatcccaacactttgggaagttgagtcaagaggatcacttgaggccaagagttcaagaccagcctgggcaacacagtgagacttcgtctttacaaaatataaaaaagttagctggctgtggtggcrcatacctacagtctcaattacacgggaggctgagcagaaggatcacttaagcttagggatatcctgtctcacaaaaaaaaaaaaaaaaagattagcataaggaacttccttatattcttaacccacattcaccaattgtaaaacactcattttaaagttgttaactttctcctaaatagttttgagcctctgctgtgtatgaaattctttaatatttggaccttatctcaaaaaaagttttaaaatattgtacattcgtacaggataattttatttgaaaagttaacatatatctccatc

SEQ ID NO: 141256 - DNA, 601 bp, Human
tttttgtatgagtttctgaaccattttttaaaaccattattttggtatactttacacttacagaaaagttgaaaaatagaataaggggctgggtgtggtggctcatacctgtaatcccaacactttgggaagttgagtcaagaggatcacttgaggccaagagttcaagaccagcctgggcaacacagtgagacttcgtctttacaaaatataaaaaagttagctggctgtggtggcgcatacctacagtctcaattacacgggaggctgagcagaaggatcacttaagcttagggatatyctgtctcacaaaaaaaaaaaaaaaaagattagcataaggaacttccttatattcttaacccacattcaccaattgtaaaacactcattttaaagttgttaactttctcctaaatagttttgagcctctgctgtgtatgaaattctttaatatttggaccttatctcaaaaaaagttttaaaatattgtacattcgtacaggataattttatttgaaaagttaacatatatctccatctcagtatttaagctacagtgcaaattgatttatttattttctctttttgccttttctaaagta

SEQ ID NO: 141257 - DNA, 601 bp, Human
tatcctgtctcacaaaaaaaaaaaaaaaaagattagcataaggaacttccttatattcttaacccacattcaccaattgtaaaacactcattttaaagttgttaactttctcctaaatagttttgagcctctgctgtgtatgaaattctttaatatttggaccttatctcaaaaaaagttttaaaatattgtacattcgtacaggataattttatttgaaaagttaacatatatctccatctcagtatttaagctacagtgcaaattgatttatttattttctctttttgccttttctaargtaagtccagattcatgtatttctgctaaagaaagcctcaaagagacttattatggtccttaatgtacttcattttaatatccttttcatattttaagcttatttgttgatggtgactaatgactttggagtatgggcaaatcttaataggaaagacaccctctttaaggtagaaactatactaattccatgacatggaggaaaattcttcataccttgttgctgctttatctaatcataaaaatatattttattttcacccatttggctacaagcagaatttaaaaattaccaaactct

SEQ ID NO: 141258 - DNA, 601 bp, Human
gtatttgagctaggtggtgtaatatgatttttttgttgttgttttatctttaaagtcacttgttttaaaatcacttttcttcttgctattttagagctttcacatattataaaatggggaatctggacaacagaatagctaatccagaccagctgcttacacaagatgtagaaaaattttgtaacagtgtagtcgatctgtattcaaatcttagtaaggtaagtttctctcctttttaaaagattatttgtttaattttttgaattttgaatctaagcaaatttatatagaattgattttrtggacataacagcagcatgtaaatatttaatgcttttataagaaaattagagttgttgtaatagttttaattattttaattttttctattatttttgtgaggtactttggcaaagaactgataatttagtgtcttataaggattttctaagaattttgcaggttgattccattaaaacaacagaaatttgaattctcatcttttgacctgtgtgcatccggccattgttagagattgactgtcaatttatgtttctaactccacacttataacactagactaggacttcctttctgccca

SEQ ID NO: 141259 - DNA, 601 bp, Human
acatatgtgtatgtgtgtatatgcatttcagttgattaataaattatttccatactggtttttgttgctttccaaaacactggaaaagcagggttttggttttgctttgttttgtttttcgaatttttctgtttattttcctaattctttgctgtcttgtgatccaggttttatcattcttgtattttgttttactataaccaagtgaataggccaaatccttcttgtctccttgcagtcatatttttatggtacttaactacatttttgtgatacttaaatatgtctccatgtctacttrttatctgattctgcatttcttaaaggcagaaactgttttagttatctttttggtccacatttgtagtagttgttgatatgcattgaattgatcagatttacttttttttttttaatcttgaatacttactagcccatatattgtgctagatagtaggaataaaaagataagtaagacacaattcctgctgaagaggaattacaatgtggtaaaacaggtagatagtcaaacaattatgatgcagcatgataaagtttagtaatagaagtttcaagaaagtatttagtgccaagaagaact

SEQ ID NO: 141260 - DNA, 601 bp, Human
tgctttgttttgtttttcgaatttttctgtttattttcctaattctttgctgtcttgtgatccaggttttatcattcttgtattttgttttactataaccaagtgaataggccaaatccttcttgtctccttgcagtcatatttttatggtacttaactacatttttgtgatacttaaatatgtctccatgtctacttgttatctgattctgcatttcttaaaggcagaaactgttttagttatctttttggtccacatttgtagtagttgttgatatgcattgaattgatcagatttacttttttttttttaatcttgaatacttactagcccatatattgtgctagatagtaggaataaaaagataagtaagacacaattcctgctgaagaggaattacaatgtggtaaaacaggtagatagtcaaacaattatgatgcagcatgataaagtttagtaatagaagtttcaagaaagtatttagtgccaagaagaactggaggtgatatctgagctactttggggaggtaagtaaacatccattagattatgtcaggcttgccaaacataagaacaacctcactgaatggaaactgttca

SEQ ID NO: 141261 - DNA, 601 bp, Human
gtgtttgggatgagccagttgcggtggctcacccctgtaatcccagcactttgggaggctgaggcgggcagatcagttgaggtcaggagttcgagaccagcctgaccaacatggcaaaaccccatctctactaaaaatacaaaaattagccggttgttgtggcgggggcctataatcccagctactcgggaggctgaggcaggagaatcactggaacccaggaggcggaggttgcattgagccaagatggcaccactgcactccagccttggcgacagagtgagactctgtctcaaaaagyaaataaagtgtatgggatgtcgtactcaggtatatgcaaatactatgccatttttcatcagggacttgagcatccatggattttggtatccagaaggtcctggaaccaatcccatcccctttggataccgagggatgactgtattacagtctctaattatcttgtttactagttatgctctttcattagaatgtaaactccataaattcagggaccttctctgttctattcattgtatctccagcttgagcacagtgtctgacacatggtagtcattgaataaatgttccagagattgtc

SEQ ID NO: 141262 - DNA, 601 bp, Human
gttatgcaaagtactttgaacttattcaacaatgagtattctatcgttatcatatttattccaaagccaggaaatacaagaagtacagaaaatgtaaatgtagttggtaaatattgactggctccacatatcacagaagtgttttctcacatagctccaggtacttcagtcacttgaatgttcctttggcaaagtaggtagccaggcttgatttccagtagcccctttattgccactgtccaaggataaaaaggacgtgagacttcgttgaagaatgcctcttgtccctttctcctacttaccctcacttctgtctttatgcagaaataaaatataccaataatataggggcacacatgactgaagcacaatgagaaagggggttgggatacttagaatagatggatcatgattatggtccataataatattttgtcttgatgttaccacactaaagctgtcactttctttttagttcaaagccttttcttttaaagcccttatgtttgtattgaatagacttctgtcgtttctataatttcacttttatagtcttaaaaatgtcctagaagaaaacctaggcattaccattcaggacata

SEQ ID NO: 141263 - DNA, 601 bp, Human
taaatgtagttggtaaatattgactggctccacatatcacagaagtgttttctcacatagctccaggtacttcagtcacttgaatgttcctttggcaaagtaggtagccaggcttgatttccagtagcccctttattgccactgtccaaggataaaaaggacgtgagacttcgttgaagaatgcctcttgtccctttctcctacttaccctcacttctgtctttatgcagaaataaaatataccaataatataggggcacacatgactgaagcacaatgagaaagggggttgggatacttrgaatagatggatcatgattatggtccataataatattttgtcttgatgttaccacactaaagctgtcactttctttttagttcaaagccttttcttttaaagcccttatgtttgtattgaatagacttctgtcgtttctataatttcacttttatagtcttaaaaatgtcctagaagaaaacctaggcattaccattcaggacataggcatgggcaaggacttcatgtctaaaacaccaaaagcaatggcaacaaaagccaaaattgacaaatgggatctaattaaactaaagagcttct

SEQ ID NO: 141264 - DNA, 601 bp, Human
aatactatgcagccataaaaaaatgatgagttcatgtcctttgtagggacatggatgaaattggaaatcatcattctcagtaaactatcgcaaggacaaaaaaccaaacaccgcatattctcactcataggtgggaattgaacaatgagaacacatggacacaggaaggggaacatcacactctggggactgttgtggggtggggtcctgggggagggatagcattaggagatatacctaatgctaaatgacaagttaatgggtgcagcacaccagcatgtcacatgtatacatatgtaaytaacctgcacattgtgcacatgtaccctaaaacttaaagtataataataataaaattaaaaaaagaacaataactaccctgtattaaaatacatcaaaatgtttaaattaatgagtttattatgatactcattatgttgaaaagtgacaaagggaaaaaaatgtctttaattctttctcttttttgggtttcatttggaaagtcttgagtccccacttatgtccttacttgttggagtgttttacttcataaccatgttccttacttcctggtgtttatcctgtgattcttgttttctcc

SEQ ID NO: 141265 - DNA, 601 bp, Human
agacagggttttaccatgttggccaggctgtaccagctttttatgggtggtaaaggtgggggctagaacagtcttcttttagttaaatcctaattcaccccttctttcaaagttttacttagttgtcatattcaataaagtctgctctgaccaccttaaaaatgcggctttcctcacccgctcccaagttccctttgtctgttttttcctccaaagtacttattttctaatatactatttaacttatatgttatgtatattctttattgtatgtctcttaccactagaatgtaaaccagtmagggtagaggtttttggttttttgttttcattttttgtctctttaattcattaatatggcctacttgcctagaacagagcctgacagagagcattcaataaatattcattgaattaaataataggaacagaaggctcaccagcttaacaaatttgttaaaggcaggttaccagctagggtaactcatatctttctgatattttctttcctattgtgttgcattggtgtttagtgttgtaagctagaattatagctaagattttctgattctttacagagttgatcagatacttacaagat

SEQ ID NO: 141266 - DNA, 601 bp, Human
cgtgaaggaggctgggacagtgttcaggattggatggacgtactcagtggtggagaaaagcaaagaatggcggtaagtatactgtgaagaagttgcacaagaatgcaactggttccagcattttgattaatcaggacacaaagtttcatcttatatttttttattcagcagctgtttcagtatggattagtttaaattatcataaaagtgcttgaaaatctttaacttgcatgtaaatttggaattctgaaaaattcataaataccctgccagtatctatgaaaggaaaagctgcagatcygactatataccaataatccatttttctaaaagttcagagaaactctgtagctcattattcctgggatataaggtaatcctggctgggttatgaaatttcttctcatgtctcttccctatagacatctcttttgtatcactcaggctattctttctgaaatagctgaaggtattagaaacgatccattcaaattttatctttattctgttcttgcccttttcctccactattatatgtatgtttttgtttcaaggttcagtatctactacttaaagttacttagaatttttaagttttcct

SEQ ID NO: 141267 - DNA, 601 bp, Human
caaagtttcatcttatatttttttattcagcagctgtttcagtatggattagtttaaattatcataaaagtgcttgaaaatctttaacttgcatgtaaatttggaattctgaaaaattcataaataccctgccagtatctatgaaaggaaaagctgcagatccgactatataccaataatccatttttctaaaagttcagagaaactctgtagctcattattcctgggatataaggtaatcctggctgggttatgaaatttcttctcatgtctcttccctatagacatctcttttgtatcrctcaggctattctttctgaaatagctgaaggtattagaaacgatccattcaaattttatctttattctgttcttgcccttttcctccactattatatgtatgtttttgtttcaaggttcagtatctactacttaaagttacttagaatttttaagttttcctaatataaacaagcatttgaaagaaactactttaattgttatgatgactaaacttgtctcaaaccaaaaatatgcgctaaacactacgtagtaagaatgagaccagcctgggcaacatagcaagaccctttctctacaa

SEQ ID NO: 141268 - DNA, 601 bp, Human
tggaaggatgtggttcagaaatggacacgacggaaactcagagaatgaataatgaatgtacttaaaccaaggaacagtgtgtgtgtggtataaaagtacaggagggataattttgatttgaagattaggaattcaaaggcgtgcccagagcagtggggggctgaggcgggagaatcacttcaacccgggaggcataggctgcagtgagccaagatcatgccactacactctagccagggcaacagagcaagactctgtctcaaaagaaaaaaaaaaaaaaaaaaacacatgatccataatrgaggcgtttgggaaatggggaaagctcacctgtgacaccactgcatatataactggagcatggccaagccattgtctagagaattgaatgtgatgtgtaaaagagagcctgttgttttgtttcagagggtggaaaggagaaggctaacgctacaaatactaacgttggtgaaattaggtaaagattatatatgtgtattcattttactgtcctttcagttttttggtaggattgaaaattaccaaagtagaaagttgaggggaaagtaggtattagaatttttaggaagaacagacctaa

SEQ ID NO: 141269 - DNA, 601 bp, Human
aatctgaaagctctaaggaacagaataaggcatttgagacatcagaaaagaatgatgtgtgtttaaggctctaaggtgtaaagcaccttgttcctagcagttgagaggaggcggtgttggctagaatgttggggttagagcgtgagtagaaataagattgtgcaggtcttgtagactgtggtaaggagtttgagttttaagtgaaatgggaagttgttgaagggttttaagccagagagtgaagttccctgattgacatttgtgaaagatgttctctggttacatggagagtggactggaraggagcagcagaagtggtaggaggctacttgtagtctatccagacaggagatgagtgtgctctgggctaagggcatgtttgtggagatgaggaaaagtgagtgaacttgaaacttcacatttctttcttgaatggactttttagttcattttaaaaatagctgtgggagagtgaaagggaagaggaaaagggaaggaccagaccagggaggactcctggctttctagctggagcaactgtttgatagtttcatttgctgaagtgttcaagattagggaagggaatggattttagagggaa

SEQ ID NO: 141270 - DNA, 601 bp, Human
aattttgatgttaattttcatttataaaattagcaaaggcttaaaaaaatgagcacaaccagaactgacaatggggatataaaacaggtacaataaaaattattggtgagaatattaattggtaccattacttaagcaacaaaatatttaaaatagagacctttttgcgtcggagtcatctagtctgaattctgagatttggttaaaatatgtactctgtaatcttatttgtttagtgagctttctttaatactagtttgaaacttcctctctcatcagtcttaaggtttgtgttttactytgagcaattagtatttcccatgaagtacgtttttccctttgttcaggatgacagcaaaaacagttatgtttatattgtttctatttctgggaagtagattttttgaattagaataatttttatacttttgatttacaagactacaaatgcatatttaacataagtttgtttcggcttactaattttaggtctgcctgtgttttacacaaaaaattttttttatgcttcagatggcaagattattttatcataaaccccagtttgccattttggatgaatgcacaagtgcagttagtgtcg

SEQ ID NO: 141271 - DNA, 601 bp, Human
ttcttccagttgatcacatcggctcctgaggcttctgcattcttcacatagttcttgagccttggttttcagctccatcagctcctttaagcacttctctgtattggttattctagttatacattcttctaaacttttttcaaagttttcagcttctttgcctttggtttgaatttcctcccgtagctcggagtaatttgatcgtctgaagccttcttctctcagctcgtcaaagtcattctccgtccagctttgttccgttgctggtgaggaactgcgttcctttggaggaggagaggckctctgctttttagagtttccagtttttctgctctgttttttccccatctttgtggttttatctacttttggtctttggtgaccgtgatgtacagatgggtttttggtgtggatgtcctttctgtttgttagttttccttctaacagacaggaccctcactactgatttcttctcttctttcctccctttttcctttttttccttcctaaatgatatagaaattttaggtagtcatgtaaaagatatctcattgatatataaatgagatataaaagatacctcatttatgtaaaacaacat

SEQ ID NO: 141272 - DNA, 601 bp, Human
attcatggagtccaaagatgaatgaatcaaacactgcttaagggcaatgtatacattgggattcctccccacctcttccctaaggtgttagacattgttcacagtctagacagcaacagaaaaagacatcaatgtttagatgagattaattaatctatcatgacccaaagcacacttcagtgcctactcaagatggttcatctctccacagtttatactccacttaggaactctcccatcatttccaaaaacaattaaaacaattaaaatgttctatcagtttaaggtctggaaatgttgyaggcctaatagagtatgacaccggccagcgaattgccaagaatcccttcttcttcgtcatctgttaaataatttcatccagtaatcagctttaaagacattcttgttcagcataggacagtagaaacatcaaagaccttaattttctttttctgtacccagcttaccttatttgaacagtgtagacttgattgacgggtttgggttcccactccaaaattgtcttgaaattagttgatttccaagttaaattatatgctgccacagtatttgtagtgcctttaaacaacagagaaacagc

SEQ ID NO: 141273 - DNA, 601 bp, Human
accatcaaggaagtcataacctttagattgaacatgctgaattatcgcctcctggggacagctgccagtcagagttgaagcaccaagaagcagagccacaccagacccagagggtgcagacagcagagtatttctgctctgccaggctcagtgagtcacgcatttggcctcctccactaagatcatgtattctaccagatttcgattcatggagtccaaagatgaatgaatcaaacactgcttaagggcaatgtatacattgggattcctccccacctcttccctaaggtgttagacattkttcacagtctagacagcaacagaaaaagacatcaatgtttagatgagattaattaatctatcatgacccaaagcacacttcagtgcctactcaagatggttcatctctccacagtttatactccacttaggaactctcccatcatttccaaaaacaattaaaacaattaaaatgttctatcagtttaaggtctggaaatgttgcaggcctaatagagtatgacaccggccagcgaattgccaagaatcccttcttcttcgtcatctgttaaataatttcatccagtaatcagctttaaag

SEQ ID NO: 141274 - DNA, 601 bp, Human
ccagaagctttgtaaattcagctttagaattcagaacatttccatggaatgaatatcaccggtgacggtttgtgctaaggcttaagccaataacatttcccaaccaccactgaaaactgttagcaaaggtgaaaaatgcagttggagttccaagtaggggcttctgcacagcagtagtgtcctgcggctggagccaggctgcagtagtgagagcagtcgggagggaagagaggcagctgcttaagatgctaactgtagggagggaaaacaggcagagaggaaggccaactgaggagatgcmgtgggcaagactttccttcttcctcccgctttggagcctcccatcagactgtggcagagccacctgagggatggtggtgtgtggatactgggtagactttggttccagacctgacatgggcactcaccatcagtgtagtcatgaataaatccctcacttctcagagcaacagtttcctcaactgtaaaatgactgctctggtcctttttaaccaggaatctcatttattcctggggtgggcaggagaagagtgcacacctcaggccgaggctgatggaaaagctcccaggccctccagta

SEQ ID NO: 141275 - DNA, 601 bp, Human
caaaaccctctgatttggaattttgagttaactaaaaaattcagtcactaatttggttgcaggttgttttccagaagctttgtaaattcagctttagaattcagaacatttccatggaatgaatatcaccggtgacggtttgtgctaaggcttaagccaataacatttcccaaccaccactgaaaactgttagcaaaggtgaaaaatgcagttggagttccaagtaggggcttctgcacagcagtagtgtcctgcggctggagccaggctgcagtagtgagagcagtcgggagggaagagrggcagctgcttaagatgctaactgtagggagggaaaacaggcagagaggaaggccaactgaggagatgcagtgggcaagactttccttcttcctcccgctttggagcctcccatcagactgtggcagagccacctgagggatggtggtgtgtggatactgggtagactttggttccagacctgacatgggcactcaccatcagtgtagtcatgaataaatccctcacttctcagagcaacagtttcctcaactgtaaaatgactgctctggtcctttttaaccaggaatctcatttattc

SEQ ID NO: 141276 - DNA, 601 bp, Human
ttctcttccttataattctttctcttccttccttctttcttttcttttcttttcttttttttctttctttccctttcttttttagacagagtctcgctctgtcacccaggccggagtgcagtggcgcaatctcagttcgctgcaacctcctccacctgggttgaagtgattctcctgcctcagcctcccaagtagctgggattacaggcacccacaaccacgcctggctaatttttgtatttttagtagagatggggtttcaccatgttggccaggctggtcttgaactcctgacctcaartgatccacccgccttagcatcccaaagttctgagattacaggcacgagccaccatgcccagcctcttttccttataattttcttaataacattttctttcctctagcttactttattgtaagaatacagtatataatacacgcaacatgaaaaatgtgtgttaattgactgtttatcttattggtaaggctgcagtcaacagtcaaccgataggtaggctattagtagttaagtttttggggagtcaagttatactcggattttcaactgcacagggagtcggtgcctctcagccatgca

SEQ ID NO: 141277 - DNA, 601 bp, Human
gctgggactacagacacgtgcaaccacacccagctactttttgtattttgagtagagatgggcttttaccatgttggccaggctggtcccaaactcctgacctcaagtgatttgcctgtctgggcctcccaaagtgcagggactacaggcgtgagccaccacacccagcgtaagccatcgtttatatcccctgactcttttcttcactgaaagtactcagaatactttccctgtaaggcatggatcgagacacacaggcttgcagcttcctgcaagagtctgaaggcccacagcacttccrgttagggactgttcctcgcacaatgggcctgagctcccaacatatgcacatgcatgtacacacacgtgtccgccatatacacacatgcatgcatgtgggtatatttgatatactcaatcccttcccttgatgggttagactctacagcctctgtggcaacagcccacagtgggtactcacgaatgtctactgtgtcctgctgcagctggtccagaagccacccccagaattagaatttaagcatgaaaaaatgcccagggaaatctgtgacttgttgctaaatcctaaacacagtttgtg

SEQ ID NO: 141278 - DNA, 601 bp, Human
actgaggcccagaaccatggatgtagagaaaagtcaattaacttctagtctatggaataaacaattaaaaagtaatgttgagtggaaatgtttccttctctctttcattttcagcagtctcagtgacattgctgcagacttcaaataaataactgtctgctctccagcacatcttttgaaattgtctctaggggtcccttttataccacctcatttctcttccttgcctctctttgtcttgtaaggtctctttctctctcttttttattgcccctcacctctaatatccccacctctttgsatgtttagtctggcttttctggcctcctctgcatctcagacaatttctttggaatccttggcgtttgccgggagcactagcgtatcagaatctgcagttcctgtttgagaactgcccagggcccatttccatctttccctgctgtgttccccaaaatccttcagggaatccagccttcaaagacactgcagttacattcccacttttctccccatctgtcctcctccaaaaccactgcagctgcagagattaggacttcgtggagtgaggaagctgcagggtttccagagtggactttgc

SEQ ID NO: 141279 - DNA, 601 bp, Human
tagcttttcctcaggcagatcttttgttttattctttcgcagtttctgctctcatcttgctggatgagggctgcaaagcagacaaggtgacccgcctaactggccttcctaccttcctcctgttttttctcctttttttcctcttttgctttctccatttcttcctcattttctccctttcttccataaaaattctctgagtgcctatacaataacattctatgcctcctaaatatagtctgggccttcctgtttcttctccaaaaatgtaatctcccaggcactcagaaagatactcacractaccacaaatggggaaatgctaaggattcttacatgaaaaaagctgaggcattaggaaaggaggagcttgatgattggaatgcaaggccagaggaagtcccacttgggatctctttctcatttcaaagagtaggtaactactcttggaagttgttgaagcttttaagaagcaaagtggtgagtttctcaacacctttaccaattaacaatttaatttaacccctcctctgttggtaaatctttacagaattgggatgagctctgtcttggatggagtctgtttctaacaaatgctctc

SEQ ID NO: 141280 - DNA, 601 bp, Human
atacaataattactgaactttttgtagaaagtagatctcttttacttaaaaacgattttatttttatgaggcattgcttataaaaggcaaagtgttaacaaatcagttaaatttatctgcaattattatcgatgcatagaatgaatcctattcattgctgcccatataatacttttctgaaaatagaaatctctcactttttaagtatactttttcctcctttttttggattttgtttattatttcttaggctctgaaagactatgaacttttgaggagctttatgtaaatagttttttgttttttttggcaaatcattaacatgttaaacgtactttgaaacctgggtgaattttttctaatgtaaatcaacagatcctaatatttctgttatcttatattttagaatctttttgcagttcaagagttcttgaaatagtaaacgctggtgttacaggagactagtgttttatattttgcattggttttagtaatttgtgattggcgtgtttatttctgatttcttgaagtccaattttaaattttgagtaaaatgtcccgttggagacccatcaagcattattaataaagttgaaatgct

SEQ ID NO: 141281 - DNA, 601 bp, Human
gaattgctggtatgggtattagaagaaatccatgagaactggaagaggacaggggaaagtgatctagatccaagtcaccaatggcataggagaaactgggaaagctgacattcttccaaagaggtgctcagtagaagaccatgtacttagaaggcttacctatatcattcatctttggctgttagccaaaattgaattaatctgaatattgaaagttatctctaggctaggtctcaagagcaagtaaatgaaagcagaaatcatttatgccttctaataataatagctagcaattttgttaaaaaaaaaaaaaaaaaaaagcccaggcgtggtggctcacccctgtaatcccagcactttgggaggccgaggcgggtggatcacgaggtcaggagatcgagaccatcctggctaacacggtgaaaccccgtctctcctaaaaaatacaaaaaaaattagcagggcgtggtggcgggtgcctgtagtcccagctactcgggaggctgaggcaggagaatggcgtgaacccgggaggcggagcttgcagtgagtcgagattgcgccactgcactccagcctgggcgacagagcgagattccat

SEQ ID NO: 141282 - DNA, 601 bp, Human
tagaaggcttacctatatcattcatctttggctgttagccaaaattgaattaatctgaatattgaaagttatctctaggctaggtctcaagagcaagtaaatgaaagcagaaatcatttatgccttctaataataatagctagcaattttgttaaaaaaaaaaaaaaaaaaaagcccaggcgtggtggctcacccctgtaatcccagcactttgggaggccgaggcgggtggatcacgaggtcaggagatcgagaccatcctggctaacacggtgaaaccccgtctctcctaaaaaatacaaaaaaaattagcagggcgtggtggcgggtgcctgtagtcccagctactcgggaggctgaggcaggagaatggcgtgaacccgggaggcggagcttgcagtgagtcgagattgcgccactgcactccagcctgggcgacagagcgagattccatctcaaaaaaaaaaaaacaaaaaaaaacttagcacgtacagtgctctgtgttggatacttacacgcgttacttcattacttacagcttttagaggtaagtgtctgcaaggttagcttcattttatgactgagaaattgtgtctctgag

SEQ ID NO: 141283 - DNA, 601 bp, Human
aaaaaaaaaaaaaaaagcccaggcgtggtggctcacccctgtaatcccagcactttgggaggccgaggcgggtggatcacgaggtcaggagatcgagaccatcctggctaacacggtgaaaccccgtctctcctaaaaaatacaaaaaaaattagcagggcgtggtggcgggtgcctgtagtcccagctactcgggaggctgaggcaggagaatggcgtgaacccgggaggcggagcttgcagtgagtcgagattgcgccactgcactccagcctgggcgacagagcgagattccatctcaaaaaaaaaaaaacaaaaaaaaacttagcacgtacagtgctctgtgttggatacttacacgcgttacttcattacttacagcttttagaggtaagtgtctgcaaggttagcttcattttatgactgagaaattgtgtctctgagatgaaagtaatttgcccaaggtcacatagatattaagtgataaatgtgttgttcaaacccaaaaccctcttgttctaccaaactacaaccaatctacacacgtctttttattttttaatttttttattagggaaagcgtacatatttggagagaata

SEQ ID NO: 141284 - DNA, 601 bp, Human
aatgcaaattataacgtatctcacgaaattgttgtgaggactagaaataatatccattaaatgcttagcggaaccctctcttttatttgaaactcattggtggttattattagtttgtttttaataaagaagtagtagtatttgctgtcctcaattcaagagctcttaatttaaattgagaagttaaataaattcataataaagaagtagggaactgagcatagccaacagaccatcttttgcactgggtagatctaaaaccatgtatgaagttaatggacactttatgtagaacaatggrtagatgaattcaacacacagtatttataagggctcataatgcaatgacagtatactgcttatgactacttatttagagaatgtaaagtgagcagcttctatgttatctgagaatcacctcctcaaatgccaactggaggttgctggtaaggagtacccaaatcttcataataggtctataagtttatacatctgtaaatggaaactcaatgagaggtgaataatagagggaaggctaaaaatctacacagtattccagctatcttctctggattgtgattattggttcctatggtagata

SEQ ID NO: 141285 - DNA, 601 bp, Human
tgtaggaacttgcctaaaatcagaaaatttgtggtctctaaaatccaaattggatcgatgctctttttactcacttcaccttgtttttatattcactatgtagcttttgtatgaggtactatctctgtttcaccaattcatttgttctttcaacaaatatttattggacatcatttgcctagcactaagtgaactaaaacaaccataatccctgccttcatggagattagagtctagctggaggaatggatattaaacaaataatcacaaaatggcaccacttacaattaattaagtgctrtagacgaaaatagtaatgctgtaagaaagtgtaacaaggagacctatatttggggctgcttgaaataatagactccaggaaaatccactgaggtctggatttccagttttgcctcctgagattgctactaacactcgtttaccattgctgggcctgacaaaggaggcttattactgcatttctttttgaaaagaggattatgggtcttcctcccaggatttaccatctcccattttattcctcactcacaaggctccagtaacagaggacaatagagcttttgatgttggtaaatctcca

SEQ ID NO: 141286 - DNA, 601 bp, Human
agcagtaagaatctattggaagctttagaaaggaagtgatttgatcggacttgcattttcaaaagatacttttggagaatggattaagaagatgctagatggaagcagaccagtttggaggctattgcagttgcccagatgacagatgatgttccttttgatatggcacaaattcagagacttgtataaatctgagagaatttaggaggtagatcatcggggagcgtggctgtgtttgtaaggaaagaaaaagaggagagagagactgtttatgaatgattgggtaaatggtggtataatycttcagacagagaatccacaccaagtatctattcttttttttggtgactcttaacaatagccaagaagttaatccaaaaaatgacactccctttacattgttctaaaaaagaacttttcggaataaaaatgtgactcacatcaaactctcaccagccaacagggtctgcaatgcccccagactactgaattaccattcaattccactgaggtttcctcagggctacagtttttgtcaagtgttcccaatctttttcagcagcactgctttatacttctaagacttagtaatgccaacaac

SEQ ID NO: 141287 - DNA, 601 bp, Human
caatagccaagaagttaatccaaaaaatgacactccctttacattgttctaaaaaagaacttttcggaataaaaatgtgactcacatcaaactctcaccagccaacagggtctgcaatgcccccagactactgaattaccattcaattccactgaggtttcctcagggctacagtttttgtcaagtgttcccaatctttttcagcagcactgctttatacttctaagacttagtaatgccaacaactttttcaagctcccaaggttagtagttgatcgaaagaacacatagtgacaaatagctactataaatttagaaatgttaaaattaattcatattttattaatagtgatagaattgacatgaatttgaaaaataatgcaatatgtgaaagaaaccctattcagtttccaaagcttagtgttcatttgcattcacagactcttggcaataatttgttggattcccccaccttcagacttcaccccagcaatcgacagaccaaattttatttttcaagatgaacattttgtttgaaataagaaacaaagctaatattaacatgatctttttaagaatttcacattctttagaaaccaaa

SEQ ID NO: 141288 - DNA, 601 bp, Human
ataacagaactgatgcattataagatgatttggtttccaggtatatttaaaatttattcaaatttttaaaaataaagttctatagttttctccataaaattttgccacagttttatgaggtgtattcctaggcatcttacatgattttggtcttgatgtaaagagagtctcatagagtctcacttttttttttttttttttttttttttagaaggagtctgcctctgtcgcccaggctggagtgcggtggcgcgatctcggccccctgcaagctccgcctcccgagttcactccattctcstgcctcagcctccggagtagctgggactacaggcggccgccactacgccaggctaattttttttgtatttttagtagagacggggtttcactgtgttagccaggatggtctcgctctcctgacctcgtgatccgcctgcctcggcctcccaaagtgctgggattacaggcgtgagccaccatgaccggcccaagtctcacttttttaacgtcactttgctataggttttttggtatgaacctttatcaggttaaggatattcgttctagtcttaatttattgagagttttctttttcttt

SEQ ID NO: 141289 - DNA, 601 bp, Human
gagtgtagtgctgtgatcacggctcactgcagcctccacctcctgggctcaagcaatcctccttcctcagcctcccaagtagctggaactacaggcacacaccaccatgcccagctaatctttccttcttgctttcttacccttctttccttccttcctctcttttcttttctcttcttttctatgtattttttgtagagacagggtttcaccatgttacccaggctggtctcaagcttctggactcaagcaatccacctgccctgcctcccaaagtgctgggattacaggcatgagccaycatgcccagcctattaaactttttgtaggagatggccaagagctgaacctcttccttctggattgcaggtactgggaaggtagaaatgcaggctggttgctggtcacctcccaacccgggagggaagcagaggaggaattcagattcctaaagtcaggagaaaataagaataaaagggcatccatcattagcttaaaatacaagggactacctacctctgaataatttgaaggttaaatcattgaagacagtccataaaataattgaaataacacaatagtgggagttaggaaacctggt

SEQ ID NO: 141290 - DNA, 601 bp, Human
tgatcacggctcactgcagcctccacctcctgggctcaagcaatcctccttcctcagcctcccaagtagctggaactacaggcacacaccaccatgcccagctaatctttccttcttgctttcttacccttctttccttccttcctctcttttcttttctcttcttttctatgtattttttgtagagacagggtttcaccatgttacccaggctggtctcaagcttctggactcaagcaatccacctgccctgcctcccaaagtgctgggattacaggcatgagccatcatgcccagcctrttaaactttttgtaggagatggccaagagctgaacctcttccttctggattgcaggtactgggaaggtagaaatgcaggctggttgctggtcacctcccaacccgggagggaagcagaggaggaattcagattcctaaagtcaggagaaaataagaataaaagggcatccatcattagcttaaaatacaagggactacctacctctgaataatttgaaggttaaatcattgaagacagtccataaaataattgaaataacacaatagtgggagttaggaaacctggttgtttttctaagt

SEQ ID NO: 141291 - DNA, 601 bp, Human
agcacatgctacctgtgctctcagaaggcccacggctgggagggaggcaggtggaggaggccatacaacttgccaagtcaaacacaccggaaggtctaattttagtccccctagccttggcattgtctctttcagcaaagatatttttcatgcactacaataaagtgctttgttccagccttgctggatacttcacaaaggcccagcaaggacagcataagcctaaatcagagctggaaacacatcaaacacagggacctcacagaagagggtcagcattcctctcgtaacctttggtaartacgttctttccatccagcttccaaaaccctaagaaggaacacttggttgtgcttctccttctacgcaactcctcttcctccagcttcttttttgtgaatcttctgttggctcctcatcaacaagtgtgttttctccttcatgccagggatttgaaaacctactccctctttttgtccctgcctaacaaagcccccttctttctttctttctttttttttatttttttttttgagacggagtctcgctctgtcgcccaagctggagtgcagtggtgcaatcttggctcactgcaagctcc

SEQ ID NO: 141292 - DNA, 601 bp, Human
atatagttttaatttccctttatttgctatgctcccattcccttcctccattatattgtatttaatatatgtcctcaggtaagggtttatccttgaaaatatacagagtttatttgtacatttgtgtgttttcacttaaataaatgacattgagtcaatacccacccatatccatcaatgtagatatacattatcacttttaatggcttcataatttccattcattgctctaaagaaatttatttagccagtttcctgtgatggacctttaggtagtttttaaaagaggtttttaaaaatkattttaaacaatgctgaagtaaacaccctttgtatatatgtcttaacaggcttgtgtcattatttccttgagataatttcgagagaccactttataaaatattccttacccaatctctcaaagaagctttgttgctggtttcctagaaagaagcgtgttctctctctcttcctcatgacactgcttttctctccctaacagcacttagtacagtcatctttaagcttcgtttcatacgttctctcttatcgctcaactgataagctcttgctgttaatgggagggattacatagtaatta

SEQ ID NO: 141293 - DNA, 601 bp, Human
agggaaagtgtaggcccaagtgagcaggtctgggaagccatgctcacagttggaattcagagtgaggataatgagagaccactgaagggtttaagcagggcagtgacatgattgggttttgtgttttagaaaggtcattccagctatgatagtatggaagatggaattcaggagggtaagactttagatggagaagcaagttaggaagctattgtactactcaaagtgataggataatggcttgaaccaaagtagtggcaacagagaaaagtagatggaatcaagagttagaaagtagaayctaccaacttcttaacttgttgataggtttacatacagaaacacgaaatagagaagttcagaatgatgcccagactctgcatggaaccttgtgaagatggcgggccacttactcggagaggaacaaagaataaaaggatgttttaggggaaaaaggaggacaaattcatgtttgcatagtatgttgagtttgatgtggtggtagaatacaatggtggaaatgtctagcaggcagatgaatacattatctagtattcccaaatttttctttaggacctcccctaaagacctggaaagacct

SEQ ID NO: 141294 - DNA, 601 bp, Human
agtccccagggattcagtctgtgccccctcctgtttcatgcttatggggtgaaacctcaactataattccaggagattcaggttttgaggtaatgtcatcagaggatgctgtaagaagggatttctgttctttccagaagctgcttttgtccccagacacatcatgaaatgccagcttgtggtccacaccctccctgcccgctgggaaatgctgctgggggcttgtgagtacttggcttctggaggacaaagaagaggggaacagaaagaggcatagtgtcagatatttgccttcattataaaaaaaaaaaaaaacatacaatatgctgggcaattttaaggcatggttttcaaggctgtttttaacagtctctggaaaccagcaatccggtgtcagttgtttataggatccaagggggtggtgctgggggttgtttcaacatccttgcacagagagaaacatgggtagtggcttacaagctttgagtgttagacacagggacagcatgctgtgggggtggggagtgggggacacccatccaggtggggggatgggcttctcatcccagctctgccatcagctgcccatgtgatctgggaa

SEQ ID NO: 141295 - DNA, 601 bp, Human
tagatagatggaggaaaaaagcacaaggggcattccaggcagaagtctaagcatgagaaggccagtctctacaaaggcaattgtttcaggatatgagtgaagagcctagggctcaaagaaaagatttattcaagactgacctaagtaatctgtcactgaccagcccattgcagcctctttccatacttgcattacatgcaggtctccaacctgagcccctaaagccctttcttcctttgctctcggccctatttccaaggttgttttcccactgctgtgtttatcctgctatgtatttgcwcatgtggtgggactgctccatttcagccactcagtttttatttaaatgaatcttgctaagattcagctaggctgattgctagattacctgggaggagctggatatgcagttctgtgtgcctcttcatactcagcagaccctggtatgttctggaagactggatttagatacagtaggtaagagacaggctgagggcaacacacacacacacacacacacacacacacacacacacacacacacatatattttgtttcaatcctctttaatacccaaagggcttatggaaaaaagatgctc

SEQ ID NO: 141296 - DNA, 601 bp, Human
agatgagcgaaactcaagacaggaagaccagttgggaggtagttgcagtatctttgagatgatcctgcaggtgagagaagatgatggcctctattaggaaagcagtggggtgcgagagaactgcatgcattctttactaagcccttactagctggtttagctagggtaaattacttaatctctctggccttcaaagttctcatcagtaaaaaggaaacaatcataatctcttttttacagtttttaaaaatactgtttttaatgctgtaaaaaaggggtcaatagtttatatgggtcaatrttgttgcacaaaagccttttgtaaattagtgtacaaaagtgccatcttctctggacatcatttgccattaagtgaaactgtgctttcctccacaagggctctatcatttgaagttctcttgtccatcaaagcccttccaccagtcctgttttgtgcctagcactgaacttctctgtatgacaacacaagcagtgagaaattcttttggtttggggatgggctggctttaatattatagcttgaaatcccagcttaaaagtaatacactccggtttctgtcccctcccttcttcggtaata

SEQ ID NO: 141297 - DNA, 601 bp, Human
ttttagagagtagatcaatgaggtttgtattctggaaattcactcaggcagctgtgcagaaggagagtggttggagtcaggtagcccagtggggaggccaatctttaatcaaggcaagatctgatgaggcctatgagggcagtggcaatgccattctgagccaggccagaacctgactttctgtgtgattcaaccattgcccaacacacctgagtgatggtgcagacccatacaagaagcatgaagttatgcacttgagtctccaaactgtgattcacagtcctgacaatatttcctgtgygtgtaagagaccaccctctccaaagtcaactggaacagtttaagacatcacaagtgacccatggagaagccaagcttccttgcctaacaaagaagctgatacgttgttgaacttctaaaggcacttgggggaggtggtttttaatacaaagtcacttctgagcttgtggtttggtaaatttaagtcttttccaaacaaggcagccaggctggcaaagtgatcctttttcatcccctctaggcactgattcagttctctgaagcctccctgctttcgctcttcctgttccttctcctgaaa

SEQ ID NO: 141298 - DNA, 601 bp, Human
aacaaaaagagtaattgttaaatcaaagcactgaatagagctcaaggaatgacagcatctggtgaaagaaccataaaaagctcagagaagagtgtttgctgataattattgacagtttgctaattacagcattatttggcctgttaaaggtatatgtacttctcccagttaaagaaaaagtacacaagagggctttttctctctctctctcttttttttttttttttttttttttttttttaccagaaaagatactcctgtatccagataagaacccagattcccacaacagaacatttaraaaaggggtgggggagtgtagcgtatctctggtcagcaatgtctacaacatagacaataactcaacactgtacactactcagaagctaaactttccctgaacattacacagaacagtcccataaaaggtacaatttctactgcagtggtattgttttggcttgtctgagtctacaagttgtattggttctagattgggctgatctaagacattccacttcgtgtatacttatgtaatgttacacaagtgaaagaaatacatttttaaaactttttctgattaaaataccaaatagaaaaa

SEQ ID NO: 141299 - DNA, 601 bp, Human
atgttgatttgagcaatattgaatcacccagatgtatatatgtgtatgtgaaatgattgaataaaatattaagcattatcattatgtgctgaagctgaacattttctataacctatgatccagcaattccattcttgtactgtacaagaaggggcatgtgtaagaatactcatagctgcactattcacaatggtaaaactgggaaacaacccaagtgcccatcaaagggaaagtggaaaataaacagtggtatatttgaacaatataacattatatagcagtcaaaatacttgaactgtarcaacactaagatattaaaaaagcaagtctcaaaagattctaaaggaaatagaaatttttaaaaatgtgttttataggattaccaataaatgcaataaaatcatataaaaagaaaagcagggaagtgatgaacccaagattcaaacgaaaagttacttcaagtggggaagaccaagggatgaaattgggggtatggccatgtggttagatatatattgtgttcaaagtcataactgttgcaagtgtttattgcatcattaaaagctcactaatcaacagaataagtagtgtgcattttata

SEQ ID NO: 141300 - DNA, 601 bp, Human
tgaacttaggtctatatttttggcaaactcttattccaactctgcctgtactcttatatcaaatagaaagcaggcagtctttttctccttctagagttgtccaaggacagaaaaaaaccgcagcagaaatatgccacgtacacagaaaaaagaaaggcggatctgataagctggaaaggagaagcctggaaaaagatgtggattatgtaataggcccagaagatgggctgatgagaaaaagcttctttcaatgtttctggaaaaaaatgcaaatattcagcaagacacggtcattatcctrgtgaatgggcacattcagtgattccttctatctttggtgcagagattgaggcatcttgggatgcaactgagggagcaaagctgactgcagcctctgccctcctgtgtgtgcagtcaacctggcacatcccctcttgctaccagacccgtttccctttccagggggaagtcaactcggttgctaaaaaacaagttctgatgagtgtttaaggaggagcaggataatgggagtggctccgctgcaaggccaggggccacagtctcccaactttaaaagcccttgcattccaaatgtgaagga

SEQ ID NO: 141301 - DNA, 601 bp, Human
ctagagttgtccaaggacagaaaaaaaccgcagcagaaatatgccacgtacacagaaaaaagaaaggcggatctgataagctggaaaggagaagcctggaaaaagatgtggattatgtaataggcccagaagatgggctgatgagaaaaagcttctttcaatgtttctggaaaaaaatgcaaatattcagcaagacacggtcattatcctggtgaatgggcacattcagtgattccttctatctttggtgcagagattgaggcatcttgggatgcaactgagggagcaaagctgactgcascctctgccctcctgtgtgtgcagtcaacctggcacatcccctcttgctaccagacccgtttccctttccagggggaagtcaactcggttgctaaaaaacaagttctgatgagtgtttaaggaggagcaggataatgggagtggctccgctgcaaggccaggggccacagtctcccaactttaaaagcccttgcattccaaatgtgaaggaactccttcagcagatatatttttaaaagcatttaaaactgaggtttagagaaatgaggcaatttgcccagcaacacaaactgaatgtgga

SEQ ID NO: 141302 - DNA, 601 bp, Human
aaaggcagtcacagagttgtttaaaaaaaatgggatttgaaatctgacagatgtgagagtcattcctagctgtgttacatttaccaaatctctgccggtttgaatttgtttccctgtctataaggtggaaataataagacccgttttatcacctcacatagcggagtcttaaaggaaagaagggaaatgaaaactatttatgacatatcaaaagttgtgtttgctgtcctgattgacgatcctctcatttacacttacacagccaggatgaaaataagtttcatttcacaggccacgtacrgtggcagcaccaaatggtgcacagaggagggtgagagactctatgaaatttcaacaggaaaatgtgccctagtcaaatagtgatgtctaccgtgtattcttgtgggtttgggggcagtggtcatggcaggacatactatgaggcagtgtcatccctattcccatcctggattcttagacaccgaactctgtgtcccctaagcacaaacccttccccagctcccgctgccagataggatgaagatggcacttaaggccttctttaccatttcctaccaatctctcaatgtcctgaccctca

SEQ ID NO: 141303 - DNA, 601 bp, Human
aaggcagtcacagagttgtttaaaaaaaatgggatttgaaatctgacagatgtgagagtcattcctagctgtgttacatttaccaaatctctgccggtttgaatttgtttccctgtctataaggtggaaataataagacccgttttatcacctcacatagcggagtcttaaaggaaagaagggaaatgaaaactatttatgacatatcaaaagttgtgtttgctgtcctgattgacgatcctctcatttacacttacacagccaggatgaaaataagtttcatttcacaggccacgtacartggcagcaccaaatggtgcacagaggagggtgagagactctatgaaatttcaacaggaaaatgtgccctagtcaaatagtgatgtctaccgtgtattcttgtgggtttgggggcagtggtcatggcaggacatactatgaggcagtgtcatccctattcccatcctggattcttagacaccgaactctgtgtcccctaagcacaaacccttccccagctcccgctgccagataggatgaagatggcacttaaggccttctttaccatttcctaccaatctctcaatgtcctgaccctcat

SEQ ID NO: 141304 - DNA, 601 bp, Human
taggtgcataacctctgtcttatagaatatgaaataaaatatataatcaaggtctgcactgtttgctgtgggatttgaacaagtgcctttgtttttctggttctaagttcagcatctgtgcaaatgaaaacattggtctatgtaggtggctttcaaactgtaacgcatctcagaatcacttgggttgactgctcagttggcagattgctaggccccttcctcaggttgctagttcactggaattagagacccaatatctgtattcttagtaagacctgccaggtggttctaaaggacaaamtctataagtgacattttgaaaaacactaatctaggtcttaacctggaagtatgtttaaataggcttcaggagttctgcccacactgaagtcgcaagtaaaattttatatataaactctcttggggtagctttaatcagattcattgaggattctgtagtcccaagaaaggataagagtcactaaaagtgtttctaaccattggcagacgtaacattctaggttccataacagtggttattgagtcttaattggcactaagacaaatgcagcaaaatccccttctaagttatactttcaaa

SEQ ID NO: 141305 - DNA, 601 bp, Human
aatgataaccttcccctgtctccaagggtgtgaagttattttggatggcttccacaccttgggattttgctttcccatggtagggcaggtgtcatttagagagatatcagtggttattgtgactgtggcatcctgaaggaattgctcttagatggcacctcaacctctctgccctcaggataaggttggaaagagccctttagaagtctctcagtccactccctcccccattttacaaataaggacattgaagcccttgaatgagggtttaaagctagaaggatgtgctgtcccgttagtwattctctgcagcagattgctcaaggacactccatttctaattgcaatagaagaaatgtcaaagcagccaggcatggtggctcacacctgtaatcccagcactttgggaggcctaggtgggtggatcacctgaagtcaggagtttgagaccagcctggccaacatggtgaaactctgtctctattaaaaacacaaaaatcagccaggtatcatggtgcatgtctgtaatcccaactactggggaggctgaggcagaagaattgcttaaacctaggaggcagcagttgcagtgagccaagat

SEQ ID NO: 141306 - DNA, 601 bp, Human
ggttgttatgaagcttgtggctccattctcatgactactgtgatatttctgtgaatctgaccctgccctgaactccaggtcagcttctcccctcacaggtgaaatccagtcctattataactgggggagtgatagacagattttgggctattttacgaccaactttccctgtctaaaatgtcaaagcagccgggtgtggtggctcacgcctgtaatcccagcactttgggatgccgaggcgggtggatcacctgaggccaggagtttgagaccagcctggccaacacggcgaaactctgtytctactaaagatataaaaattagccaggtatggtgcatgcctgtaatcccagctactggggaggctgaggcaggagaattgcttaaacctaggaggcggcagttgcattgagccaagatcacgccattgcaccccaagctggaagacagagtaagactccatctcaaaaacataaatataaaataaaataaaataaaataaaataaaataaaatgtcaaagggaggaatccctttgtagtaatagagaagctattagttgtcgtccaccttcaacaaacaactatagaatggcgtctaaa

SEQ ID NO: 141307 - DNA, 601 bp, Human
tgtcaaagcagccgggtgtggtggctcacgcctgtaatcccagcactttgggatgccgaggcgggtggatcacctgaggccaggagtttgagaccagcctggccaacacggcgaaactctgtttctactaaagatataaaaattagccaggtatggtgcatgcctgtaatcccagctactggggaggctgaggcaggagaattgcttaaacctaggaggcggcagttgcattgagccaagatcacgccattgcaccccaagctggaagacagagtaagactccatctcaaaaacataaatttaaaataaaataaaataaaataaaataaaataaaatgtcaaagggaggaatccctttgtagtaatagagaagctattagttgtcgtccaccttcaacaaacaactatagaatggcgtctaaaaggagtccgtagccaagagctatggagtgtgtggaatttgagtcagactcttaccctactctaagggcctcacagcctaggagaaactcttaacaatctgtgtaaatagctagaagagatacaaagtaacgtttgccccaacataggtgcagattttctagcctaagaaatttctgta

SEQ ID NO: 141308 - DNA, 601 bp, Human
cgggtgtggtggctcacgcctgtaatcccagcactttgggatgccgaggcgggtggatcacctgaggccaggagtttgagaccagcctggccaacacggcgaaactctgtttctactaaagatataaaaattagccaggtatggtgcatgcctgtaatcccagctactggggaggctgaggcaggagaattgcttaaacctaggaggcggcagttgcattgagccaagatcacgccattgcaccccaagctggaagacagagtaagactccatctcaaaaacataaatataaaataaaataaaataaaataaaataaaataaaatgtcaaagggaggaatccctttgtagtaatagagaagctattagttgtcgtccaccttcaacaaacaactatagaatggcgtctaaaaggagtccgtagccaagagctatggagtgtgtggaatttgagtcagactcttaccctactctaagggcctcacagcctaggagaaactcttaacaatctgtgtaaatagctagaagagatacaaagtaacgtttgccccaacataggtgcagattttctagcctaagaaatttctgtataaataacttca

SEQ ID NO: 141309 - DNA, 601 bp, Human
gaccccagcccaccagcctagtcttgtggtgtcatcccagccagagctggcagtacagatcccagccagagctgcctgccctgagccctccacttgcttagggaggaggcccttccttggcctttgtttctgccactttccgcagagagaagctggtgatgacttgctgagtaaaaagtggattgaccaactttccgggtaaaaacagtaacacggtgttcccgtgagaaccagctgggcctggctgctacaggtggcccctggggtcagatccccaatattgtaggtgaaataccttcartctgaaataaagaagcatactcaaaacattttggtctgaaagcaaagacaaatgggttgttttatcagtgtggctcacagtgtttttagggaccagtgcaagatggttgttgtcctatgtttgttcatttgggtggtttctttttttctcctgtatattttttattactaaatggcacaaagatgtgtggtgaagctatacatactatcattttgggcttggttctctctatccgaggcagagacaacagcttggaatacgtgttaagtaatagctgaaaaggcagctgctctgtggaga

SEQ ID NO: 141310 - DNA, 601 bp, Human
tacagggtttgaatccaggttctgccccttgggagctgtgagttttagggcaatggccttcacttccctcattttagattctgcagctgcccaatggctcttcatatctactttacaagtgtctgctattcaactgctcaataaatggtaaaggtcactctaattatgactggggatagagtatggggttgaggaagctggcactgctgtctgattatgcagcaaagatccttctctgcacagcatcaagttaggatctgctccaggggactatgcccccttggtggtatggaaactgtcytggcctccaatccatgtgaaccagccttcccagccttccccagaacccctacaaggctgacccagtcaccactgcttctatgtgaaaaaaagtttaaggaggaagtgaaaaggctgtccctggtgcaggcaccagggaatcctcccagcgactcggcgggtaagccagcagaggaggaaaccttctgctccttgagcccctccgcagcagctggtaacagccttgaaggtattacactgatgcaagagaaaggctctcggagaatacaattttccctcaacaaaacaacccaggcagagt

SEQ ID NO: 141311 - DNA, 601 bp, Human
acagggtttgaatccaggttctgccccttgggagctgtgagttttagggcaatggccttcacttccctcattttagattctgcagctgcccaatggctcttcatatctactttacaagtgtctgctattcaactgctcaataaatggtaaaggtcactctaattatgactggggatagagtatggggttgaggaagctggcactgctgtctgattatgcagcaaagatccttctctgcacagcatcaagttaggatctgctccaggggactatgcccccttggtggtatggaaactgtctwggcctccaatccatgtgaaccagccttcccagccttccccagaacccctacaaggctgacccagtcaccactgcttctatgtgaaaaaaagtttaaggaggaagtgaaaaggctgtccctggtgcaggcaccagggaatcctcccagcgactcggcgggtaagccagcagaggaggaaaccttctgctccttgagcccctccgcagcagctggtaacagccttgaaggtattacactgatgcaagagaaaggctctcggagaatacaattttccctcaacaaaacaacccaggcagagtg

SEQ ID NO: 141312 - DNA, 601 bp, Human
ggaaatattggagtgtaggtggcaggaaaggtgtctgttatccccgtgcagccatcaaatttactgttggctccaggcaggctgccataccctgggaatgcaggcagggagtctggttggctttaccacataaaacaccatagaaaaccagatactttacgtcctttctaaagtaaatcaaaggatgactagatgcatagatgaataatagacagagaatactagccaacattcgttgaatgctcagtgtgcgtcaggcattgttccaagcactctgcatatattaactcatttcatcctyataagggtatttgaggttggtgctattattatttgccccattttacaaatgaggaaactaaggcacaaagtagttaagtaactatcccaaggtcacacagcattgaaacccagcagttggactccattgccaatgctctttacctggtagagagagccttgatggagatctcaggtgatcctcatccccactaataagagtggtttgtgtgctttcctttcctatagtcttcagatttaaaacattgacataaacgtctgatatggttccaagtggctcctaggatgaaatgcagagaag

SEQ ID NO: 141313 - DNA, 601 bp, Human
tttgaggttggtgctattattatttgccccattttacaaatgaggaaactaaggcacaaagtagttaagtaactatcccaaggtcacacagcattgaaacccagcagttggactccattgccaatgctctttacctggtagagagagccttgatggagatctcaggtgatcctcatccccactaataagagtggtttgtgtgctttcctttcctatagtcttcagatttaaaacattgacataaacgtctgatatggttccaagtggctcctaggatgaaatgcagagaagtgaagagtcaggggctggagtcagacagaaatgagtccaagtcctggctctgcactgtccagctgtttggctgtaggcaagtccttcatcctccaagtccgagttttctcatcaaacaaatgggatgatgacctgcttcacctgcttcccagagcagtggtgagggccaggaggctgagggtctgacagtgcctacacttctagcttaggttccttgttgacagcactggagttgagtcagaagaaaaccaaggtgggctatgactgtgaggttggagaagcccaccatgaggaattacaacttccctct

SEQ ID NO: 141314 - DNA, 601 bp, Human
catgtcacttcttaagttcccttccaacagcaagattctagaaatcacgtgcagctgtcactcaatctctgctaggcatgcctgtccctatagcacaggtcccttgacattgtggctatttttttgtccagctacccacaaggtcagggactgtgtcttagtcatctctgtatccccagcaatcaataacaaaaattagttggatgaaataataaattaacaaatgaataaaggactctgtttcatagcttaactgaaactcagttgaaagaataagtgaaagaaatgaaacatttaaagwgtgttatccagaataatgagctacagagattctcaatgaaccttttcaatacagaatgtttaaataagtaatatgcaacataacataacagaataacataacatcccccattctgagagtcaagtagctagctaattttcttatgactacgggaggtacttaccagcaaaagagagttgtcaatgaacttccttaaatactattttcccaaagaggaaatgaaaagataaactgtaaaacttgacatgcccagtatgaaaaggctatctgatgacttgaaattaggctgcttatgttgga

SEQ ID NO: 141315 - DNA, 601 bp, Human
aagacattccccttcctgcccattagtcagccttttatcagaacagccctgttgaggacagagaacatgatgcggattgcgatgtgtcagtgacatgggactggaagcatccagatgacaggggcttggctctccatctccagggaaccttcctctgaactctagccaggcaagggccacagttcaaggccctgaactctgcatgctttgatccagtagtgccagggttggctccttttcccaaggaagaagaaaatctttgcttgatagatcaagcagttgtggcattttctgatcctgstggtagttttcagaaaaataaaggaaagggaaaaagaagggagctaatgtttattgagaccctactatgtgttaaatagatgctatgagagaaacagagaaggagataggatcccttggaaacagtattgaacaaaaacaagagcaataattacagcaaatgcttatgtagcattcgctgtgtacctgggtactatgctatacatgttctctgtgttatctgtttaattcatacaacagccttctgccctagataccattattatccccattttacagatgaggcaatcgaggcacaagg

SEQ ID NO: 141316 - DNA, 601 bp, Human
tgactgctgtggggataggctccatccaggaagggggccttgaacttggtcaaagagtagactaagaggaggtttggaggattttcccaaactccccagactgggccaactccagaactctctgaagaggacagtggtggctcaaggtgcgaaaggagccagctccgtctccagcacccccacttccactgctccatgccttgctctctgctctgtaatccccaccccatgccccactgctatactcttgtcctgccctcacccaaacctgctcccccaaatgtctctcatcaatttattratattaacatgtcagtgactgattatatttaatgtgtacatcctgctaagggatttatagtttatcaggaaaaccaaagtaatagtgatgaggttttagggcctgttcaggggactttctttatgttctcagattaatatcagaatatatgatacacacagaggtgggcaatgcaaggcaagactttgtcatttgtcagggagaggactttgacaaaccatgttcttcatgcactctgtgtgtgtgtgtgctctcactcacacacacgcacgtgcctatgcataccgtgagaatgaggag

SEQ ID NO: 141317 - DNA, 601 bp, Human
ggccttgaacttggtcaaagagtagactaagaggaggtttggaggattttcccaaactccccagactgggccaactccagaactctctgaagaggacagtggtggctcaaggtgcgaaaggagccagctccgtctccagcacccccacttccactgctccatgccttgctctctgctctgtaatccccaccccatgccccactgctatactcttgtcctgccctcacccaaacctgctcccccaaatgtctctcatcaatttattgatattaacatgtcagtgactgattatatttaatgygtacatcctgctaagggatttatagtttatcaggaaaaccaaagtaatagtgatgaggttttagggcctgttcaggggactttctttatgttctcagattaatatcagaatatatgatacacacagaggtgggcaatgcaaggcaagactttgtcatttgtcagggagaggactttgacaaaccatgttcttcatgcactctgtgtgtgtgtgtgctctcactcacacacacgcacgtgcctatgcataccgtgagaatgaggagagggatagatgtgttttgaagttctggctgtcctt

SEQ ID NO: 141318 - DNA, 601 bp, Human
cctgctcccccaaatgtctctcatcaatttattgatattaacatgtcagtgactgattatatttaatgtgtacatcctgctaagggatttatagtttatcaggaaaaccaaagtaatagtgatgaggttttagggcctgttcaggggactttctttatgttctcagattaatatcagaatatatgatacacacagaggtgggcaatgcaaggcaagactttgtcatttgtcagggagaggactttgacaaaccatgttcttcatgcactctgtgtgtgtgtgtgctctcactcacacacaygcacgtgcctatgcataccgtgagaatgaggagagggatagatgtgttttgaagttctggctgtccttgattttgacccccttcaggaaaataatctctttgccgcatggtcctttttggaggctgaagcctctcaaccccaagaagggaagcagaggtggccccagaggctgcctgatagccatgtgatttctgtggcttgtctcggggactggccagcaaagctgctgagcagggagcccccctccctaagtgctccacagtgtaaaggccccttccgcctccatgtacatccatcag

SEQ ID NO: 141319 - DNA, 601 bp, Human
aattccttcgtttcccagacggtggatgtgcccattctacagtacattcactccctcaaggaagagtttccaaagcccttgtctgagtcaggcccagggctcagtccccagttctagggatacagagatgaataagatacccaaccttgggtgaaggtgcttccagtgcagtgcagtgcagtgcagtgaggcaactttcctctcctcagctcctcctcaccccatctcctcttcattcccttaactccctaggccatcctcatccttctttgtcctcactcccaaatccaccccatcactrttcccatcttcccctctcttttttttggagctcagacttcatactgcagcatcttgccccacaattcatcaccatccaccaatagccaggaaggccaatttcagtggaacaagaagggctatggctgtgtgaaggtaccattggcaggagtgatttctcaaatcttcagcaagggattatttagcaagtgcatggaaaatactaattgagataggaaacaggaattgttgaaagcaattttttaagttacttggaaaaagtacagtgaaattcctggaaaaatatttgatgaattataca

SEQ ID NO: 141320 - DNA, 601 bp, Human
tacttggaaaaagtacagtgaaattcctggaaaaatatttgatgaattatacatgtacctacacccctgagaccgtcatggccaaattcaaattatggccacaggacagcaaacagaagttagccctgggctggacctcagttctagccccaccactggcccctgtgatgcatcctcataacagatgtttcccttctctgggcctgtttcctcatcacaaaagatgtaagagctaaataatctctaaggactcttgttgggacagtcagtccagtgtcttctttgtgctgagccctcttcrctcatcattacgcccagatttcttcctggagtggggagtggagccatacacaggggaatgctcagctgttccctgtgctgcacagacccactggtccagacctcaatcacccatctttccacgtttcatcctgttgtccataagcaaatgacacagttgttcatctattcatcccatagaaatgtaaatagcttcttccatttaaatggttgcatgtagggagatcaataatgagaaagcaatcagacagatcttgctccagaagagcccccaagtcaagaggagagagatagacagttc

SEQ ID NO: 141321 - DNA, 601 bp, Human
cagcaaacagaagttagccctgggctggacctcagttctagccccaccactggcccctgtgatgcatcctcataacagatgtttcccttctctgggcctgtttcctcatcacaaaagatgtaagagctaaataatctctaaggactcttgttgggacagtcagtccagtgtcttctttgtgctgagccctcttcgctcatcattacgcccagatttcttcctggagtggggagtggagccatacacaggggaatgctcagctgttccctgtgctgcacagacccactggtccagacctcawtcacccatctttccacgtttcatcctgttgtccataagcaaatgacacagttgttcatctattcatcccatagaaatgtaaatagcttcttccatttaaatggttgcatgtagggagatcaataatgagaaagcaatcagacagatcttgctccagaagagcccccaagtcaagaggagagagatagacagttcgctgtattaggcaaattgtgctcagctccctttgaaagggaagtccaggaaggttggggaaatgagctgagggctggaaacacgcatggggaggtggctggtcgga

SEQ ID NO: 141322 - DNA, 601 bp, Human
aaaggctttctggaagaaatcagatttgagtggggctctgaactgggatagaattccaggagatgggccctagtggggagggcatcacaccaggaagtccttcagtgtgggcaaggccctctgaggtatagctgagggcactgtaagactcgggggcccctcttaccactgttgcttgcatggcaacgtagacctggcagctcttaggagggggcactgaaggcacacttgcctgtcatccccagttgggggaaacattggcttaacaatgttcagcaaattacacattcataatgaatcytgttggcagaacttccaagcccttagcaccaggcagtgcatctgacagcatcattacccctcagtatgagttttgccagttgtcattttcccaagcactttggagccgactccgcctttgcttagcagtcacagggaagccagcccattgggctccacatggcacttcctttggttttcttgtcctgtccccattttcctccaaacccattccagtttgtccctgcctcactcactcagctgtggccaaccccaaggagggcatttatcccctcagggtcagatccagggcattttgtct

SEQ ID NO: 141323 - DNA, 601 bp, Human
gcaagtggaagtaagggatgctgtctccatggcaactgccgttcatcctcagcttgtcaggctgggcatgctggaattgaacagggctgaattgttgcccccatcatgtggcacttttccaattttgagatgccttcacctgcatacatgcacatgcacatgcacgcgcacacacacacacacacacacccccaccttacactttttcctctacctttctccagggaagaataggtgtggtttccagtggcacagttcaagcatggcagcacctttcttaccccagaaagcagcagtaccyggggaaagaatatggggagggggataagggaagtgtgagaggaccagctcttgtcctggtacctgctaagcagaggaggagtttggtggtcaatgttgctgtctgtgctcaaggatgtagtcacctggtgtatcagtttcctactgctgctgtaacaagttactacaaactgatggcttaaaacaacacaaatgtattatcttacacttttgggggccagaaatctgaaacagatttcattaggcttgggtttcttttggaggttctaggagagaatccattcccttacctttctcacct

SEQ ID NO: 141324 - DNA, 601 bp, Human
ttcaattttcccttatttgcctttttagaaaaggcagcttctaggcaggaaagtagagaaaccaggtcacaaacagtattagaactcatggtcctgactccccatccagggctccctccttgtgctccatcatttgcctccctccttatgcatttcctcacctgaggaatgagggtaacgtattcattcactgaataaagatttattgggcatatactatgatcaggaatggtactagacaccggggattcaaataatttgtttgttacagtcttaaaaaaaaaaaaatgcaatccccccycaaaaggcccccagcaatgttacagggccattctaagtgattacaataatgtgtggtggagtcatgcccagggtcttgagagggcataggggaagggcacttgccctagcttggagttcaatctttctatatgaactgagtgctagagcatctgtaagaaaatgccaggagatagaaagcatttgagagggaggccttcctgcaatggggaaagcatggaggtaagaaattacaggtcatatcctggaaggcacattgggaaacacagaagttcattttgctcatgcctaatgtgtccgt

SEQ ID NO: 141325 - DNA, 601 bp, Human
ctaagtgattacaataatgtgtggtggagtcatgcccagggtcttgagagggcataggggaagggcacttgccctagcttggagttcaatctttctatatgaactgagtgctagagcatctgtaagaaaatgccaggagatagaaagcatttgagagggaggccttcctgcaatggggaaagcatggaggtaagaaattacaggtcatatcctggaaggcacattgggaaacacagaagttcattttgctcatgcctaatgtgtccgtcaggcagagagggtaccactgtatgaacgggcraaaccctggagacgtgagccaggcccttctcatggggatccaactccagaaagtgatgaaaaaccagtgaagggttttaagtagcatgggtaggatggcttcatggaattttctaagtggttcattctggaagcagtctggacaagggattggcaaagcgagaagggcaggctagaggcagaaataccagcaggaacctggagggtatccagatgggaggtgcaggggccccgcctcctcattctcagggaagatctgctgtgctttcagtgcgcctcccacgtggaaggcttctggatg

SEQ ID NO: 141326 - DNA, 601 bp, Human
tcccctgagaaagtgggtgggaaggtgagcattatgctattcatgatattatcttttgagaaaaagaattccacacccactattgtcttttatcgagtgacgctacaaattgattctaagcctcagaaataaaagagggtataatatagtacaaaaaaaaattgcaaagatcatacaaccttcatctgctagtgtaaaacagtacagactaaccccgataaattcagaaaaaaagtagaatgaaacctctcaatttaaactcactggggagggctaatttgaattttacattgtttcaaargaatgctacttcttcctctcacatccaagcataataaaaccttaagagaatatttgtgtaatcaaatgctgatgagtagaataaagaaagttaataggaaaactataatagacttatggttacataatggtgagtcatgagcagtatggtcatttttatatacaagaatgaacttgatgaaggaaagctactttaaaaacaatacctagcatatcacttaacagggaatctcaccaggcagccctataaaaatcagcagtttctttctctaaaaatcaacagtttcttccttccttcctt

SEQ ID NO: 141327 - DNA, 601 bp, Human
ttttatcgagtgacgctacaaattgattctaagcctcagaaataaaagagggtataatatagtacaaaaaaaaattgcaaagatcatacaaccttcatctgctagtgtaaaacagtacagactaaccccgataaattcagaaaaaaagtagaatgaaacctctcaatttaaactcactggggagggctaatttgaattttacattgtttcaaaggaatgctacttcttcctctcacatccaagcataataaaaccttaagagaatatttgtgtaatcaaatgctgatgagtagaataaagmaagttaataggaaaactataatagacttatggttacataatggtgagtcatgagcagtatggtcatttttatatacaagaatgaacttgatgaaggaaagctactttaaaaacaatacctagcatatcacttaacagggaatctcaccaggcagccctataaaaatcagcagtttctttctctaaaaatcaacagtttcttccttccttcctttctctctctctttctttctttccttctttttctttctttcttttctttctttcttcctctttctttttttctctctctctttttctt

SEQ ID NO: 141328 - DNA, 601 bp, Human
gtgtgattatctccaggtctgaggctcactcgctgggaaaccatggattcgtcacctcatctctctgtgccttttgtctcatgcataaaatgtgaaaaggaacaaatgtaataggcagaaaaatgtgtccccccttcaccccaaggtatacatgtcctaacccctagaatttgtgaaaatattatgttacatggcaaaggtcatttatggtagtagatagaactaaggttactaatcagctaacctgaatatagggagagcattctgtattatccaggtgggctcaatgtaatcacaagcrtccttaaagtgaaagagggaggcagaagggaaggttggagtgactcaatgtgaggattccgtctgccaccactgcttttgaagaaggaggaaggggccacaagtgaaggaatgcaggcagcctcttagagccagagaaggagagggggtggaatccactcccctgaagcctccagaagggagtgtagctctgccaacactttgatggtaacccagagaagacccatgtcagacttccaactcccagaactataagataatgaatgtattgctttaaaccaaaatggtcgaggtaatgtgt

SEQ ID NO: 141329 - DNA, 601 bp, Human
tatgttacatggcaaaggtcatttatggtagtagatagaactaaggttactaatcagctaacctgaatatagggagagcattctgtattatccaggtgggctcaatgtaatcacaagcgtccttaaagtgaaagagggaggcagaagggaaggttggagtgactcaatgtgaggattccgtctgccaccactgcttttgaagaaggaggaaggggccacaagtgaaggaatgcaggcagcctcttagagccagagaaggagagggggtggaatccactcccctgaagcctccagaagggartgtagctctgccaacactttgatggtaacccagagaagacccatgtcagacttccaactcccagaactataagataatgaatgtattgctttaaaccaaaatggtcgaggtaatgtgttacagcagcaacaggtaatattcaaataattaagataattaaatgagaaaacgcctgtgtgaaatgtctactatggggctcgatatggtttggctctgtgtccccacccaaatcacatcttgaattatactcccataattcccacgtgttttgggggacctggtgggagataactgaatcat

SEQ ID NO: 141330 - DNA, 601 bp, Human
acagactcatttcaggtatttaagacagtcttactcattttaaaaaattccacctccagctcagttcagtgctctccttccctccccagcacaggctgccttgtctgtggctgcagttaggaggcaggggctgggggcgggacaatgtgtcaaggatcagcacttggcacccaccccttcctctactactaagcagctcctccactccttcatgtattgaggcagggaagatatagagaaaagggaatttcagtaagttccttacggaactaggccaggttacagcatctccttagctgattttttttttttttttttttttgagatctcagcgcactacaacctccgccttcccggttcaagtgattctcctgcctcagcctcctaagcaagtcgttgggattaggattacaggcaggcatgcaccaccatgcctggctaatttttttgtatttttagtagagatggggtttcgccttgttggccaggctggtctcgaactcctgatctcaagtgatccgcccgcctcagcttcgcaaaagactgggattacaggcatgagccaccaggcccagccccttggctgatcttctaatctcct

SEQ ID NO: 141331 - DNA, 601 bp, Human
caccctgcccctgtgtctgcagaggagcaaagagaacattgtctctaagctggcctgggagatgatggttggatgcaagagtgattcttaaaggtacacctttattagaccctatcaacttatggctgaccccaactgccagcagctctctgaagttagaatgaagtgcttactaccttttattttcagtttggagcattgtccacaattctaggacaaaggaaaaatctgtcactgggtagaagcctcactaagatactcagaagaggctctgggaatattcaatgatgaagaactgcgsctctcagatgccagccccactccagcctggcctgaccatggccatagcctgctgggtgcagcttgtctgctgcacagactctgggtggggttgccccaagaaggctttttaacagcaatcaaagcaataaaggactattttgtctaaaatctgttcctggactatcccagcagtttcaccctcatttcaacaccacatccaaacagcttcaggacctaaatgcaaatccacgccaaggagacaccacatacccccatctcaccacatcacagcccgtggctgcctcagggccctggagga

SEQ ID NO: 141332 - DNA, 601 bp, Human
tttcctgccacccctactgagatctaagctatagcaatttctccagagaaagacagttttgttcctggggcaggattgttctaaatcccctctctgtgtaagcccttctgagttcagtggacttgacttacttggcaatggtttccaactgccactggtgatgcagaatttttctcagccactttgccaaccagggaactccatggccagcaataccccctgccatgcctgggccttgcttggccccaggcctgctggaggcacctcgtccactcggcctgctgtgttatagattgtaccygcattcaacaattcctgagctcttgtccctcatccaagaagaataaggttacactgacaattagaagggtaaggatgggcagagaagaattttattgagcaatgaaacagctctcagctgagaggggacacggtgggggtggtcccccacccccacagtcaggtgatttctctctcagtgtggctgggtcccaggctttttatggactcggaatggcgagtgcatgcagattggtttgtgagtatgcaaaaacaggttaaagtgaagacaacacccaaaggtgggcacgatagtgtagaa

SEQ ID NO: 141333 - DNA, 601 bp, Human
tgtaaagggtgcatcacacattagcactctggttaactattggatggtggtttgacaatatgggtcacaagtaagatttgtgtattccttcacccatagtccatgtttaggagataaccagatcaattttataaataaaacactttaaggtattaataacagtgaagacgttttaaaccattgtcagagtctctagatttgattaaataaattatagaacattcatataatggaatattaatcagccactaaaaagggggtcatatatttaaagccagtgacctaaaaggttttcatgacrtagcaccaaatgaataaatctagagttataaatatacatgcgtgtatgtgtaaacatgcagaatgcagaaccatacacaggtacatacttaatgactagaatgaaggtaaggtttgttgttgttgttgttgttgttttccgagatgtagtctcgctctgtcactgaggctggagtgcagtggcatgatctcagctctctacagcctccgcctcccgggttcaagtaattctccttcctcagcctcccgcgtagctgggactacaggcccatgccaccatgcctggctaatttttgtattt

SEQ ID NO: 141334 - DNA, 601 bp, Human
gatggtggtttgacaatatgggtcacaagtaagatttgtgtattccttcacccatagtccatgtttaggagataaccagatcaattttataaataaaacactttaaggtattaataacagtgaagacgttttaaaccattgtcagagtctctagatttgattaaataaattatagaacattcatataatggaatattaatcagccactaaaaagggggtcatatatttaaagccagtgacctaaaaggttttcatgacgtagcaccaaatgaataaatctagagttataaatatacatgcrtgtatgtgtaaacatgcagaatgcagaaccatacacaggtacatacttaatgactagaatgaaggtaaggtttgttgttgttgttgttgttgttttccgagatgtagtctcgctctgtcactgaggctggagtgcagtggcatgatctcagctctctacagcctccgcctcccgggttcaagtaattctccttcctcagcctcccgcgtagctgggactacaggcccatgccaccatgcctggctaatttttgtatttttagtagagacggtttttcaccatgttggccaggctggtctc

SEQ ID NO: 141335 - DNA, 601 bp, Human
atgggtcacaagtaagatttgtgtattccttcacccatagtccatgtttaggagataaccagatcaattttataaataaaacactttaaggtattaataacagtgaagacgttttaaaccattgtcagagtctctagatttgattaaataaattatagaacattcatataatggaatattaatcagccactaaaaagggggtcatatatttaaagccagtgacctaaaaggttttcatgacgtagcaccaaatgaataaatctagagttataaatatacatgcgtgtatgtgtaaacatgmagaatgcagaaccatacacaggtacatacttaatgactagaatgaaggtaaggtttgttgttgttgttgttgttgttttccgagatgtagtctcgctctgtcactgaggctggagtgcagtggcatgatctcagctctctacagcctccgcctcccgggttcaagtaattctccttcctcagcctcccgcgtagctgggactacaggcccatgccaccatgcctggctaatttttgtatttttagtagagacggtttttcaccatgttggccaggctggtctcgaactcctcaccttaac

SEQ ID NO: 141336 - DNA, 601 bp, Human
actaaaaagggggtcatatatttaaagccagtgacctaaaaggttttcatgacgtagcaccaaatgaataaatctagagttataaatatacatgcgtgtatgtgtaaacatgcagaatgcagaaccatacacaggtacatacttaatgactagaatgaaggtaaggtttgttgttgttgttgttgttgttttccgagatgtagtctcgctctgtcactgaggctggagtgcagtggcatgatctcagctctctacagcctccgcctcccgggttcaagtaattctccttcctcagcctccygcgtagctgggactacaggcccatgccaccatgcctggctaatttttgtatttttagtagagacggtttttcaccatgttggccaggctggtctcgaactcctcaccttaactgttccacccacagggattacaggcgtgagccaccacacctggccaggtaaggttttttgtatgattcactgctgtatccccagtgtgagaaactttgtcagtgttcaataaatacacattgaatcaatgaactcctagaacaatggtcattgtttttttttgtttttgtttttgattttgtttgttt

SEQ ID NO: 141337 - DNA, 601 bp, Human
aagaggtttaattgactcacagtgccacatggctaaggaggtctcacaatcgtggctgaaggcgaatgaggagcaaagtcatgtcttacatggcatcaggtgagagagcttgtacaggggaactcccctttataaaaccatcagatctcgtgaggcttattcactatcatgagaacagtgtgggaatgaccctcccactgggtccctcccaggacacataggaattatgggagctacaattcaagatgagatctgggtggagacacagccaaaccatatcaccccatctttactaaaaatmcaaaaaaaaaaaaaaaaaaaaaaagctgggcatggtggtgagtgcctgtaatcctagctactctggaggctgaggcacaagaattgcttgaacctgagaggcagaggttgcagggagccgagattacaccactgcactccagcctgggtgacagagtgagactctgtctcagaaagaaaaaaaaaaaattaaaagtaagagccgaatgtgatggatctagcagaggccaccttcacctatcgagttagtcaggaaatacttattgaatatccattgtgttccaggcactaagaatacaga

SEQ ID NO: 141338 - DNA, 601 bp, Human
gaggtttaattgactcacagtgccacatggctaaggaggtctcacaatcgtggctgaaggcgaatgaggagcaaagtcatgtcttacatggcatcaggtgagagagcttgtacaggggaactcccctttataaaaccatcagatctcgtgaggcttattcactatcatgagaacagtgtgggaatgaccctcccactgggtccctcccaggacacataggaattatgggagctacaattcaagatgagatctgggtggagacacagccaaaccatatcaccccatctttactaaaaatacmaaaaaaaaaaaaaaaaaaaaaagctgggcatggtggtgagtgcctgtaatcctagctactctggaggctgaggcacaagaattgcttgaacctgagaggcagaggttgcagggagccgagattacaccactgcactccagcctgggtgacagagtgagactctgtctcagaaagaaaaaaaaaaaattaaaagtaagagccgaatgtgatggatctagcagaggccaccttcacctatcgagttagtcaggaaatacttattgaatatccattgtgttccaggcactaagaatacagaca

SEQ ID NO: 141339 - DNA, 601 bp, Human
tctctctggccacactcactggcctagaagactggggagtccaagggcaggaaaaggctgcagcctgtgctcagaggcttatggttttccaggataacacacaaacccctgcttccttgaccagtggatgctcacaccatgacatgcacatattcccgaagatcttttatggcaacagctcatacacgccctttcacactgtctgcactgctgagagctgcagggttcagtatggtagccacgggctgcatgtggttttgagcacttagaatatggctagcaggaattgagatgtgctgtragtaatgacacatgtacctgcttcaaagacttagtccaaaaagtcaaatatctcactgataactttaatagtgattacatgttgaatgaatgatgtaatttcgatgtgttttgaatataatgggttcaatggaatctattattaaaaactattttttttttacctttgtaatatggctattagaaaaattccaattccttatgtgattggcatttgtggctcatgatatctttttattggacagggctgctctcaaaggtactcacagtaggctttgtgtttggagagtgctttagcagt

SEQ ID NO: 141340 - DNA, 601 bp, Human
acatagtggatgatgattgactgatcactcaatatattgttttctataaaagaatgaaagaagatcatttcctcttctggtcatttcctttaaagaatatatgtactctttaaatgttccttagttttcgtattattggctcatacacagaacacagccttgctgaaactaaaataataacaacaataataatagcatctttcatcggctgaatacctattatgagcccaacactgtgtgcacatcatgtgtgtgctttacacacatcatcctaatcctcacagctttgctaccagggtcwtccaaagaagggaagcccaatgcccctaggcacactactgttcaatagtggaagaactggaacccaataccgggcattctgactctgttccaatgtcctccccattaaatcccaaaggtcccagcccagcagccaattctcctctatcctgtcccattttttgtatgaagaaactaaggctgggtgtgttggcttgcacctgtaatcccagcacttttgggaggccaaggcgggaagatcacttgaggtcaggagtttgagaccagcctggtaaacacggtgaaacccggtctctactaa

SEQ ID NO: 141341 - DNA, 601 bp, Human
tctcatcattgtcaccatgacgctgtgaaatgagttgggtgcagggtgaaatgagaatcgatcttggatagaccactttattctggaggaggtagggagatcaaataagttttagaaccagttgtgaaatctgctgttctacccacttcagttggagcgagtgaagacagtacgaagggagtggtctcattctagctttccccacagcaaccaagctactaccaagcaccttcaaagatcctcaccacttgcctagtttcaaattcagtgccatttaaaattaataaaaacaatctttccrgtctagcagactggctctaaatggaaactcaccacaatttccaaagtgtaatttgttattgacatcctagtttcataacaaagagtaataggttggtggttcaatatttaccaggaagagaagtactagaataatcccctacccaaaatcaaaatgccattgacccgatttatagtgcaaatggtgtattagacagaaataaaaagagacttcatttgattttaaagtctgagtaatcagtaagtacccttcagggtctgtgacatttccaatggagatagaaatagggatagagagacc

SEQ ID NO: 141342 - DNA, 601 bp, Human
tttttttttttttttttttttttttttgagacagagtctagctctgttgcccaggctggagtgcagtggcgctatcttggctcactgcaagctccgcctcccagcttcacaccatcctcctgcctcagcctccagagtagctgggactacaggtacccgccaccatgcccagctaattttttgtatatttagtagagacagggtttcaccgtgttagccaggatggtctcgatctcttgaccttgtgatctgcccgcctcagcctcccaaagtgctgggattacaggcatgagccactgcrcccagccggtgagcattctaatgtgaaggagatctggaaggtaaggaggttggatttctactgcctcattctcattttttataaaaaagcagaacttctctgggagttcatgacctttctggggcagtctgtgtaaacagagagatctggcctaagacataagtgaaaattgcttatcttgtcccgggaggcgaaagccccttctctagaaatttagttcaagagtaattttattctcaaatagatgtaattatacgagaatcacaggctaataatggctaccttttgtaataaagactg

SEQ ID NO: 141343 - DNA, 601 bp, Human
cccacgctgggtggggccctggaggcccagaggctaatgtgtctggttctcatgcaccacctcttagaggaaacaaacattttgatattcacaactagatagattactgaaaagaaagaaatgcagagtggggcccactgtctgtagaaaaagctcctgccctggccaggaggaagctggttaaaccatgcaaagactcctgttgtctgcctggggaaagaaaagacctcaagtgtttcctggggttttcttctgcaggttgttcggttcagggacagggtatggagtacaaccgggagcagtcaaggtctgtgtaatcccaagaagtctcagactctgaaactctaggctatgatgaagaacaatgaattgtcagcagcctgtatattaggatggggggaaaggaccacatgcgaatattttaaagcttcaaactgacaatatcatgtccattacttttgtttgcagctccatacacttgtaatttatcacagtaaaattttatacttctttatatggtggtttgattaatgcctattttcccccactccttaatgctctatgtctttcttctattttattgccagcacctaacactgtc

SEQ ID NO: 141344 - DNA, 601 bp, Human
acaattgatttttctctcaaggttttttagacctaaattaatttttaatatactgacccaaggtgcccagttatttttagataaaactgtcaactatcccttaacctaaaagtaggctgtgagacataagatagttaaagcattacagtgccagaaacctacacgaatggaggtttcgtgcccactggtctcatgccaactgcacatagaaatgctggcgggtaaacagcactaaggggacttgggaacctgtccaggggctcgctctgctccactccaagtcagttcacaggtgccagcyccacccaggcccctaatcacaaggcagatgaacacatcagccaaagtaccctctagaaagggaccaggaccactcatgcataaggcacaggaggagcaaacttgcctatttagaagttttcagattcaacattgtttagttcaaaactcagcgcctggcagcctgtcctcaggtaccaagcacctaagtagcattggggggtgaggggctggggtcatgctgagctgttcaaagaagaaggaaagtccttccctctacaactccctccttgaaactaacagctcatttactgagctttag

SEQ ID NO: 141345 - DNA, 601 bp, Human
tttgtgagtaacccaggattcctctgccacgccacccactgcgtactgcattcccaatgtgaaggtcttcttggttttcttctaatgcccggttccacttcagggccttccacttcctctctctctgcccagcatgccctcccctggcctctgggggctcctccctcactttgctcccatctctggtcttatcccatctcccagagaggtcttccttcctgcataccttcccaaatatgcccactccaccctcacaccaaagcaatctaacccttaccaagaggggttttgtcccaacatytgtccctgccccagattaacttgttgagtggaatatatggcagaatgcaagctctctgaggaggctctgccctcacggctgcatgcccagaacccagacccagcctggagcctggcaggcatgcaatagcagatgcatggttcggtagctttcctttgattgactgtcttagcatgggttcccacccctgcaccagccactctgaccaaggagagaaaggtatcacttgctgaaggtagagccaggtgctccatcctggagctggggggatgccccatccagacaccaagagctgagatc

SEQ ID NO: 141346 - DNA, 601 bp, Human
agagtggtcttgtttttgccttgctccatcatggtcactggcattttgtgacattggttatgtttggtgtgagacctgactgtgagggctgggccagctcccggcagcaccaaggcccggtgggcagtccgggccatttcctggctgtcagcggctgcttttctttctcttagttcttccacgtttctccccatcacttctagctcttcctttcttctattcagagcttttatggattgatttctcacctgattatgggtcacattttcctgcttcgtgacacgtgtaataatttttattggttcctggacattatgaatgttgcattagagtgtctgtattttgttgtcttcatttatagagtgctgagattagttttgacaggcaggtaagttatatgtaaattagcgtgatcttttcgaggcagttttataattttaagcttttagagcagatggagagtaggttttctgtagtaagttagcccagtgcccaatttgtgaccattttggggttcttactgattttctcatacatttagtgaggtttctctactctggctggtgggaaccagccccatgtgttgtgatacttattcagg

SEQ ID NO: 141347 - DNA, 601 bp, Human
tttcctttgtgcaccactctggctactagactaatcaggaccttgtctaccaattatccacaaaatgaaatttcggaaagtctgcctcttttagagacaactttcttaaagtgttccatgatacatcaataccatctagctacaaaagtaaatacgcacaaaatattttatctcagtggacattttaacttgttaaataaagcactttctagttagtggtttgctctgattggcatttctaaaaacaactttatgagttataacttacagaccataaattcacccatgttaagtgtacaamttaaatgatttttactaagtgtacagagatatgcaaccatcaccataatgtaaatttaaaacatttttattcccccagttagatccctcatgcccaaaggcccgctcccaccccaggctcaggcaaccaacacatcactgtgtctccatggatttggctccctttctgggcatttgacacaaatggaatcacataacatgtggccttacatgtctggcttctttatatttttgagatttatccatgctgtagcatattcattctcttttgttgctaaaatagtatatatttttttaccgt

SEQ ID NO: 141348 - DNA, 601 bp, Human
actctggctactagactaatcaggaccttgtctaccaattatccacaaaatgaaatttcggaaagtctgcctcttttagagacaactttcttaaagtgttccatgatacatcaataccatctagctacaaaagtaaatacgcacaaaatattttatctcagtggacattttaacttgttaaataaagcactttctagttagtggtttgctctgattggcatttctaaaaacaactttatgagttataacttacagaccataaattcacccatgttaagtgtacaaattaaatgatttttastaagtgtacagagatatgcaaccatcaccataatgtaaatttaaaacatttttattcccccagttagatccctcatgcccaaaggcccgctcccaccccaggctcaggcaaccaacacatcactgtgtctccatggatttggctccctttctgggcatttgacacaaatggaatcacataacatgtggccttacatgtctggcttctttatatttttgagatttatccatgctgtagcatattcattctcttttgttgctaaaatagtatatatttttttaccgtatagctgtatcctat

SEQ ID NO: 141349 - DNA, 601 bp, Human
ctaccaattatccacaaaatgaaatttcggaaagtctgcctcttttagagacaactttcttaaagtgttccatgatacatcaataccatctagctacaaaagtaaatacgcacaaaatattttatctcagtggacattttaacttgttaaataaagcactttctagttagtggtttgctctgattggcatttctaaaaacaactttatgagttataacttacagaccataaattcacccatgttaagtgtacaaattaaatgatttttactaagtgtacagagatatgcaaccatcaccawaatgtaaatttaaaacatttttattcccccagttagatccctcatgcccaaaggcccgctcccaccccaggctcaggcaaccaacacatcactgtgtctccatggatttggctccctttctgggcatttgacacaaatggaatcacataacatgtggccttacatgtctggcttctttatatttttgagatttatccatgctgtagcatattcattctcttttgttgctaaaatagtatatatttttttaccgtatagctgtatcctatttgtttacagttgatgagcacttgtgtcatt

SEQ ID NO: 141350 - DNA, 601 bp, Human
agttagtggtttgctctgattggcatttctaaaaacaactttatgagttataacttacagaccataaattcacccatgttaagtgtacaaattaaatgatttttactaagtgtacagagatatgcaaccatcaccataatgtaaatttaaaacatttttattcccccagttagatccctcatgcccaaaggcccgctcccaccccaggctcaggcaaccaacacatcactgtgtctccatggatttggctccctttctgggcatttgacacaaatggaatcacataacatgtggccttacrtgtctggcttctttatatttttgagatttatccatgctgtagcatattcattctcttttgttgctaaaatagtatatatttttttaccgtatagctgtatcctatttgtttacagttgatgagcacttgtgtcatttccacattttggctattaataatactgctatgaatgttctcatgcaagtctttgtatagatgggcatttatttttaaagcacttttctaagaaaggaaataatttatactttggaaatttcatatcaagaattaattgtatacagttagttggtctggataatt

SEQ ID NO: 141351 - DNA, 601 bp, Human; identical to SEQ ID NO: 27190

SEQ ID NO: 141352 - DNA, 601 bp, Human; identical to SEQ ID NO: 104177

SEQ ID NO: 141353 - DNA, 601 bp, Human; identical to SEQ ID NO: 104178

SEQ ID NO: 141354 - DNA, 601 bp, Human; identical to SEQ ID NO: 104179

SEQ ID NO: 141355 - DNA, 601 bp, Human; identical to SEQ ID NO: 104180

SEQ ID NO: 141356 - DNA, 601 bp, Human; identical to SEQ ID NO: 104181

SEQ ID NO: 141357 - DNA, 601 bp, Human; identical to SEQ ID NO: 104182

SEQ ID NO: 141358 - DNA, 601 bp, Human
ctctgctgtgaagccaaaacaaccagcagcatcaggaaaaatcagacatgctgcttggccgagcaggagcccgcaggtccgtgggccgcgggtactcactccagccagggatttctggatgttctctctggctctcgcaatgtcacggaggatcacgctggcgccgttctcctgcagacagtgcagaaagaaccagtcttttttttattattaaaaaagaatttaattaaaaaacaaaccaaaaaaccccatgaaccctcacatagagacagcaagaaagtactgcacagaacgagagctyggcgggccagaaaagcgggagatgcctgaggctgtgacgacaggcaaaggcgcccatgtctgcgggggaaggagtgccaggcctggccccacaccaagtgcacaggcgccggcaggagggccctgagcagacccggcccgggggcccggccaaggccgcctgccccgagaccccactcccagcacccacagcagagccactgggccagggtgcctctgccttcctggcctggctgaatccgctttgtgtgccccggccactcctgtcgggcagcagagccgcccagccgccccacgtgca

SEQ ID NO: 141359 - DNA, 601 bp, Human
cgagagaggcgcgagatggaagtggaggcggggcggggatgaggctgcctgctgagcaccttgaaacaagcaacgtgggcatccaccagaatctgggagaggcaaaggaacagactcctcctgagcctttggaaggatggcgaccttgctgacactggggacagcctcgtgagacacatttcagatttctggcctggaaacccggcatgatacagatgtactgtttccagcgtgaggctgtggaaagccatagcagcagccacagaaacactgaccccgttcttggggccaggacaccacyccgtcccggggagaacgcagtcccaactcctcgggaacaccagggctgccacctcccggaggacaccccttccccagccagcctgtcaggccacagctactgcctccaactcctgatcttggcccggggcctggaggccaagcagggatacagggctccttctgggtctccaactcaagacggtgccaactctaggctctgaactccttgcgccttgcagaaccaccacttctctctccccagtgaggcaagatctaagagggaatgtgggaaggcccagcagacacacagtcctgccac

SEQ ID NO: 141360 - DNA, 601 bp, Human
ttcaaacctcacgtgacccgccgggctggactgtgaaactgcctgggactagtgacgccctgtttccttcttctttttcccattttgaaagggaatgcctgtcccacaattgtattttgggagcagataacttgctttccagtttcactggtccacagatggagaggaattttgcctcaggatggaccacgcaatcccccatgcctgattggatgggattctggactttggagggacactgtgggggacccaggcttctgcagatgttggtgaggagcaatgcaccttacaaatgagacamtgagaatctccggcgcccacgtcccaacccccagagcctgcaaatccactaccttacatggcaaaaagaagaattggcaaacacgattaaattcaggattttgaggtgggaacatcctggacctgggatcctgggggcccaaagcaagtacaagaaccacgtaagtgacagagcgaggcaggaggttcgagagaggcgcgagatggaagtggaggcggggcggggatgaggctgcctgctgagcaccttgaaacaagcaacgtgggcatccaccagaatctgggagaggcaaaggaacag

SEQ ID NO: 141361 - DNA, 601 bp, Human
cgcctccttgtcctcctcctcattgtcactgccaaacaggtcaatgtcatcatcctcgtcatcctctgctggtgtggctggcttcttggctgggggctccacttggcgcatgggagatacgtgctgccacaggggaagggacaggaggcacggctgagacgccccaaccagggcccagagctgcctggccacctcctggccctcctccctcctttgactggaggaagggcagcccctgtgtaccgcagctgtgtacatgcagggccccaggaaagacaaaaactgcctccacctgcccagrgctaactgtaaaccttcctggggacctgaggactccagtatcctggctgccagctcatcactgctgctggggccagcccacagggcgacgtggaagccagcagggccacgtggtcccctgcagtgtcaggcgtggggagagcattcacctgggtctgtggggccgtggcccggtggccaggcgagctcttctccagcacgttcagccgggcctccagcttggagatggcctgctgcagctcctgtaccactgggggggcaaggggagcacggttagatggcaggggccagggacagcccc

SEQ ID NO: 141362 - DNA, 601 bp, Human
gagccaggagcctcctctgaggtggggttcactctgggactcgctccccactgccgtggggtggagtgcagggtatgggccagggtccccagtctcctctcccctcctctccccggccggctcactcacgtgctcctcaaacttggtgatctcctcctccagcaagtctgtccccaccttgtcgtcctccaccacacactgaatctgtagcttccggataccgtagcccacgggcaccagcttggaagccccccagaccagcccgtccagctggatagagcgcacacaggcctccagctgrgccatgtccgtctcatcatcccactgtggggaaaggggaggaaaagctggggtcagccaccctcagaacacccaggaagtacctgcatgcaccctaccctcaaccactgtgtgtccacaattctgtttccttaaagggcccacagaaaacaatccaaattcacaccttcctgcctccaagtttgtgtttatcccaagacttctaaactcggctttaaagtctccccagaacccagagggcagggggagggtcacaggctgagccggctaggcgggcaccagggcagtgcctggccccctg

SEQ ID NO: 141363 - DNA, 601 bp, Human; identical to SEQ ID NO: 24902

SEQ ID NO: 141364 - DNA, 601 bp, Human; identical to SEQ ID NO: 24903

SEQ ID NO: 141365 - DNA, 601 bp, Human; identical to SEQ ID NO: 24904

SEQ ID NO: 141366 - DNA, 601 bp, Human; identical to SEQ ID NO: 24905

SEQ ID NO: 141367 - DNA, 601 bp, Human; identical to SEQ ID NO: 24906

SEQ ID NO: 141368 - DNA, 601 bp, Human; identical to SEQ ID NO: 24907

SEQ ID NO: 141369 - DNA, 601 bp, Human; identical to SEQ ID NO: 24908

SEQ ID NO: 141370 - DNA, 601 bp, Human; identical to SEQ ID NO: 24909

SEQ ID NO: 141371 - DNA, 601 bp, Human; identical to SEQ ID NO: 24910

SEQ ID NO: 141372 - DNA, 601 bp, Human; identical to SEQ ID NO: 24911

SEQ ID NO: 141373 - DNA, 601 bp, Human; identical to SEQ ID NO: 24912

SEQ ID NO: 141374 - DNA, 601 bp, Human; identical to SEQ ID NO: 24913

SEQ ID NO: 141375 - DNA, 601 bp, Human; identical to SEQ ID NO: 24914

SEQ ID NO: 141376 - DNA, 601 bp, Human; identical to SEQ ID NO: 24915

SEQ ID NO: 141377 - DNA, 601 bp, Human; identical to SEQ ID NO: 24916

SEQ ID NO: 141378 - DNA, 601 bp, Human; identical to SEQ ID NO: 24917

SEQ ID NO: 141379 - DNA, 601 bp, Human; identical to SEQ ID NO: 24918

SEQ ID NO: 141380 - DNA, 601 bp, Human; identical to SEQ ID NO: 24919

SEQ ID NO: 141381 - DNA, 601 bp, Human; identical to SEQ ID NO: 24920

SEQ ID NO: 141382 - DNA, 601 bp, Human; identical to SEQ ID NO: 24921

SEQ ID NO: 141383 - DNA, 601 bp, Human; identical to SEQ ID NO: 24922

SEQ ID NO: 141384 - DNA, 601 bp, Human; identical to SEQ ID NO: 24923

SEQ ID NO: 141385 - DNA, 601 bp, Human; identical to SEQ ID NO: 24924

SEQ ID NO: 141386 - DNA, 601 bp, Human; identical to SEQ ID NO: 24925

SEQ ID NO: 141387 - DNA, 601 bp, Human
tggtattgggcgcctgtaatcccagctactcaggaggctgaggcaggagaatcgcttgaacctgggaggcggaggttgcagtgagccaagatctcaccactgcgctccagcctgggcgacaagagcaaaacttcatctcaaaaaaaaaaaatttgtccgagggaaaggggttcaggcagctcactacccagacggaggggacacccatagctctagccaagcccccgaggtgccctgctcccctttttggcagggagagctccacgtctagcctttctggcagtgtcgagctgcacgggcrttacccaccttagcagtgcacacgtgctccccgtaatggcggatcacgtctccctgcatcaccaggtgcagctgctccttggtcagcaggggcagggccgcgcccagcaggcggaaacacaggtagctaaagggggtgcaggacagagcctggtcagagcccttggtgcccctggtgggaacctcaggactagtggcctagcccacttcacggacagggaagggggccgagagaggacacgcgtcgcccgcacctggctggccagaactgcatcttcagcagcccttgttccaccacctc

SEQ ID NO: 141388 - DNA, 601 bp, Human
gggaggccttggttggtgacagatgagaaggccactagcacggccagctgccgctcagggtcatcctggcacccctctaggaaggtgcccacgtaatcgtccatctctggggcaaacttgaactgctttgggagctgcaagagttaggcatggcgctgagcccaccagcccaggggggcaggcggttaacaacccaacagccaagggggcaggcgggcaacagcccaacagcccaacagcccgggggcaggcgggcaacagcccaccaggcttgtgcccactacaggttaaatcgagcccyggcaatctcctgttgtacacagctaggctgtgcctgaacttgcaacagtccagtcaccccagtgcttttgtctggcgtcaaggcctctgtgggtctgactgccccagcttcagcacctccggccccagaaggcccctctttccgccttgctggatggggatggcctgttttcctggctcaacgcagggcagagtggtagttaggaggcgagactgacctgggttcaaagcccacgctgccaattcctagccgtgtcatcttcgggaccaaaaacaaccacctctcacgcgcttactcagt

SEQ ID NO: 141389 - DNA, 601 bp, Human
ggctctgacacagcaaactgcagcctcctctgtccaagtcaagttcggagatcccaaggctgggggcaggctccacatgtgtcctggaatcaccaggactctgctgctatcaaaggcctgacgtcaagaattggaaggggcatcgtggccaacctttccccaaacagctcatccacatgctgggctcagaataaccaaagctggcaagtaaggcaaccacagtcaagtggccagacgggagcaagcaagagacccacctactcaggctacagaagacctaaagcagccccaataagagcakcttatgtcatgagaagaaaactcaaaagaaatcagggtactgagcctcgaatgtggtcagggcttcttgatgggaagaaccgagcgggagagcccgttgccagaaggtgttcccacagcagggggtacagtgcaagctcctttgcctctgagtcttagtttctccatgtcaaacatggagagggggtgtctgcctcaaagctgtggggattacgagatcctgcatggaaagcctaggacaccagctggtgccgctaagtggccggagggatgtttccacctgtgacaaagttggcttcaa

SEQ ID NO: 141390 - DNA, 601 bp, Human
accccaagagctgagggcttttgagatggagtctcgctctattgcccaggctggagtacagtggtctgatctcggctcaccacaacttctgcctcccaggttcaagccattctcctgcctcagcctcccaagtagctgggattgcaggcatgtaccaccatgcccggctaatttttgtattttgagtagagacggggtttcaccatgttggccaggctggtcttgaactcctgacctcgtgatccacccccttgccccccttggcctcccaaagtgctgggattgcaggtgtgagcccccrcgcccagctagctgacggctttttcacacctaatacgcagttacaggatccaaaagcctgaaggggacaaggagtccaactcccccttggacactcaagaaaggcagaacctgacaaggatggtcagggtcccagagaagccagcaagccccagcccccaattcataattctagattattccctccatgcttggcttggcatgagagacagaattgaaagtcattagttttaactaatttaattacattgaactcatctgactggggataaccccagactcgagtgaggtggcgtggtgt

SEQ ID NO: 141391 - DNA, 601 bp, Human
ccctggccagtcacccccacaatccagaacagaagaccccagctggacaccccaagagctgagggcttttgagatggagtctcgctctattgcccaggctggagtacagtggtctgatctcggctcaccacaacttctgcctcccaggttcaagccattctcctgcctcagcctcccaagtagctgggattgcaggcatgtaccaccatgcccggctaatttttgtattttgagtagagacggggtttcaccatgttggccaggctggtcttgaactcctgacctcgtgatccaccccctygccccccttggcctcccaaagtgctgggattgcaggtgtgagcccccgcgcccagctagctgacggctttttcacacctaatacgcagttacaggatccaaaagcctgaaggggacaaggagtccaactcccccttggacactcaagaaaggcagaacctgacaaggatggtcagggtcccagagaagccagcaagccccagcccccaattcataattctagattattccctccatgcttggcttggcatgagagacagaattgaaagtcattagttttaactaatttaattacattgaa

SEQ ID NO: 141392 - DNA, 601 bp, Human
cactggggccaggccctgtccccagcccttctaaaccaggcaaggggctggccaaatggcagcagtggcatcaagaagcctccaacacccagccactggcccgccctggccagtcacccccacaatccagaacagaagaccccagctggacaccccaagagctgagggcttttgagatggagtctcgctctattgcccaggctggagtacagtggtctgatctcggctcaccacaacttctgcctcccaggttcaagccattctcctgcctcagcctcccaagtagctgggattgcaggcrtgtaccaccatgcccggctaatttttgtattttgagtagagacggggtttcaccatgttggccaggctggtcttgaactcctgacctcgtgatccacccccttgccccccttggcctcccaaagtgctgggattgcaggtgtgagcccccgcgcccagctagctgacggctttttcacacctaatacgcagttacaggatccaaaagcctgaaggggacaaggagtccaactcccccttggacactcaagaaaggcagaacctgacaaggatggtcagggtcccagagaagccagcaagc

SEQ ID NO: 141393 - DNA, 601 bp, Human
cagtcacactccccacccctcctgactatccacgcagcgccccagctcccaggccttcacctccccagcacctgagctctgaaggcaggtctaccaggtgcctgcctgtctctcccacgcctgccaccgcctccctcctgggccctctgcctccagcacagcccctcccaaacccttctccacgctgccagccgtttctgaaaaggcaaaccagactcagaccctcccccccgccactgctcttgctgataatgcctctgtggcctccagcaccgctagggtcagggcctgcgagggtgcrggggtctgtggcctcgctgcttgcctgaccttccagctgcgtgtctgaccagctcccgtcaggatgctcttcctccctttctgccctgcccaaggcctcccagcctgacaaactcccatgcacactacacctccgaggactgggttgggtgtcccctgccacaggtgcacccactgtccccctccaccccagcacagccccacttgagactgtcaagggcagggatggaccccagctccagggcactgttggcacagccccacttgagactgtcaagggcagggatggaccccagctcca

SEQ ID NO: 141394 - DNA, 601 bp, Human
cccgggcgggcctgggtttgtgaagaatgcactgccagtcacactccccacccctcctgactatccacgcagcgccccagctcccaggccttcacctccccagcacctgagctctgaaggcaggtctaccaggtgcctgcctgtctctcccacgcctgccaccgcctccctcctgggccctctgcctccagcacagcccctcccaaacccttctccacgctgccagccgtttctgaaaaggcaaaccagactcagaccctcccccccgccactgctcttgctgataatgcctctgtggccyccagcaccgctagggtcagggcctgcgagggtgcgggggtctgtggcctcgctgcttgcctgaccttccagctgcgtgtctgaccagctcccgtcaggatgctcttcctccctttctgccctgcccaaggcctcccagcctgacaaactcccatgcacactacacctccgaggactgggttgggtgtcccctgccacaggtgcacccactgtccccctccaccccagcacagccccacttgagactgtcaagggcagggatggaccccagctccagggcactgttggcacagccccactt

SEQ ID NO: 141395 - DNA, 601 bp, Human
ctgtccacgcacgctggcagaactatctgagaaggcgtggcccgggcgggcctgggtttgtgaagaatgcactgccagtcacactccccacccctcctgactatccacgcagcgccccagctcccaggccttcacctccccagcacctgagctctgaaggcaggtctaccaggtgcctgcctgtctctcccacgcctgccaccgcctccctcctgggccctctgcctccagcacagcccctcccaaacccttctccacgctgccagccgtttctgaaaaggcaaaccagactcagaccctyccccccgccactgctcttgctgataatgcctctgtggcctccagcaccgctagggtcagggcctgcgagggtgcgggggtctgtggcctcgctgcttgcctgaccttccagctgcgtgtctgaccagctcccgtcaggatgctcttcctccctttctgccctgcccaaggcctcccagcctgacaaactcccatgcacactacacctccgaggactgggttgggtgtcccctgccacaggtgcacccactgtccccctccaccccagcacagccccacttgagactgtcaagggcaggga

SEQ ID NO: 141396 - DNA, 601 bp, Human
gtgaaatgcctggggctgctcctgggccaggccctgctcacctgcgggcccgtgggcatgtggctggggtcagtgccagctttctgcttctcctgtgtctcatgcacgcagccctcagcagtgttgcccttcaagacccggagcaggtagagagaggcgttgaagtggtagagggcggtgggggagtcgggctggcggccagcctgctgcaccaaccgctccacctgggcgtgcagggcccctgcgcgctcacccaagtcgtggcagtagcgccgggcacggcacaggtggtgcctgtgggtggtgaggacgagagctggtcagaacattctcggtccaccctgctccgccaagcagagccaacccaagtcccactttataagtggggaaacagacctagaagacgacagaggcgacccaggccacagaggagggcccagggccgcctgcaggctgcctggaagctgtgtgggctcagagtgctggggtgacaggggcgctccaggggagaacagaacagctccctgagtggaggctgcaccaagggccaactgcctgcctggggcacccctcctgtctacacttgtctctcatggggcag

SEQ ID NO: 141397 - DNA, 601 bp, Human
ctccctggctgtgaaatgcctggggctgctcctgggccaggccctgctcacctgcgggcccgtgggcatgtggctggggtcagtgccagctttctgcttctcctgtgtctcatgcacgcagccctcagcagtgttgcccttcaagacccggagcaggtagagagaggcgttgaagtggtagagggcggtgggggagtcgggctggcggccagcctgctgcaccaaccgctccacctgggcgtgcagggcccctgcgcgctcacccaagtcgtggcagtagcgccgggcacggcacaggtgrtgcctgtgggtggtgaggacgagagctggtcagaacattctcggtccaccctgctccgccaagcagagccaacccaagtcccactttataagtggggaaacagacctagaagacgacagaggcgacccaggccacagaggagggcccagggccgcctgcaggctgcctggaagctgtgtgggctcagagtgctggggtgacaggggcgctccaggggagaacagaacagctccctgagtggaggctgcaccaagggccaactgcctgcctggggcacccctcctgtctacacttgtctct

SEQ ID NO: 141398 - DNA, 601 bp, Human
ccgggggacccagatggccacctccagctgcctcccagccctgccctgatggctgcccacactcctgtaccaggcctggaaacctggctgctcaccctgaatcttctccaacccttccacagtctccagccctgccagccccttctcggctttctcacgggatgtggcagtgccaccccaccccctctcaccccgccctgcaggaggaggacagggtggcacagtcccttcccaagtcactcacccatccatggtttggtaactgcccaaatggcagcccagagccctggcccaggcactsagaagtttccccacatgacccccatccctgcagtccagcccgggcatggcactgctggccgggaggccccaaggcccccaagaggaacccgaacacgaccgcggactgggcccccgcctcacctcatgtttgcaggtcctgaagagaacgttgagcagctccagggaggacagtgcctgctgatgctgcgccttggtctgcgcctcccccagcacgcgcaagttctagggaagggtggccaggctgaggcactccggagagctgctcaaagcctttctgtttcccagccggaagtaaagc

SEQ ID NO: 141399 - DNA, 601 bp, Human
cttaccgagggaggaaacacgcgccccaggtgttggttctcctccttcccatagccaaaggcctggtctcagagtctcggtgtcctcccctccagcagtggcccgggcccacccacctccaagagggccactccccagcactccatcaccgcggggctgccaaagcgcttccccacccaaccctgccaccttcctgcacatcctgaatgggttattgttggaatccgccagcttccgggagccctgctctcctggcttcctcactatcagccagttttgtaaggccccgtcccgggcccctcctctgcctgccagcacccccttggcaagctctccctccacaagggctgactagcacctatgctgaagattcccaaaccccgccctctgggccagaccgggggacccagatggccacctccagctgcctcccagccctgccctgatggctgcccacactcctgtaccaggcctggaaacctggctgctcaccctgaatcttctccaacccttccacagtctccagccctgccagccccttctcggctttctcacgggatgtggcagtgccaccccaccccctctcaccccgccctgcagg

SEQ ID NO: 141400 - DNA, 601 bp, Human
tgctgcctcaccagtgacccctgccccttcctgggcctcagcctctccttctgcctgttaagtcatccgtgtctcttaccgagggaggaaacacgcgccccaggtgttggttctcctccttcccatagccaaaggcctggtctcagagtctcggtgtcctcccctccagcagtggcccgggcccacccacctccaagagggccactccccagcactccatcaccgcggggctgccaaagcgcttccccacccaaccctgccaccttcctgcacatcctgaatgggttattgttggaatccrccagcttccgggagccctgctctcctggcttcctcactatcagccagttttgtaaggccccgtcccgggccccgcctctgcctgccagcacccccttggcaagctctccctccacaagggctgactagcacctatgctgaagattcccaaaccccgccctctgggccagaccgggggacccagatggccacctccagctgcctcccagccctgccctgatggctgcccacactcctgtaccaggcctggaaacctggctgctcaccctgaatcttctccaacccttccacagtctccagc

SEQ ID NO: 141401 - DNA, 601 bp, Human; identical to SEQ ID NO: 21233

SEQ ID NO: 141402 - DNA, 601 bp, Human; identical to SEQ ID NO: 21232

SEQ ID NO: 141403 - DNA, 601 bp, Human; identical to SEQ ID NO: 21231

SEQ ID NO: 141404 - DNA, 601 bp, Human; identical to SEQ ID NO: 21230

SEQ ID NO: 141405 - DNA, 601 bp, Human; identical to SEQ ID NO: 21229

SEQ ID NO: 141406 - DNA, 601 bp, Human
cccacatttgaatgtgaacactggatttattattcagtcttccttgtcttgaatccgcgtcgataactcctagtgtccagtagccacccatgcaaaatgtgactaaaagtagaatgtaatttattttttagaccttaaatacttcctcttgatctgtaagttggctggaacagtgtaaactgatattttaacagatgtttatgttcttacgtatgtacagtgttttgtggcagttgttttattgggaagattgcctgctttctccacccctagatttttttttttttttttttttttttttcagaattagcagttgatgggctgcgttctactaaatccagctgctttgcaccaattctaacaattaaagtggggtttcccccctaaatatttggagaagattcatttaggtcatgcgtattattattttggatttcgagaaaaagctcccttttttcctaatccctttgatacattgatttacttttgtgtattctaaggaaattttgttcatttaagatacattcctccccaggaaggacaaattagatttgtctttctcagcctgggaaactgcagctttgtgtgtgctctctgtcca

SEQ ID NO: 141407 - DNA, 601 bp, Human
gcagtggctcatgcctgtaatcccagctcttagggagacagaggtgggaggatagcttgaactcaggagttcgagacctgcctgggcaataaagcgagaccccattcttcacaaaaagaaaaaaaaaagtgtaactgaaagctgacctgggccacgtgtggcccgctggctgtgcattgggcaagcttcatctaaacatggaaaaggtacagtataaaagataagaaatggtacacctgtatagggcacttaccgtgaatggagcttttaggactggaagttgctctggtaagtcagtgaktgagtggtgagtgaatgtgaaggcctaagacatcactgtacactactgtagatgttataaacagtgtatacttagacgactataaattaatgttaaaaataaagtaattcaactacaatgtctctaggcaataggaactttttggctctattataatcttatggggccacctttttatatgcagtcggttgttgactgaaactttatgtggcatgtgatcataatgcttggattctgaaagttttctctccaagggcgtgcaaccattttggtataaaagcaggtaagatgaagtgaaag

SEQ ID NO: 141408 - DNA, 601 bp, Human
ctggcttttcattgtacttgctgttcttttttttttttggagccagggtctcacttccatcacccagcctggagtgcagtggcaagatcatggctcactgtagcctcgacttccagggctcaggtgatactcccaagtagctgggaatacaggcatgccccaccacgcctgggtaattttttgtatttttagtagagatggggtttcgccatgttgcccatgctggtctcaaactcctaagctcaagccatccacctgccttggcctcccaaagtgctggggttacaggtgtgagccaccrtgcctggtctgcttgctgttctctttagtgttcttccctaagtttaactgccattttatttcctaacccacatttctaggaaaataagaatatagtttcacaaaatactgctgatctctaataagaatcttaccaagttgttagcatttattcaacaaattaaataaatacttgctgagtgcctaatatgttccaggtactgttttattttaagtttttgggggtacatagtacatacatattaggtgcatatatttatgggttacataagatactttgatacaagcatgcaatgtgtaa

SEQ ID NO: 141409 - DNA, 601 bp, Human
tcaaactcctgggctcaagtgatcctcctgccttggcctcccaaaatactgggcttacaggcatgaccaccacacctggccttaaatataaattataagtgttttaatgttatcacatatatccctaaaacttgatatatatgagttggcaaaaatatttttagatggaaaatggaggttcatcttacattcaggttgttttttaatagacatatagcctatttttaaaatatgcatttgggagaatggatgagtaaaagtgttacagagttctcatcttagtgggtagagtaggaaaggrcatcattatttagtttaaacattatcagtgctagagatgggcatttgatgccttgtgtaatagaaaagtgtgatagaacttccaaactagggtggtgtgaatatgggtgagaatgatttgaaacttgaccaagctagatataagcaaagtgaatagaggaacaaactgattatgataagtgaaaaataagatgaaaaggttagaccaaatataattatcatcacaatacatgtaaatgggctcaattctcctacctaaagatggcagttaccaagagggttaaaaaattaaaactagtgc

SEQ ID NO: 141410 - DNA, 601 bp, Human
catttgtatatttttcattttaaacaatgaatagttcaatcaaatagtaattgttcttgacagtaggtgttgatcaggtagacataattttatgttatgaaagtaaaatactgtgtttacatggtagtgccacattttgagaacctcctttttccttaggcagaaggttgggataaaattagaccataataagttggaccacaagttccttggattcaatatactgcttagtgtcagcccagatggacacacagaacctaaagagtctccatatgtttaatttgcccttttgtttaaatasacattcagcagggactggagaaaataccaagctgtgcctttctggcatacagtgtttattttgctacttcatcatgtgccaattactaaataatttccacagattgttatttcaggagaatacttacagtgaaggtctttggaaaggaaattcttagcattgtggaaatgagaagtaagcactgttctttttattctctaaattttcaacctatgggtttctcatttttttctctttcaaccatttggctatcaaatctgtgtttcaaatactaatcctttttttctcaaggactttttt

SEQ ID NO: 141411 - DNA, 601 bp, Human
atttgtatatttttcattttaaacaatgaatagttcaatcaaatagtaattgttcttgacagtaggtgttgatcaggtagacataattttatgttatgaaagtaaaatactgtgtttacatggtagtgccacattttgagaacctcctttttccttaggcagaaggttgggataaaattagaccataataagttggaccacaagttccttggattcaatatactgcttagtgtcagcccagatggacacacagaacctaaagagtctccatatgtttaatttgcccttttgtttaaatagwcattcagcagggactggagaaaataccaagctgtgcctttctggcatacagtgtttattttgctacttcatcatgtgccaattactaaataatttccacagattgttatttcaggagaatacttacagtgaaggtctttggaaaggaaattcttagcattgtggaaatgagaagtaagcactgttctttttattctctaaattttcaacctatgggtttctcatttttttctctttcaaccatttggctatcaaatctgtgtttcaaatactaatcctttttttctcaaggacttttttt

SEQ ID NO: 141412 - DNA, 601 bp, Human
tgtatttttagtagagacagggtttcaccatgttggccagactggtctcgatctcctgacctcaagtgatctgccccccttggcctcctaaagtgctgaggctgcagatgtgagccaccatgcctggctggaaaagggcagattttaaagtaactgttacatgctacagcatggatgaaccttgaaaacactgtgcccagtgaaagaagccagtcacaaaggatcacatattgtatgatttcatttatgtaatatgtccagaataggcaaatccgtagagagaacataaattgatgttatstaggctggggagttggagggaaatggagactgactgctaatgggcataggtttctttatggggtaatgaaaatgttgtaaaattgattttggtgattggcatactactctgtgaatacactaaaaatcattgaattgtacacattaaatgggtgaattgtgtggtatactaattatatcttgagctgttataaaaataaaacaaatggctagaaatggaaatagtcattgacattaaaactcagcagatgggccaggcgtggtggcccacgcctgtactcccagcactttaggaggccag

SEQ ID NO: 141413 - DNA, 601 bp, Human
tccttcgttaccctactttaagtgccggagagctaaggcctcacttatatgcacccagatgcccccgagatctccattttccccaaatgcataaaaggctaaaaacggccacattccccagcaccacggcgtggctgcagctcctttgtttaccatataagtcacaccgggggttcactcctcgccctctcccctgctttaaagccgagtgcggcggaagactgaggagcacccccaaactcctgctcagcccgagtcaagcaccgaaagcttcacaggtttttttcctgagccttgaagrgaaaccacatagccagaaccttttgaactcctaaccccgcagggatgtccgcctcccagaagagagccggcttcccaggcagcttaggaaacttaaccgagatcccagaaagaaggcgaggtgtagctccggtcgaacggagccccgaggcgacatcctctttacctgcaaagttgcaatcttcgggctgaagtgatgggatccgaggactgacggcgcgggtgccgtgcggggtgagagcacgcccggcaaattccaatggaattcccttagtcgctgctgagttttggagcattccaa

SEQ ID NO: 141414 - DNA, 601 bp, Human
ttaaaactgaaaaagttttacaagtctgtctatttttttttttaataaaacaactaaagcttccttctgtctcttcctactcctttggcttggtgcttactccttaagcaacttgctgcattttatagctatggaatttcactgggaagggcctctctaagaagccatgtgaacagggatacaccatagtggatacaccatagtgaatgcaggcagacaagataagagatccctttcctcagctctcctaaaccctcgatgcctttccagtattctcttgtctctagtcgcaaaagacagytgacttcacagctggaacaacaagttgtgcagtgaatcccagtgatttaaccaagtagcaaaccgggtcattggcttcattggcttcattggaatctcggttgccaggcgaactaggaatcactagcctgggtcgggcaacacggataaaagtgtttctgtttcttgacagagaatgaaaacgacgcagaatgtaatcgatcggtagaacattgatcactctccttccttcgttaccctactttaagtgccggagagctaaggcctcacttatatgcacccagatgcccccgagatctcc

SEQ ID NO: 141415 - DNA, 601 bp, Human
taatgagaaccaaataatcatggtggggtttccataggcattaaagaggtcaataacactggttccaattgagtctaggcaattcaatttctaaagtcaaagtgcacattagaatttgatttcataagctatatggcaatgatggttttggaaaaaggaaaatttaatagtttattgtattttccctttacctgacattattttcaaaaatacaacaatcatattttcataaaatattcagtccctaattttatagttctagctactgcttagtatttctcatatatctatctttacttayatatctatactaactttaagcactgatagttacaatacttactattgaacaaatgtgtgcatatttttatttttgttccaatatatgcatcgatcagaaaagagaaattatttcagttttcagctgctaactataatgctgatcatctgaattgctataaataatcctggcaattaaacatgcaggtataaaaataaaacagactatttccaaaaatatacacttaaaagtagttttaattcagtggggttaaaatcagtgcatcttaaagggggttattatatttcaatacaaatgtaa

SEQ ID NO: 141416 - DNA, 601 bp, Human
ttttaataaagacattttattaccagcttacagatggtcaaaaggttagcatgataactttttatttataaattataagctcatgagtatttctaaaaaattataatcttgaactttgttcataaaaacaaactttttttttctttttacatgtattagatttatatttaagaataagaaaggaagtcattttgagatcatcctgctcaagataagtagcttatctcttgctctgcttcaaaactgatggaactttaacagactattgtttcaaattctatccccatgatggggacagttktttatattccaatgttataatatttttaaaattcaagaaacaaatagctgaaaaaatgaatttatgaaacttgttaaaagattattgattgtattttagaaaccacaggaattaagtaaaaagagtgtagtctttaccatcaggtagacgtagtacctgatagtaaaatttgatatacttcaaatcctgccttcccacaaagcaattttgtgattttcataaatttcatctttctcaggttgttaaaatgtgataatacttcagtttcaaggtagatgttaagataacaatgaaaaatag

SEQ ID NO: 141417 - DNA, 601 bp, Human
ataagatgtagtataaacctaacatggcctagcatgaccttttttttaataaagacattttattaccagcttacagatggtcaaaaggttagcatgataactttttatttataaattataagctcatgagtatttctaaaaaattataatcttgaactttgttcataaaaacaaactttttttttctttttacatgtattagatttatatttaagaataagaaaggaagtcattttgagatcatcctgctcaagataagtagcttatctcttgctctgcttcaaaactgatggaactttamcagactattgtttcaaattctatccccatgatggggacagttgtttatattccaatgttataatatttttaaaattcaagaaacaaatagctgaaaaaatgaatttatgaaacttgttaaaagattattgattgtattttagaaaccacaggaattaagtaaaaagagtgtagtctttaccatcaggtagacgtagtacctgatagtaaaatttgatatacttcaaatcctgccttcccacaaagcaattttgtgattttcataaatttcatctttctcaggttgttaaaatgtgataat

SEQ ID NO: 141418 - DNA, 601 bp, Human
tattgaataatggtgggtaaattatttttgtaacataagaaataatatggtactcaatatattgtataagtgcaacattatcacaattggcatcattatataaaaatatgctaaaagtttagccaagtacaatattatgaaagtataaaatacattaattatgtcaattatgaagcatagtatttatggcactctaattcagttacaaactcacacagttttgaaaatcctccggttttctttaaaaagtttactgtctagatctggagacagatctttgccagcctgcaagacagaatayaacaagctctttgcttgtatttatacttgggacatctggagaaatgaaggaaactttcaaggatacggtcatattggatttaactaggcacaaactaggcactaactaggcactaactaggctttagtgcctgcagaatatttttacagaaacaaaaaggtagaagttattctagacagagggagctttgccaggaaatgcaacaaaaatgaaaagcttacgcatgtgccattcatctattgattcaattattcatttactaatattcaacaaatatctactgaatggataagattttag

SEQ ID NO: 141419 - DNA, 601 bp, Human
aagtttattgaataatggtgggtaaattatttttgtaacataagaaataatatggtactcaatatattgtataagtgcaacattatcacaattggcatcattatataaaaatatgctaaaagtttagccaagtacaatattatgaaagtataaaatacattaattatgtcaattatgaagcatagtatttatggcactctaattcagttacaaactcacacagttttgaaaatcctccggttttctttaaaaagtttactgtctagatctggagacagatctttgccagcctgcaagacakaatataacaagctctttgcttgtatttatacttgggacatctggagaaatgaaggaaactttcaaggatacggtcatattggatttaactaggcacaaactaggcactaactaggcactaactaggctttagtgcctgcagaatatttttacagaaacaaaaaggtagaagttattctagacagagggagctttgccaggaaatgcaacaaaaatgaaaagcttacgcatgtgccattcatctattgattcaattattcatttactaatattcaacaaatatctactgaatggataagat

SEQ ID NO: 141420 - DNA, 601 bp, Human
tctatgtccaacctatggagaacaaataaatcagtaattggatttcatcagaaggcataattcaatcaaggttataattccatctcactatgaaaacataatcttaccacaattttataaatgtgcataaatatggattttcaccatatgcaccacctacatatggaagtaccctactatggttgaggcagcagggaatgtgaattcatatacggcagctcctctgtcataagcctccaatcctagatccaattagacaattgaaaattcccatttgtaggactgatggagtgctagcagmgtataatattgaagaaacaaagggtatgtgaaacgctttgagcagtcgctgtcttcggtttacttatgtatctatttcattatatttaaagtaatccagatgaatttcaggcagaacctgaaacacttctaaaataaattgaattccagtgtattttatgagtagagtctcattaatcacattaaatatttgacaataatccttttatatatcaaagatgaaaagatctcattgtgactctcaaaaccagaagcattataagaaagtagattatcttttaaaaaacttcatttagataaa

SEQ ID NO: 141421 - DNA, 601 bp, Human
tggataaatattttgcattgttttgtgttacacttatatttctggtaactagcaaacactttcaaaataccatactggtaagagtttaggaaaatgaactgaaagtacttattgcataaattaaaattaaaatgttaaactgtttttaaaataaactattaacaatgattaacaacatcagtaatatatcaagtattttgttattttagacaggacatttgaaaatattcatatggtgaatatttttaatatttttctttaggattatattgagcactcattttagtgtaaaacactcaamcccaccacgaatcatgtaatgatattatcttcataatgccatagagagaacaatagatcatttttctgaagcacaacagactaaattcaatgtgccttttctgtacacaaaggaacaatgtaataacctgaaatctcctttcttaaaacctttttgtttaagcctttcttcatataaaattttcttacatagactaggaagaaatgtctatgtccaacctatggagaacaaataaatcagtaattggatttcatcagaaggcataattcaatcaaggttataattccatctcactatgaa

SEQ ID NO: 141422 - DNA, 601 bp, Human
gggatataaaaatcaaaacaattgaacacatggagataaagagtagaaggatgattaccagaggctggtatgggtaatgggggttgagagggagtggggacagttaatgagcacaaaaaatagtttgaaagaatgaataatatgtagtatttgatatcacaactgtgactaaagtcaaactcatttaactttacatttaaaaataactaaaagggcataaatggatggtttgtaacataaaagataaatggtcaagtgaacagataccccattttccatgatgtgattattactgactgcrtgcctgcatcaaaatatctcttgtaccccataaatacatacacctactatgtacacaaaaaattaaaaataaaaaatatacaaaatgaataaataaatcagtttacagataggacatggtgaaaaaagaggattcataaatgggaagagagctgtaaataaaatatacagattacaacacagagaacaaaaataaatggaaaaagcattaaaagaaaaagtacagtttactagaacatgacatagtgtgaaaagctacatacatctttatttggaggtcttaagaaggaaaaaatgaagg

SEQ ID NO: 141423 - DNA, 601 bp, Human
aaaaaagaatgagatcctgttacttacaacaacatggatggaactggaggtattatgttaagtgaacacacagagagacagcacagaaagacaagtattatatgttcttacttatttgtgggatataaaaatcaaaacaattgaacacatggagataaagagtagaaggatgattaccagaggctggtatgggtaatgggggttgagagggagtggggacagttaatgagcacaaaaaatagtttgaaagaatgaataatatgtagtatttgatatcacaactgtgactaaagtcaaactmatttaactttacatttaaaaataactaaaagggcataaatggatggtttgtaacataaaagataaatggtcaagtgaacagataccccattttccatgatgtgattattactgactgcgtgcctgcatcaaaatatctcttgtaccccataaatacatacacctactatgtacacaaaaaattaaaaataaaaaatatacaaaatgaataaataaatcagtttacagataggacatggtgaaaaaagaggattcataaatgggaagagagctgtaaataaaatatacagattacaacaca

SEQ ID NO: 141424 - DNA, 601 bp, Human
ctattcagctataaaaaagaatgagatcctgttacttacaacaacatggatggaactggaggtattatgttaagtgaacacacagagagacagcacagaaagacaagtattatatgttcttacttatttgtgggatataaaaatcaaaacaattgaacacatggagataaagagtagaaggatgattaccagaggctggtatgggtaatgggggttgagagggagtggggacagttaatgagcacaaaaaatagtttgaaagaatgaataatatgtagtatttgatatcacaactgtgackaaagtcaaactcatttaactttacatttaaaaataactaaaagggcataaatggatggtttgtaacataaaagataaatggtcaagtgaacagataccccattttccatgatgtgattattactgactgcgtgcctgcatcaaaatatctcttgtaccccataaatacatacacctactatgtacacaaaaaattaaaaataaaaaatatacaaaatgaataaataaatcagtttacagataggacatggtgaaaaaagaggattcataaatgggaagagagctgtaaataaaatataca

SEQ ID NO: 141425 - DNA, 601 bp, Human
attttccttttgtgtgtttgtttatgcaatcagtattgtcatcaatttaaaataccagattataagataatatttgcaagcctcatggtaacttcgaattgaaaatcacacaacagataccctgaaaatacaaaccaaaaacttaaatcataacaccatagaaaactaccttcatggaaagaagacagtaaaaaaggaagagaaggccacaaagcaatcagaaaacaacaaaatggtaggagtaagtctcccatccaagtattaaccaagcctgaccctgtttagcttccaagatcagatragattgggtgaattcagggtcacatggctgtagagtaagtctctatttatcaataacaaccttgaatgtaaatagaataagcttttcaatcaaaagacacagtatggctgaatggataaaaaaataaagccccatgttctatttgcctacaagaaacacactactataaagatacacatagactgaaaataaagggttggaaaaagatattacatgccaatggaaattttaaaaaagcaagcaggagtagctacacatatatctaacaaaatagatttcaagacaaaaactgtaagaaga

SEQ ID NO: 141426 - DNA, 601 bp, Human
aagaactcttgggcattaagtgaacactagcagtggcctggcagaactccaccatgggccagtggtggtgatgcccaccagatgaagctcctttgcctgtgaaaaggagaaggaagagtgggaaggacttcctattgtggtctgactttcaccttagctgcagtagaatggaacatcaggcaaattcctaagacttttgactctaatccctgactttcagaaaccatctctggagtcaccgagagcctggggaatctcactgccctggggaaaagaataaaaacctggcctgccgattgcrgaggcctaggactttgagtgaacataggtggtagccaggtggcagttacagcaggccttgggcaagacccagtgctgtgctggctttaggtcagtcccaacaaagtctagtgctgctggccacagaagtgcctgcataaccatacccttagttccagctgggtcagcccagaaagaaagagactcttatttgtttacctgaaagtgaggtaaatgaataacagtctcttcctggtaatccagagaattactacagatcttattaaagaccaccaaggcaggacccctacaagtctgcaaa

SEQ ID NO: 141427 - DNA, 601 bp, Human
cagatcttaaactggaagggattgtggaaaacaaaaacaaaaacaaaaaacacaaacttggattctccagcctcagaatgttcagcactgacaacctaacttttacttgatcaggctggagctgagaccgtgctgtgttgggagccaatcatggtcatcggtgttgggaagatggcatttctctcattcactcctgcatcatctggcacagattaaaattacagtgcacattagaaacaacacagaagacaaataatccacatctcacagagtaaatagtgtctaatttggattatatgaraactacccgatatattaaccataagctgcaacaatactgatggttaaatcagaaacaatgtctcacaggcagttttgaatgatatcttaaaatcatgtgatctggtctaatacagtgtttcccacatctgcagagcatctttaataaaatatattctatcaagatttataggcaattttagtgaaaacagtgaaaactgtaacacatgcagtagtgagctgtagcaccttccaatccttttataatggacatgaaataatagaaatggggattactcagaaaaccataggcctgaaaaat

SEQ ID NO: 141428 - DNA, 601 bp, Human
cccattgccaggacctagattcccacagtcagatgaaatctatgagcttcctgggaaggaggctgggtatgcatccatggaggctcacgcccttcatagaagggtatctcagaggtgaaatgtgattctggattactatgccatctagcttattatgtcattgtcccaactgacatggaaactgtgattcatctataccatcaaatactactgagcaataaacaataataagttattgatacaaaaaaacaacttggatgaatctaggtgcttgtgactaagatattccaatggaaaggawgactggctgtgaggtgcgttctcctgaagcttgtttttgaccatgcaataaactccttcccatggtggtagatgtagtgttgaggaacaaagtcaaaaccaagtcatcagactttgggttgagggacagattaaggatgtcagcccaaaatacaaatggaaacctcccttcttggacatgaccaagcagccactgagtctagaattttatctaaatccacgctaacttctgaacaaacctaaatgaattttcactcagaccgtccaacaggatctcattgtgcctaaaacagatcttaaa

SEQ ID NO: 141429 - DNA, 601 bp, Human
acctatggaatggagcaaaggcagtcctaagttgatgaatatcctaatttccctaatttgatcattataaaatttatagatgtatcagaacatcacaatgcaccccatgaatatgtacaattctgcctcaatgattaatgaaaataaaataaatatttaaaaaggggaagtggagatttgcaacaacatggagaacattatgctaagtgaaataagccaagcaaagaaagacaaatactgtacgatctcatttatagatggataaagtggaccttatgaagtccacaaatatatacagtgkactcataaagttgaactcacagaaatagagtagaatgatggttaccagaggataagcagggaagctgaaggaaatggggaggtggtgaccaaacagtacaaagtttcagatagataggagataaggttttgggatctattgcacataagagtgattatacttaataataatgtatgctacatttcaaagtacagatggcctacaacttacaatggttcaagttatgatttttcaactttacatgagtttgccttttagatttacaatattttcaacttaaatgagtttgtcaggacataa

SEQ ID NO: 141430 - DNA, 601 bp, Human
tttagatcacacgtacctgacagaaatatctacaatattctactcaacagcaacaggattcacattcttctcaagtgcatatggaacattctccaggatagatcacatattatgccacaaaacaaatcttaacaaatttaagagaactgaaatcatatcaagcggtttttcagagcacaatgatataaaattagaaatcaataataggaaaaaatctaggaaaatacacaagcatgtggaaattggacaacatgctcctaaataaccaacaggtcatagtgtaaatcaaaaaggaaatttwaaaataccttgagacaaattaaaatggaaacacaacatgctaaacctatggaatggagcaaaggcagtcctaagttgatgaatatcctaatttccctaatttgatcattataaaatttatagatgtatcagaacatcacaatgcaccccatgaatatgtacaattctgcctcaatgattaatgaaaataaaataaatatttaaaaaggggaagtggagatttgcaacaacatggagaacattatgctaagtgaaataagccaagcaaagaaagacaaatactgtacgatctcatttatag

SEQ ID NO: 141431 - DNA, 601 bp, Human
tgtagagtctttgtatggaattaaaagcaagttgttaccagcttaaagtagtctgttacaggatatttcctggtaacccacttagcaaaaacccccagtagttgcacaaaatatgcaaagaaagggttcaaagcataccgccacagaaaaccatcaaaccacaaatgaagacagaaagagaggaagaaaaaaaaaacatataaaataatcaaaaaacaaattaaaaaatgccagcaacaagtttttatgtaccagtaattacctcaagtgtaaatggattaaattcttcaataaaaagacrtagattggctgaatggattaaaaaacaagatccaaccatattttcttataagagactcactttactagtacagatacacacagattaaaagtgaaatgattggaaaaaagtatttcccacaaatggaaattaagagaataagagtagttacacttagacaaaatagactttaagtcaaatgttatttttaaaagacaaaaaggttattacataataataaaggaattgattcaccaagaagagataacaattgtaaatatatatgcacccaacatctgagaacataaatacataaagcaa

SEQ ID NO: 141432 - DNA, 601 bp, Human
taaaaataattgcagcaacaataaattgctaagaaatacaaattacaaaaatgaatgtaaattttggcattaaattaataaaaagtatgtgtggggttgtgaaagtgtagagtctttgtatggaattaaaagcaagttgttaccagcttaaagtagtctgttacaggatatttcctggtaacccacttagcaaaaacccccagtagttgcacaaaatatgcaaagaaagggttcaaagcataccgccacagaaaaccatcaaaccacaaatgaagacagaaagagaggaagaaaaaaaaaacatataaaataatcaaaaaacaaattaaaaaatgccagcaacaagtttttatgtaccagtaattacctcaagtgtaaatggattaaattcttcaataaaaagacatagattggctgaatggattaaaaaacaagatccaaccatattttcttataagagactcactttactagtacagatacacacagattaaaagtgaaatgattggaaaaaagtatttcccacaaatggaaattaagagaataagagtagttacacttagacaaaatagactttaagtcaaatgttatttttaaaaga

SEQ ID NO: 141433 - DNA, 601 bp, Human
atacatcaccactaggcgtgatttataggaattgctaaaagtagttctttaaggtgagatgaaaggctactaatgaataattaaaataacattttaaaattaaaaataaatcccaatggtagaagtaatatgtggtcatactcagaattctctaatattgtaagggtggtgtgtaaagcaactttatctctactaggagaattaaaagacaaaattattaaaaataattgcagcaacaataaattgctaagaaatacaaattacaaaaatgaatgtaaattttggcattaaattaataaaragtatgtgtggggttgtgaaagtgtagagtctttgtatggaattaaaagcaagttgttaccagcttaaagtagtctgttacaggatatttcctggtaacccacttagcaaaaacccccagtagttgcacaaaatatgcaaagaaagggttcaaagcataccgccacagaaaaccatcaaaccacaaatgaagacagaaagagaggaagaaaaaaaaaacatataaaataatcaaaaaacaaattaaaaaatgccagcaacaagtttttatgtaccagtaattacctcaagtgtaaatgga

SEQ ID NO: 141434 - DNA, 601 bp, Human
ccaatcaaattcaacccatagaggacatcaccaagatacattataatcaaattatcaaaaatcaaatacaaagaaataatactgaaagcagcaaaagataagaaacatcacattcagtggaggcacaatatggcttttggcagatttgtcagcagaaacacttcaggccagaagagaggcaaattctatattaatagtgctgaaggaataaaaagaaatggccaaccaagaatactttaccaaataaagctatgtttcagaaatgagaaagaaataaaaactttcccagacaaacaaaagmtaagagcatacatcaccactaggcgtgatttataggaattgctaaaagtagttctttaaggtgagatgaaaggctactaatgaataattaaaataacattttaaaattaaaaataaatcccaatggtagaagtaatatgtggtcatactcagaattctctaatattgtaagggtggtgtgtaaagcaactttatctctactaggagaattaaaagacaaaattattaaaaataattgcagcaacaataaattgctaagaaatacaaattacaaaaatgaatgtaaattttggcattaaat

SEQ ID NO: 141435 - DNA, 601 bp, Human
cagagatgactgcagagcccagccagcagctctacttgatggcagagtccagatagtagcctcactgaaccatggagaacagttagaaataccattcaaattcagagcacaagaatccacccagtctaattagagaacccaaccttaaggtctgtttggggtcgctacaagctgtctcatctagaatttttaagctagactaggctagaagaaatagccatctcctcaaatgtggaggcattaatgtaagtacatgaggatgatgaaaaattagggaaatatggcaccaccaaaagaagttaataaagctctactgatggacccagaagaaatggagatctataaaatgactaacaaaaaattcagaacactactcaaagaagttcaggaaattccaagaaaatatagatagaaaatcaagtaaaatttgggaaaaagttataaacaaaatgagaagcttgcaaagaaacataaataataaaaaattatgaagccataaattctggagctaaagaatacaaaaagtgaactaaaaaattaaatagaaagtttcaatagcagacttgatcaagtagatcagtgagctcagaggacatttgaa

SEQ ID NO: 141436 - DNA, 601 bp, Human
cctgcctcagcctcccaagtagctgggattacaggcatgcaccaccatgcccagctaatttttgtatgtttagtataggcagggttttgccatgttggtcaggctggtctcgaactcctgacctcaggcgattcacctgtctcagcctcccaaagtgctgggattacaggtgtgagccactgctccacgccagttcatggatctttcaggcttgaatccctagccagcttttccacccagcccagatgctctcgttaagctttttctaggtgagaggcaaatgcaggtcagtgagtacccrtgaatagatcatctagtactgccaaaaaccagcaactgcatgtaaaccagtaactccacaaaaccgtgatactcttcttcagctcacattaagccagcaggcaagtctaagtccatgcacatctgtaaagcatagcctctggctctgcctacttctgtgaccaagcagcaatcctaggtacttcaccagccttggatcccagcaaatggcccttcccaactgcagatttcaaatagcagtgccacccagccatggaagacaacctgcaaacctgtctgatcagagatgactgcagagccc

SEQ ID NO: 141437 - DNA, 601 bp, Human
tccttgattgtgccacccctctcccaagctggcacaggaacacacactaagatttttcctgaacccacagtttctacagtaggaaaaataagttggaagcaaacattaagtttccctacaattttggaaccctttcaggagactgatatctgtctcatcccatgggaaacattggaaatgccagcatggctagattacctgagtttagttagaaacaaagaacagagatagagctaatagtgaccagcttgcagaccttggtagttactctatatttgggctgataatggtgtcaaaccaragagactagctgacagcatcacactacaggaaacatggttcacaggtctttctttttttttttctttctttattttttgagacagagtttcactcttgttgcccaggctggagtgcaatggcacaatctcggctcactgcaacctccatctcccaggttcaagcaattatcctgcctcagcctcccaagtagctgggattacaggcatgcaccaccatgcccagctaatttttgtatgtttagtataggcagggttttgccatgttggtcaggctggtctcgaactcctgacctcaggcg

SEQ ID NO: 141438 - DNA, 601 bp, Human
gttacagaactatgtcttcaattgatgtttggtgacacacacacacacacacacacacacgcacacatacacacatgcacacacagagtagtgtgttagcaagacagcagaataggagttctccagcttcactctctcctacctaccacagaaatctaaccagcaactatccgcaggcaagaagataattctgaatatcccacaccttggaagtgagtcaaggacactcctttctttggaccaaagcactgagaaaattttgatcccaatggtaagatgaatgattctccttgattgtgcyacccctctcccaagctggcacaggaacacacactaagatttttcctgaacccacagtttctacagtaggaaaaataagttggaagcaaacattaagtttccctacaattttggaaccctttcaggagactgatatctgtctcatcccatgggaaacattggaaatgccagcatggctagattacctgagtttagttagaaacaaagaacagagatagagctaatagtgaccagcttgcagaccttggtagttactctatatttgggctgataatggtgtcaaaccagagagactagctga

SEQ ID NO: 141439 - DNA, 601 bp, Human
tcattaaaagtcagttagcaacttagcatgacaattatgtattttggggattgtaatgtgactttaagtttcaatgcagtaacacaaaactagagactagaagaaggtttgcagaaaagatattacatttagtatgtgattctttacaaaatactcaagaaaattgaacccagtagtgttaatatatcaactgcttaatggcacaaaaatgatttcagtcctgagggtgtccaggtatagtgttacagaactatgtcttcaattgatgtttggtgacacacacacacacacacacacacatgcacacatacacacatgcacacacagagtagtgtgttagcaagacagcagaataggagttctccagcttcactctctcctacctaccacagaaatctaaccagcaactatccgcaggcaagaagataattctgaatatcccacaccttggaagtgagtcaaggacactcctttctttggaccaaagcactgagaaaattttgatcccaatggtaagatgaatgattctccttgattgtgccacccctctcccaagctggcacaggaacacacactaagatttttcctgaacccacagttt

SEQ ID NO: 141440 - DNA, 601 bp, Human
attatagcacaatggttaataaacttggctttggaatttgtgaagtttgggttgaatttatggttgtactacatactaattgtgtgaccttagaaagttatttaaccattctagaactagttttgtcatctgtatagtaggaatgatgatgttttatgagggtaataatataaaataatgcaagtaaatcattcagcatagggccaaccacagactagtcactcatcaaatgttaactttgttactttgctaccattttcagaagaaagttggaaaacctagttatagccattattggaggtccttaaacttcacatgcttttagctatttggaattacagaatcattaaaagtcagttagcaacttagcatgacaattatgtattttggggattgtaatgtgactttaagtttcaatgcagtaacacaaaactagagactagaagaaggtttgcagaaaagatattacatttagtatgtgattctttacaaaatactcaagaaaattgaacccagtagtgttaatatatcaactgcttaatggcacaaaaatgatttcagtcctgagggtgtccaggtatagtgttacagaactatgtct

SEQ ID NO: 141441 - DNA, 601 bp, Human
tagggaacttttgtaatggcactaatcacataagggtagacccctcatgacccaataactttccaaaggcctcacctcctaataccatcactttcagggttaagatttcagcatataaatttttagagggaaatattcaggtcatagagctttttgaaaccagacattgataaataaggatgagaaatggaacgaaaagagtaaggatgctatattttcctagacgctgtacagctgtaattaaatctagtccttcaaaaatgaacactttagcaaatgctataaagcttttaaaagcttrgaaacaagatatcatacctgctaagactgataagaaaaacaaaggctgctcagtgattaatatgagtacatgaagatgttccagacttcaaacttgcattatagcacaatggttaataaacttggctttggaatttgtgaagtttgggttgaatttatggttgtactacatactaattgtgtgaccttagaaagttatttaaccattctagaactagttttgtcatctgtatagtaggaatgatgatgttttatgagggtaataatataaaataatgcaagtaaatcattcagcataggg

SEQ ID NO: 141442 - DNA, 601 bp, Human
aacaattagaaaatattcaaaaaacagaaagagaagctttactgaaaggtgatctatagatgacaaataagcacatgaaaagatgtttaacatcattagccattgtagaaatacaaaataatgccacaatgagatatcactactataaaaatggctaaaataagatatagtaatgacactaaatgctggtgaggaggtgaacagactaaatcattcatgcattgttagcaggtatgcaaaatgttacaactaactgctctaaaaaacagtttctttaaaaatgaagcatgcaactatcatrtgactcaacaattaaattatactctggacaggtatcccagataaatgaagacttacattcaaacagacatcttaaaatcataaaattttatttatattacagtctcaaaaagaaaaagaaaacttatggccaggcacagtggctcatgcctgtaaccccagcactttgggaggccaaggtgggtggatcacttgaggtcaggggtttgagaccagcctggccaacacggtgaaaccccatcaccactaaaaatacaaaaattagctgggtgtggtggcatacacctgtaatcccagatac

SEQ ID NO: 141443 - DNA, 601 bp, Human
catttctagttaagaggatgaaatgacaagctacagacttgaaaacatgtacaaatcccatatctaataaatagctaatatctaggatgcataaagaaatataaaactttaacactaaataaaaacaattagaaaatattcaaaaaacagaaagagaagctttactgaaaggtgatctatagatgacaaataagcacatgaaaagatgtttaacatcattagccattgtagaaatacaaaataatgccacaatgagatatcactactataaaaatggctaaaataagatatagtaatgacrctaaatgctggtgaggaggtgaacagactaaatcattcatgcattgttagcaggtatgcaaaatgttacaactaactgctctaaaaaacagtttctttaaaaatgaagcatgcaactatcatgtgactcaacaattaaattatactctggacaggtatcccagataaatgaagacttacattcaaacagacatcttaaaatcataaaattttatttatattacagtctcaaaaagaaaaagaaaacttatggccaggcacagtggctcatgcctgtaaccccagcactttgggaggccaa

SEQ ID NO: 141444 - DNA, 601 bp, Human
taactcaattttaataattcggtttcaataataaatcattagatattatcctgtcatttaatgagggatcattatgtaccaagcattgtgatttattttctatatcttaccaactgcactgtcagatagatattcttagtttcagtttatagatgagaaacctggggattacagatattaggtaacttatactaggttactcagctcctgaatatgaggatcaagattcaaactggaatctatgtagcatcaaatctgaggcttttaatcaactcccctagaaaaattggggtggcttcaracaagtcaaatgaaagacattgtgaaagtgtctgtcacagaaaaattatcatgctattatttttctcaaatgctgttaaccctaatattccatcaaccaagtattctatcctcctgccataatttactgtaaaaacaatcacatttgggtctgaaacatgatccttttattggatcatcaataattaattttcagacacaaattttactctaaacagaatttttgcaagcagaaaataatatgcattttttgtgttttcctctgaaaatttgtttactggttatgtcagtggaaactcca

SEQ ID NO: 141445 - DNA, 601 bp, Human
cgattataattatcaagaaaagttccccatttacagaagaagaaaagagtcctcaaggagttacataatctaccaaggtgacacagctactaagagatagagctgagatggactctggtacatctgatatcatgctcttatatatatcttataaagttagtctgagaattaaataatattcagaaagatttcaacgtagtgactacatagtatatgctccatcaatattgacaagtagtagtattgatattttattactgctagggcagtaccaagaggaattcccagggatttctaccarcaggatgccttgataccttgtagctattcgcattccctcctagagccatcatgtgcctgcttttcctctgttctccccctttgtggagtccttgctctaccgaaaaccaggtagtaaggactatagtaaaggtgatgagttcctggcctccaaatttgcactctaattacatctctttctttaaagcttagataccatcgtcagagtcaaggacattacttgttttataatacaggcacatccagggttaatctatgtctctagtcattaaagagaacatgatatcaatgaaaaagttac

SEQ ID NO: 141446 - DNA, 601 bp, Human
aggaaagttaagaatatatatacacctaaaaccatattctacatttgcatatacttgctttgctgggaggtcttgagtctttcttaagcctcagtacttctgtccacgattataattatcaagaaaagttccccatttacagaagaagaaaagagtcctcaaggagttacataatctaccaaggtgacacagctactaagagatagagctgagatggactctggtacatctgatatcatgctcttatatatatcttataaagttagtctgagaattaaataatattcagaaagatttcaaygtagtgactacatagtatatgctccatcaatattgacaagtagtagtattgatattttattactgctagggcagtaccaagaggaattcccagggatttctaccaacaggatgccttgataccttgtagctattcgcattccctcctagagccatcatgtgcctgcttttcctctgttctccccctttgtggagtccttgctctaccgaaaaccaggtagtaaggactatagtaaaggtgatgagttcctggcctccaaatttgcactctaattacatctctttctttaaagcttagata

SEQ ID NO: 141447 - DNA, 601 bp, Human
gcagagttaaagtcgaccacaggatatttttttttcataagtgatcttgttcacacagtccatataaatactgtcttgcacttaataattactaaaatatgtcatttgaatgaaataactcagatgatttcttttttagtaagtaaaaatttagaacttttacctattttaaaatcaaaagtatcaaaatgattccattgtactaaatttaccttttacttgccctgactctaatcaatatatacacaatattcacttctctatgtaccatattttaggtatattcttactcttgtatagrgagaagcattaaaggaaagttaagaatatatatacacctaaaaccatattctacatttgcatatacttgctttgctgggaggtcttgagtctttcttaagcctcagtacttctgtccacgattataattatcaagaaaagttccccatttacagaagaagaaaagagtcctcaaggagttacataatctaccaaggtgacacagctactaagagatagagctgagatggactctggtacatctgatatcatgctcttatatatatcttataaagttagtctgagaattaaataatattca

SEQ ID NO: 141448 - DNA, 601 bp, Human
tgtgaaaatggactaacacatattccaaacttcttatccaaccacatggaaatactgcaacattaaaatagagaaccattgatctgagccagctgttcttagtgtgtggtctccagatcagcagtatctgtgtcacctgggaacttattaggaatgcaaattcacatgctctacctctcacccactaatccaacactttggggcatagcctagcaatctgatgaactctagtttgacagtaacagattttgattctagacctttttataaaaacagacacactgaagtacaagtcacaaargcagagttaaagtcgaccacaggatatttttttttcataagtgatcttgttcacacagtccatataaatactgtcttgcacttaataattactaaaatatgtcatttgaatgaaataactcagatgatttcttttttagtaagtaaaaatttagaacttttacctattttaaaatcaaaagtatcaaaatgattccattgtactaaatttaccttttacttgccctgactctaatcaatatatacacaatattcacttctctatgtaccatattttaggtatattcttactcttgtatag

SEQ ID NO: 141449 - DNA, 601 bp, Human
acaggcccagagacctaggaggaaaaagtggtttaatgggccaggcccagagtcgctgtgctgtgtgcagcctagggacttggtgactttagttccagccactccagccatgactgaatggggccaacatagagctcaggccatggcttcacagggtgcaagcctcaagccttggcagctcccacatggtgttgagctttccagtgcacagaagtcaagaattggggtttggaaatctccacctagatttcagaagatgtatagaaacacccagatgcccaggcagaagtttgttacaggsgcagggccctcatagagaacctctgctagggcagtgcaaaaggaaaatgtagggtgagatcccccacacagagtccctaccagggcaccacctagtggatctgtgagaagagggccaccttcctccagaccctagaatggtgtatccaccaacagcttgcaccatgtgcctggaaaagctgtggatactcaatgccagcccatgaaagcagccaggagggaagctgtgccctgcaaaggcttggctgcccaagaccatgggaacccacctcttacctcagcatgacctggatgtgagact

SEQ ID NO: 141450 - DNA, 601 bp, Human
acagtgacaaagaaagataaaaggtataagtgagtagccaaaaaaagaggaagataacaaatgttttgtatcctagctattctcaagcttatttttagattcaacacataaggtgcatgacattagtatgtacagcatactcgtatgcacaattcccaatatattggttaatacatcaggaacaatataacaagggtaaatacaaatatgctctaacatttaattacttcttttctcaaaatttctagtttatatttaataatgaattatttgtactgaaatggtttggctctgcccccayacaaatctcatcttaaattcctgcatattgtgggagggtcccagtgggaggtaattgaatcatgggggcaagtctttcccatgctgttctcatgatagtgaataagtctcaagagatctgatggtttcataaagaggagttctcctgcacgagttctctctctttgcctgctgccatccatgtaagatgtgacttcctcctccttgccttctgcctgattgtgaggcttccccagccatgtggaactgtaagtccattaaacctctttcttttgtaaattgcccagtctcgggtatattt

SEQ ID NO: 141451 - DNA, 601 bp, Human
ccaatatgaaacctgttttctagcaacaattatcctttcaaagttggtagtcagttttacttgcttcagtcggctgactgtttcattctcttcggtggctcttaataacttttcattttaacttcatgccttcaaaaaattactacttcctccttctgagggcgttcattgtaaaatatgacctatgaatgtccagtgtcctccattcacagccatttctctctctggtattaatggttcatgtatgcttgtttctgctaaaggcaacacgctttacctgcactcttgtccaacatcttgytacttgcatctttcttgctcttgcatctttatgatgctgtacaaacaccatgggtttctttattcttgcatatcctgtcacatgtctttcctccttctctgtcttactagctactgagaacacccaagatactgacaggagtagtagagaaaggaagacgtgtgcagacagtgacgtagcagaagtcactggaaactttgacatgacagtgacaaagaaagataaaaggtataagtgagtagccaaaaaaagaggaagataacaaatgttttgtatcctagctattctcaagcttatttt

SEQ ID NO: 141452 - DNA, 601 bp, Human
ctcgctctgtcaccccaggctggagtgcagcagcacaatctcggctcactgtaatctctgcctcctgggttcaagtgattcttgagtctcctgcctcagcctcccaagtaactgggggtacaggcatgtgccaccatgcctggctaacttttgtattttgagtagagatgggttttcaccaagttggccaggctggtcttgaactcctggcctcaagtgatctgcctgtattggcctcccaaagtgctgggattacaggcatgaaccaccagcaggcccagcctgtttttttttttaattytttttttaaatcctgcatattgtcgatggaagaaaaacaaaacaaaacaaaataaaagcacattggaatgtttgccaatatgaaacctgttttctagcaacaattatcctttcaaagttggtagtcagttttacttgcttcagtcggctgactgtttcattctcttcggtggctcttaataacttttcattttaacttcatgccttcaaaaaattactacttcctccttctgagggcgttcattgtaaaatatgacctatgaatgtccagtgtcctccattcacagccatttctctctct

SEQ ID NO: 141453 - DNA, 601 bp, Human
agagtctcgctctgtcaccccaggctggagtgcagcagcacaatctcggctcactgtaatctctgcctcctgggttcaagtgattcttgagtctcctgcctcagcctcccaagtaactgggggtacaggcatgtgccaccatgcctggctaacttttgtattttgagtagagatgggttttcaccaagttggccaggctggtcttgaactcctggcctcaagtgatctgcctgtattggcctcccaaagtgctgggattacaggcatgaaccaccagcaggcccagcctgtttttttttttaattttttttttaaatcctgcatattgtcgatggaagaaaaacaaaacaaaacaaaataaaagcacattggaatgtttgccaatatgaaacctgttttctagcaacaattatcctttcaaagttggtagtcagttttacttgcttcagtcggctgactgtttcattctcttcggtggctcttaataacttttcattttaacttcatgccttcaaaaaattactacttcctccttctgagggcgttcattgtaaaatatgacctatgaatgtccagtgtcctccattcacagccatttctc

SEQ ID NO: 141454 - DNA, 601 bp, Human
gttatacttgcattttctataactgagctaataaatcatgataccttaatattttttattcattggaatactatttatcttcatgctatatttgcatttttcacataaatttagttcatcaggtgacatattcagaaactgcaatatgagttcatgccaatagtctatctgtcccagatattacataaatttcggcacatatttcacttaaaacataaacactgtttataaatgttctacatagctatcttcttttcaagactctgagtacaatattgacaaaacatttaattttttcackcttatgcatccttccaaattctaattgtttcctaacctaaattatgtgttgtttttgaatactttaagtcacatgtactttcaattgattttgactattttatgtttttagttaaggaaagttcctacttaatacattaaagaatcaaaactttgcccactgggtttttgtttacgtgtgaattatattactgaaagtgggtcaaaaatgatcaagctatttcaaaattattttctatgaactctaaaccacaaacacttgtcacattgaaaaagattactttcctcataaattcccaac

SEQ ID NO: 141455 - DNA, 601 bp, Human
agtctgacagtacagttttatcttcaaacaagaaactgctatcaagtgtagcggttatacttgcattttctataactgagctaataaatcatgataccttaatattttttattcattggaatactatttatcttcatgctatatttgcatttttcacataaatttagttcatcaggtgacatattcagaaactgcaatatgagttcatgccaatagtctatctgtcccagatattacataaatttcggcacatatttcacttaaaacataaacactgtttataaatgttctacatagctaycttcttttcaagactctgagtacaatattgacaaaacatttaattttttcactcttatgcatccttccaaattctaattgtttcctaacctaaattatgtgttgtttttgaatactttaagtcacatgtactttcaattgattttgactattttatgtttttagttaaggaaagttcctacttaatacattaaagaatcaaaactttgcccactgggtttttgtttacgtgtgaattatattactgaaagtgggtcaaaaatgatcaagctatttcaaaattattttctatgaactctaa

SEQ ID NO: 141456 - DNA, 601 bp, Human
gaggatatagtttttaaatttttttattgtctttgtattttagctaagaagagtagtctgacagtacagttttatcttcaaacaagaaactgctatcaagtgtagcggttatacttgcattttctataactgagctaataaatcatgataccttaatattttttattcattggaatactatttatcttcatgctatatttgcatttttcacataaatttagttcatcaggtgacatattcagaaactgcaatatgagttcatgccaatagtctatctgtcccagatattacataaatttcrgcacatatttcacttaaaacataaacactgtttataaatgttctacatagctatcttcttttcaagactctgagtacaatattgacaaaacatttaattttttcactcttatgcatccttccaaattctaattgtttcctaacctaaattatgtgttgtttttgaatactttaagtcacatgtactttcaattgattttgactattttatgtttttagttaaggaaagttcctacttaatacattaaagaatcaaaactttgcccactgggtttttgtttacgtgtgaattatattactg

SEQ ID NO: 141457 - DNA, 601 bp, Human
gcatcctactcagtcttcattcagccttcacaaaaccatccacccatttggctttccaggatcttagctgttttctaattttaacaaaaaaatggaggatatagtttttaaatttttttattgtctttgtattttagctaagaagagtagtctgacagtacagttttatcttcaaacaagaaactgctatcaagtgtagcggttatacttgcattttctataactgagctaataaatcatgataccttaatattttttattcattggaatactatttatcttcatgctatatttgcatttytcacataaatttagttcatcaggtgacatattcagaaactgcaatatgagttcatgccaatagtctatctgtcccagatattacataaatttcggcacatatttcacttaaaacataaacactgtttataaatgttctacatagctatcttcttttcaagactctgagtacaatattgacaaaacatttaattttttcactcttatgcatccttccaaattctaattgtttcctaacctaaattatgtgttgtttttgaatactttaagtcacatgtactttcaattgattttgactatt

SEQ ID NO: 141458 - DNA, 601 bp, Human
tctcaatgcatcctactcagtcttcattcagccttcacaaaaccatccacccatttggctttccaggatcttagctgttttctaattttaacaaaaaaatggaggatatagtttttaaatttttttattgtctttgtattttagctaagaagagtagtctgacagtacagttttatcttcaaacaagaaactgctatcaagtgtagcggttatacttgcattttctataactgagctaataaatcatgataccttaatattttttattcattggaatactatttatcttcatgctatattkgcatttttcacataaatttagttcatcaggtgacatattcagaaactgcaatatgagttcatgccaatagtctatctgtcccagatattacataaatttcggcacatatttcacttaaaacataaacactgtttataaatgttctacatagctatcttcttttcaagactctgagtacaatattgacaaaacatttaattttttcactcttatgcatccttccaaattctaattgtttcctaacctaaattatgtgttgtttttgaatactttaagtcacatgtactttcaattgatttt

SEQ ID NO: 141459 - DNA, 601 bp, Human
tgaaaagtaccacaacgactttcacaaccatctgggcatattcttaggatacagagttttgcccattaattcacttagctgttaacgtctttcctactagtgaagatgggcagctgacgatcttaaaaatgaaaagatactctcctcctgctctgtcaaagagacagactgtgcttcctgtgagtggttctttacttagccttgcctttgggtctagaacatcagctgccacctgcagatgcacctgcaaacctaattttatggtaagaagtaagatatttctggcatctcggggttttgygcctcaactgtcagaagaataatttagctggactcttaggagatctgtggttgtggggccttttctcaatgcatcctactcagtcttcattcagccttcacaaaaccatccacccatttggctttccaggatcttagctgttttctaattttaacaaaaaaatggaggatatagtttttaaatttttttattgtctttgtattttagctaagaagagtagtctgacagtacagttttatcttcaaacaagaaactgctatcaagtgtagcggttatacttgcattttctataactgagct

SEQ ID NO: 141460 - DNA, 601 bp, Human
gttagatgtgtttttatttatcctactatgtctattactttgttttcagcagtatcgagtcctgcttcttataatttctctcttttcctggattcattttatttatttcatttccttgctgcactctgccagttcatagttcttttttcttgtttatctcttcctaagctccttcattattgatttggtgcttttgcttcacagagatttttaaaaattcatagtaaaatgccattttcttctgcttctcattctatgtttctggcatgcattcttcatctcctattttattttctgccarttttttctgattattttcctgcattatatttctaaagcttctgtactttttctttcttaactcatcattgaactcatgatttatgagctcagttatagaaaaaaaaattatctaaaagaagttttgcttggacaagctatttgatacggcattcacctgattgaaaagtaccacaacgactttcacaaccatctgggcatattcttaggatacagagttttgcccattaattcacttagctgttaacgtctttcctactagtgaagatgggcagctgacgatcttaaaaatgaaaagata

SEQ ID NO: 141461 - DNA, 601 bp, Human
ggcacaccatgctaactctagtcaatagaaaactacagtatgtatctattgattaacctctaaaccctttaaaaactttatgctaaactattttcatgttagatgtgtttttatttatcctactatgtctattactttgttttcagcagtatcgagtcctgcttcttataatttctctcttttcctggattcattttatttatttcatttccttgctgcactctgccagttcatagttcttttttcttgtttatctcttcctaagctccttcattattgatttggtgcttttgcttcacaragatttttaaaaattcatagtaaaatgccattttcttctgcttctcattctatgtttctggcatgcattcttcatctcctattttattttctgccaattttttctgattattttcctgcattatatttctaaagcttctgtactttttctttcttaactcatcattgaactcatgatttatgagctcagttatagaaaaaaaaattatctaaaagaagttttgcttggacaagctatttgatacggcattcacctgattgaaaagtaccacaacgactttcacaaccatctgggcatatt

SEQ ID NO: 141462 - DNA, 601 bp, Human
cctgaccaacatggtgaaaccccgtctctactaaaaatacaaaattagcctggcatggtggtgcatgcctgtaatcccagatactcaggaggctgaggcacaagaatcacttgaacctgggaggcagaggtggcagtgagccgagatcatgccattgcattccagccaggacaaccagagcgaaattccgttttaaaaaaaaaaaagtctgcttaagcaaaaataattttaaaaatctatggtggtataaataacatttatataatatatagtatatattttttgtatatatatatatattatataatagtataaagtgtagaaggggagaaaagtaagcgtaatgttttaactttcttttactatataggaagtagtatcatatcatatgaaggcagactgtgaaaagttaaagtatataaactaaagtaaaaatttaaaaatgaaatcatagtttgagtttcttatctattttagatgttcttctcttattagatataagatttgcaaatattttctcccaattttgccttgtctcttcgctctgttagttgtttcttttgctgtacagaagaatttttttttcacatttgatgcatct

SEQ ID NO: 141463 - DNA, 601 bp, Human
cagctggctgcaccattaaaaatattaaaggaagttttttacacagaaaaagaaaacacacagaaatatgtatctataggaaaaaataaataaaacattaaaatggttaagtacatgaatgaatataaacatgttgttattatttattatttaatattatttaaattctttttaaagagaattgcttgctggacatgatggctgacgcctgtaatcccagcattttgggaggctgaggcaggcggataacctaaggtcaggagttcaatcaagaccagcctgaccaacatggtgaaacccygtctctactaaaaatacaaaattagcctggcatggtggtgcatgcctgtaatcccagatactcaggaggctgaggcacaagaatcacttgaacctgggaggcagaggtggcagtgagccgagatcatgccattgcattccagccaggacaaccagagcgaaattccgttttaaaaaaaaaaaagtctgcttaagcaaaaataattttaaaaatctatggtggtataaataacatttatataatatatagtatatattttttgtatatatatatatataatataatagtataaagtgtaga

SEQ ID NO: 141464 - DNA, 601 bp, Human
agaccacatgttatgttattccatttatatgaaatacacaaaataggtaaatccatgggaaaagaaagtagatcagtgattgccaggggttggatggggctgagtgcagtgggtaagaattgggagtgactgctaatgactatggggtttcttcttgtggtgacaaaaatgctctgaaattagaggtctgtgcaacatgatgactatattaaaaactattaaattgtgtattttaaaagggtgagtcttatggtatgtgaattatattttgatcatttaaaaatgatatgttaattttttwaaaagttgagataagcatgcttcagcacataaatgtggtaaaatttccctccagctggctgcaccattaaaaatattaaaggaagttttttacacagaaaaagaaaacacacagaaatatgtatctataggaaaaaataaataaaacattaaaatggttaagtacatgaatgaatataaacatgttgttattatttattatttaatattatttaaattctttttaaagagaattgcttgctggacatgatggctgacgcctgtaatcccagcattttgggaggctgaggcaggcggataa

SEQ ID NO: 141465 - DNA, 601 bp, Human
ctctaaagattataaatggctattaagcacatgcaaacatgctccatatcataagtcattagtgaaatataaatcaaaaccacaatgagataccactttgcacccactgggatagcttcaattaaaacaaaaacaaaaagaaaacaacccagaaaatagcaagtgttggtaaggacgaggcgaaatgggaatctttgtgcattgctggttggattgggaaccaataaaaccagttggatcagccactttgggaaacacttcagtggttcctcaaaaaaattaaacatagaattaccacatracccagcaattctacttctagatatacactcaaattaaatgaaaatatatgtcacacagaaatttgtacgtgaatgtttatagtagcactgttcataatagccaaaagttggaaccaacataaagtccatcaacagatgaatggtaaaatcaaatatatatatataatagactgtcattcagcaataaaaatttgaagcactagttcgtactacaacacagatgaaccttgaagacattattctaagttagggaagtcagacacaaaagaccacatgttatgttattccatttatatgaa

SEQ ID NO: 141466 - DNA, 601 bp, Human
tgctattcctatcaaattaccaatgacattcttcaaagaattagaaaaactattttaaaattcatatagaaccaaagaagagtccaaatagccaaggaaatcctaagcaaaaagaacaaaactgaaggcatcacattgcttgacttcaaactatactacaaggctacagtaactgaaacagcattgaactggtagaaaaagagacacatagagcaatggaacaaaatagaaagcctagaaataaagccacatgcctacattcatctggtcattgataaagttaacaacagcaagcaatggrgaaaggtctctctattcaataaatgatgctgggataactggctagtcatacgtggaagattgaaactgggtctttccttacacaatatacaaaaatcagctcaagatagattaaagacttaaatgtaaaacccaaaactgtaaaaatcctggaagataacctaggaaataccattccagacacaggccctggcaaagatttcgtgatgaagatgccaaaagcaattacaataaaaacaaaattgacaaatgaaacctaattaaaccaaagaacttcacacaggaaaagaaactattaaca

SEQ ID NO: 141467 - DNA, 601 bp, Human
gattcaatgctattcctatcaaattaccaatgacattcttcaaagaattagaaaaactattttaaaattcatatagaaccaaagaagagtccaaatagccaaggaaatcctaagcaaaaagaacaaaactgaaggcatcacattgcttgacttcaaactatactacaaggctacagtaactgaaacagcattgaactggtagaaaaagagacacatagagcaatggaacaaaatagaaagcctagaaataaagccacatgcctacattcatctggtcattgataaagttaacaacagcaascaatggggaaaggtctctctattcaataaatgatgctgggataactggctagtcatacgtggaagattgaaactgggtctttccttacacaatatacaaaaatcagctcaagatagattaaagacttaaatgtaaaacccaaaactgtaaaaatcctggaagataacctaggaaataccattccagacacaggccctggcaaagatttcgtgatgaagatgccaaaagcaattacaataaaaacaaaattgacaaatgaaacctaattaaaccaaagaacttcacacaggaaaagaaact

SEQ ID NO: 141468 - DNA, 601 bp, Human
aattaaaaaaaatacatgtggccaacaagcatatgaaaaaaaatttttaaaaaccattaataataggaaaaggttatgaacagacacttttcaaaaaagacataattgtggccaggaggcatatgaaaaaaagcttaatatcactgatcattagagacatgcaaatgaaaactacaatgagataccatcttacaccatcagaatggctattattaaaaagcaaaaaaattacagatgctggtgaggttgtagagaaaaagaaatgcttatatactgttggttggagtgcaaattagttcakgcattgtggaaagcagtgtggctatttctcaaagatctaaagacagaaacaccatttgacccaacaatcccattactgggtatatactcaaaggaatacatattattctaataaaagacacatgaatgtgtatgtttattgtagcactatgtataataggaaagacatggcatcaacataaatgcccatcaatgatagaccaaataaagaaaatgtgatacaccatggaatactatgtagccatgaaaagaacaagatcatgtcccttgcagggacatggatggggctggaggccattat

SEQ ID NO: 141469 - DNA, 601 bp, Human
acatggacacagggaggggaacatcacataccagggcctgtcaggggattgggggccattgaagagatagcattaggagaaatacctaatgtagatgatgggttgataggtgcagcaaaccaccatggcacgcgtatacctatgtaacaaacctgcacgttctgcatatatatcccaaaacttaaagtacaattaaaaaaaatacatgtggccaacaagcatatgaaaaaaaatttttaaaaaccattaataataggaaaaggttatgaacagacacttttcaaaaaagacataattgtgrccaggaggcatatgaaaaaaagcttaatatcactgatcattagagacatgcaaatgaaaactacaatgagataccatcttacaccatcagaatggctattattaaaaagcaaaaaaattacagatgctggtgaggttgtagagaaaaagaaatgcttatatactgttggttggagtgcaaattagttcatgcattgtggaaagcagtgtggctatttctcaaagatctaaagacagaaacaccatttgacccaacaatcccattactgggtatatactcaaaggaatacatattattcta

SEQ ID NO: 141470 - DNA, 601 bp, Human
ctaatgcaggaacagaaaaccaaacattgtttgttctcactcataagtgggagttgaacaatgagaacacatggacacagggaggggaacatcacataccagggcctgtcaggggattgggggccattgaagagatagcattaggagaaatacctaatgtagatgatgggttgataggtgcagcaaaccaccatggcacgcgtatacctatgtaacaaacctgcacgttctgcatatatatcccaaaacttaaagtacaattaaaaaaaatacatgtggccaacaagcatatgaaaaaaawtttttaaaaaccattaataataggaaaaggttatgaacagacacttttcaaaaaagacataattgtggccaggaggcatatgaaaaaaagcttaatatcactgatcattagagacatgcaaatgaaaactacaatgagataccatcttacaccatcagaatggctattattaaaaagcaaaaaaattacagatgctggtgaggttgtagagaaaaagaaatgcttatatactgttggttggagtgcaaattagttcatgcattgtggaaagcagtgtggctatttctcaaagatctaaag

SEQ ID NO: 141471 - DNA, 601 bp, Human
aaaaggggtgagttcatgttctttgcagggacatggatgaagctggaaaccatcattctcagtaaactaatgcaggaacagaaaaccaaacattgtttgttctcactcataagtgggagttgaacaatgagaacacatggacacagggaggggaacatcacataccagggcctgtcaggggattgggggccattgaagagatagcattaggagaaatacctaatgtagatgatgggttgataggtgcagcaaaccaccatggcacgcgtatacctatgtaacaaacctgcacgttctgcayatatatcccaaaacttaaagtacaattaaaaaaaatacatgtggccaacaagcatatgaaaaaaaatttttaaaaaccattaataataggaaaaggttatgaacagacacttttcaaaaaagacataattgtggccaggaggcatatgaaaaaaagcttaatatcactgatcattagagacatgcaaatgaaaactacaatgagataccatcttacaccatcagaatggctattattaaaaagcaaaaaaattacagatgctggtgaggttgtagagaaaaagaaatgcttatatactgt

SEQ ID NO: 141472 - DNA, 601 bp, Human
tatccagcatctgtaagaaacttaaataaatttcaagaaaaaaaataaaaacccccaaaagtgcacaaaggatgtaaacaggcactttaaaaaaatgcaaatcaaaattacaatgagataccatctcacaccagttagaatggcaatcattaaaaagtcaggaaatgacagatgctggagaggatgtggagaaataggaatgcttttacactgttggtgggagtgtaaattagttcaaccattggggaagacagtgtgatgattcctcaaagatctagaaccagaaataccatttgacccmgcaatcccattactgggtatacacccaaaggattataaatcatactactataaagatacatgcacatgtatgtttattgcagcactattcacaatagcaaatacttggaaccaacccaaatgctcatcaatgatagactggataaagaaaatatggcacatatacaccatggaatactatgcagccataaaaaggggtgagttcatgttctttgcagggacatggatgaagctggaaaccatcattctcagtaaactaatgcaggaacagaaaaccaaacattgtttgttctcactcata

SEQ ID NO: 141473 - DNA, 601 bp, Human
acctaggtaatactatttaggacacaggaacgtacaaagattttatgatgaagatgtcaaaagcaactgcaacaaaagcaaaaatggacaaatgggacctaattaaactaaagcgcttttgcatagcaaagaaaatgattaatagcgtgaacagacagcctacagaatgggagaatactagacaaagtctagtatccagcatctgtaagaaacttaaataaatttcaagaaaaaaaataaaaacccccaaaagtgcacaaaggatgtaaacaggcactttaaaaaaatgcaaatcaaaatyacaatgagataccatctcacaccagttagaatggcaatcattaaaaagtcaggaaatgacagatgctggagaggatgtggagaaataggaatgcttttacactgttggtgggagtgtaaattagttcaaccattggggaagacagtgtgatgattcctcaaagatctagaaccagaaataccatttgaccccgcaatcccattactgggtatacacccaaaggattataaatcatactactataaagatacatgcacatgtatgtttattgcagcactattcacaatagcaaatacttgg

SEQ ID NO: 141474 - DNA, 601 bp, Human
aggcttaaatgtaataatcaaaactgtaaaaaccctggaagacaacctaggtaatactatttaggacacaggaacgtacaaagattttatgatgaagatgtcaaaagcaactgcaacaaaagcaaaaatggacaaatgggacctaattaaactaaagcgcttttgcatagcaaagaaaatgattaatagcgtgaacagacagcctacagaatgggagaatactagacaaagtctagtatccagcatctgtaagaaacttaaataaatttcaagaaaaaaaataaaaacccccaaaagtgcrcaaaggatgtaaacaggcactttaaaaaaatgcaaatcaaaattacaatgagataccatctcacaccagttagaatggcaatcattaaaaagtcaggaaatgacagatgctggagaggatgtggagaaataggaatgcttttacactgttggtgggagtgtaaattagttcaaccattggggaagacagtgtgatgattcctcaaagatctagaaccagaaataccatttgaccccgcaatcccattactgggtatacacccaaaggattataaatcatactactataaagatacatgca

SEQ ID NO: 141475 - DNA, 601 bp, Human
aaggcttaaatgtaataatcaaaactgtaaaaaccctggaagacaacctaggtaatactatttaggacacaggaacgtacaaagattttatgatgaagatgtcaaaagcaactgcaacaaaagcaaaaatggacaaatgggacctaattaaactaaagcgcttttgcatagcaaagaaaatgattaatagcgtgaacagacagcctacagaatgggagaatactagacaaagtctagtatccagcatctgtaagaaacttaaataaatttcaagaaaaaaaataaaaacccccaaaagtgyacaaaggatgtaaacaggcactttaaaaaaatgcaaatcaaaattacaatgagataccatctcacaccagttagaatggcaatcattaaaaagtcaggaaatgacagatgctggagaggatgtggagaaataggaatgcttttacactgttggtgggagtgtaaattagttcaaccattggggaagacagtgtgatgattcctcaaagatctagaaccagaaataccatttgaccccgcaatcccattactgggtatacacccaaaggattataaatcatactactataaagatacatgc

SEQ ID NO: 141476 - DNA, 601 bp, Human
catgatgaattaaaggcttaaatgtaataatcaaaactgtaaaaaccctggaagacaacctaggtaatactatttaggacacaggaacgtacaaagattttatgatgaagatgtcaaaagcaactgcaacaaaagcaaaaatggacaaatgggacctaattaaactaaagcgcttttgcatagcaaagaaaatgattaatagcgtgaacagacagcctacagaatgggagaatactagacaaagtctagtatccagcatctgtaagaaacttaaataaatttcaagaaaaaaaataaaaacccccaaaagtgcacaaaggatgtaaacaggcactttaaaaaaatgcaaatcaaaattacaatgagataccatctcacaccagttagaatggcaatcattaaaaagtcaggaaatgacagatgctggagaggatgtggagaaataggaatgcttttacactgttggtgggagtgtaaattagttcaaccattggggaagacagtgtgatgattcctcaaagatctagaaccagaaataccatttgaccccgcaatcccattactgggtatacacccaaaggattataaatcatactactat

SEQ ID NO: 141477 - DNA, 601 bp, Human
tagtagagagaactattttaaaatttacatgggaccaaaaaagagcatgaataaccaaggcaatactaaggaaaacaaacaaacaaacaaacaaagcaggaggcatcatgctacctaacttcaaactatattacagggttacggtaatcaaaacagcatagtactgctacaaaagcagacacatagaacaatggaacagaataaagaaccaaaaaaaaaggctgcacacctacaactattcaatctttgacaaatcagacaaaaacatgcaattgggaacaatgtcctatttgataaatgrcactaggataataggctagccatatgcagaagattgacattggaccccttccttacaccatatagaaaaatcaactcatgatgaattaaaggcttaaatgtaataatcaaaactgtaaaaaccctggaagacaacctaggtaatactatttaggacacaggaacgtacaaagattttatgatgaagatgtcaaaagcaactgcaacaaaagcaaaaatggacaaatgggacctaattaaactaaagcgcttttgcatagcaaagaaaatgattaatagcgtgaacagacagcctacagaa

SEQ ID NO: 141478 - DNA, 601 bp, Human
gcacaaagctcaaaggaatcacagatgacacaaacaaatggaaaaacattccatgttcatggataggaagaatcaatatcctaaaaatggtgatattgcccaaagcaagttatagattcaatgctattcctattatactaccattgagattcttcagggtagtagagagaactattttaaaatttacatgggaccaaaaaagagcatgaataaccaaggcaatactaaggaaaacaaacaaacaaacaaacaaagcaggaggcatcatgctacctaacttcaaactatattacagggttayggtaatcaaaacagcatagtactgctacaaaagcagacacatagaacaatggaacagaataaagaaccaaaaaaaaaggctgcacacctacaactattcaatctttgacaaatcagacaaaaacatgcaattgggaacaatgtcctatttgataaatgacactaggataataggctagccatatgcagaagattgacattggaccccttccttacaccatatagaaaaatcaactcatgatgaattaaaggcttaaatgtaataatcaaaactgtaaaaaccctggaagacaacctaggt

SEQ ID NO: 141479 - DNA, 601 bp, Human
aatacctcgaaattaaagagccatctctgacaaacccataacccacatattactaaatggcacaagctggaaacatgccccttgaaaaccagcacaagacaaggatgccttctctcaccactcttattcaacacagtattggaaatcctggacagagcaatcaggcaagagaaagaaataaaaggcatccaaataggaagagaggaagtcaaactatccctgtttgcagacaacataagcctttaactagaaaactccatagtctcagcacaaaagcttcttaagctgatacacaacttcmgcaaagtctcaggatacaaaatcaatgggcaaaatttgctaacattcccataaacaaacaacagtcaagctgagagcaaaatcaggaatgtaatcccattcacaattgccacaaaaagaataaaatatctaggaatatagctaaccatggaggtgaaagacctctacaaggagagctacaaagcacaaagctcaaaggaatcacagatgacacaaacaaatggaaaaacattccatgttcatggataggaagaatcaatatcctaaaaatggtgatattgcccaaagcaagttatagatt

SEQ ID NO: 141480 - DNA, 601 bp, Human
aaccacataattatctcaatagacacagaaaaggctttcaatacaattaaacactcattcatattaaatatgctcaataaactagatattgaaggaaaatacctcgaaattaaagagccatctctgacaaacccataacccacatattactaaatggcacaagctggaaacatgccccttgaaaaccagcacaagacaaggatgccttctctcaccactcttattcaacacagtattggaaatcctggacagagcaatcaggcaagagaaagaaataaaaggcatccaaataggaagagargaagtcaaactatccctgtttgcagacaacataagcctttaactagaaaactccatagtctcagcacaaaagcttcttaagctgatacacaacttcagcaaagtctcaggatacaaaatcaatgggcaaaatttgctaacattcccataaacaaacaacagtcaagctgagagcaaaatcaggaatgtaatcccattcacaattgccacaaaaagaataaaatatctaggaatatagctaaccatggaggtgaaagacctctacaaggagagctacaaagcacaaagctcaaaggaatca

SEQ ID NO: 141481 - DNA, 601 bp, Human
agtggacctgatagatatctacagaactctccagccaaaacaacaggatatacattcttctcatcgtgacatggcacatatgctgccatttctgctgaaactattccaaatatttgaggagaaaagactcctccctaactcattcaatgaggccagcatcatcctgataccaaaatctggcagaaatacagcaacaacaatttcaggccaatatccttgaagaacattgatgcaaaaatcctcaagaaaatagtcacaaacagaataaagtagcacataaaaaaagctaatccaccatgaycaagtaggctttatccctaggatgcaagattggtacatatgcaaatcaataaatatgatccatcacataaacagaactaaagacaaaaaccacataattatctcaatagacacagaaaaggctttcaatacaattaaacactcattcatattaaatatgctcaataaactagatattgaaggaaaatacctcgaaattaaagagccatctctgacaaacccataacccacatattactaaatggcacaagctggaaacatgccccttgaaaaccagcacaagacaaggatgccttctctc

SEQ ID NO: 141482 - DNA, 601 bp, Human
tgtagtcttgcattctttcacttgtagtgaatgacttgtacacaaaaactgcagaatgtcattgaaggaaattataggagatcaaataaatggaatggcattttgtattcatgtattggaaatcttaatgtaaaaatgacactaatcatcaaattgatctataaatttaatgccatccttatcaaaattccaacttactttttaaaagaaattgacaagctgattctcaaatgtatagttaatccaagggaaccagacaagccaaaacaatctgataaaacagaaaaaaatttggaggacktgcattatctgatttctaaacttactaagaaactacagtaatcaagaatgtgtagtgctggaatattagacataaaggtcaataaaattgatttgagggtcagaaaataaacccttatgcttatgatcagttgattttttttacaaaggtgtcaagaaaaatttaatggaaaaaagatctttcaataaacagtgctgagatgactatatatcaacatgaaaaagaatgaagttggacccaaacttcatacaatatggaaaattcaattcaaaaaggatcaaagatctaaatgttaagagc

SEQ ID NO: 141483 - DNA, 601 bp, Human
caattaggtaagggaaaaaaaaggtatcaaagtagaaaagaaatgaatataactatatctatttcaagatgacatgatcttcaaaaataagtaatccataaaaattctattaaagactaatgaatggattcagtaaatttataggatataacatgaacataaaattaattatatgtttataaaataaggaataattccaaaacaaaactatagaaacagttccatgtaaaacaacatcaaaaagattaaaatatttaggtatatgtttaagtgaaagacttgtagtcttgcattctttcayttgtagtgaatgacttgtacacaaaaactgcagaatgtcattgaaggaaattataggagatcaaataaatggaatggcattttgtattcatgtattggaaatcttaatgtaaaaatgacactaatcatcaaattgatctataaatttaatgccatccttatcaaaattccaacttactttttaaaagaaattgacaagctgattctcaaatgtatagttaatccaagggaaccagacaagccaaaacaatctgataaaacagaaaaaaatttggaggacttgcattatctgatttctaaa

SEQ ID NO: 141484 - DNA, 601 bp, Human
caacaaatcaatacaataaaaaaacccacatcatcacaacaatagacacagaaacaacatttctcaaagaaattcaacatcatttcactatagaaatcctcaaaatctaggaatcaaatgggatttcctcaatcttgtaaaggacatctaggaaaacacacagctaaaatcatacttactggaaaatactgagcatttcatccctgagatggggaacaagacaaagatgcccactctcaccatttcttgtcaacaatatactagaggttttgaccagggcaattaggtaagggaaaaaaaaggtatcaaagtagaaaagaaatgaatataactatatctatttcaagatgacatgatcttcaaaaataagtaatccataaaaattctattaaagactaatgaatggattcagtaaatttataggatataacatgaacataaaattaattatatgtttataaaataaggaataattccaaaacaaaactatagaaacagttccatgtaaaacaacatcaaaaagattaaaatatttaggtatatgtttaagtgaaagacttgtagtcttgcattctttcacttgtagtgaatgacttgtaca

SEQ ID NO: 141485 - DNA, 601 bp, Human
agataagcaacgacaactaacttctcattggaaaaacactagtgaaaaaagcagtggaacagcaactctaaaatattgaaaaaaaagtcaatctagaattttatacccacccaaaatatctttccaaacaaaggctaaccaaccacaaaggcataaaattataaatcaataacaagaagaaatctgggaaagtcacaaatagttagaaattaaatgatattctctaaaataatcaataaatcaaagaagaaatcataagagaaattagttaattttatgagataaatacaagtgaaaatayagcataccaaaattcatgggatgtaaaagcagtgcttacaaggaaatttatatttgtgaatgcctgtttgatatatatcttaaattaatatcataaacttctatcttaagaaattataaatgtaaaaatattaaatcaaagcaagcagaagaaataatatatattacagtggatataagtaaaatagagaacagagaaacaataggaagaatcaacaaaaccaattattttaagcaatccatataactgatgaaactttagctaaacagaccaaggggaaaaaaaagagaagatgcaaat

SEQ ID NO: 141486 - DNA, 601 bp, Human
atatctattctacttacattactgtgacaaagttttttagttgcactgaattattaatagatatttaactatttggtttaataagatatcttagaagctaataataaaatcaaaactctattttataacaacaaaaatctcaataacaaaattggcaacatatgccaaaatacaaatcaatatatgtttgtagaactatgattccagccaagagaatacactcccacttaaaataacaaaaacaacaacaaataggaaaataaatgaaacaacagatttaaagtcactggacattatcagyccaggacagtgatcctgagcaacagagggaaaaagacagacatgattatcccaaatactgccttgagagagtttgcaggttgtgatacagggagggaaaattcaggtggagcctttcaaactccctcacttggggatacagaactaagaatctggggagaggcaacacagctagacttcacaggacaaagtaccagagaggagagaagtgtgcaaaggttcagacattcttagaatgttctcgtctagtattcagcagagtactcattaccacatacatataaggaattaccagaggcca

SEQ ID NO: 141487 - DNA, 601 bp, Human
tgacaacaattgaaaattaaaatcctcatacaaatgaattaaactttatacttttgatttgtgggatgctctttggtaatatttccatatcttttcaaattttttacattcatacatatttaattaattcctatttcttatacccatcttacttgcctatgaatatataccttggttgtttttataaaaagcataaacatattactctagtttatctctccaacaaactgatctcaaaattttttgtactctatgtattttagttatagcacatgttctattgaaaatattctacatattrtctcattcctcttttttcacactattataatcgcatgctttcttaggcacaatagatttaatattcccagatcttctttcaaatacattgttaatgtcatctaaaattcctatatctattctacttacattactgtgacaaagttttttagttgcactgaattattaatagatatttaactatttggtttaataagatatcttagaagctaataataaaatcaaaactctattttataacaacaaaaatctcaataacaaaattggcaacatatgccaaaatacaaatcaatatatgttt

SEQ ID NO: 141488 - DNA, 601 bp, Human
atatatgttgctccataagacaactttctgctctaaatcttgaactgtgaagttagttaacaaatgattttaaagaataagtgacaacaattgaaaattaaaatcctcatacaaatgaattaaactttatacttttgatttgtgggatgctctttggtaatatttccatatcttttcaaattttttacattcatacatatttaattaattcctatttcttatacccatcttacttgcctatgaatatataccttggttgtttttataaaaagcataaacatattactctagtttatctctmcaacaaactgatctcaaaattttttgtactctatgtattttagttatagcacatgttctattgaaaatattctacatattatctcattcctcttttttcacactattataatcgcatgctttcttaggcacaatagatttaatattcccagatcttctttcaaatacattgttaatgtcatctaaaattcctatatctattctacttacattactgtgacaaagttttttagttgcactgaattattaatagatatttaactatttggtttaataagatatcttagaagctaataataaa

SEQ ID NO: 141489 - DNA, 601 bp, Human
ccaattaattacttgaggttaatagtatgttcattctggattttacaatgatggtttgtaaaatttaaatcatgctagaagtatttctgctttgataagttaaaaatacagaattccatattattacacctgagtctattttgataaaaccaaatgctttaaaaacatttcataaattaagatacaatgttatttgattattattattcccattacacagccaaaattatattgaagttgtgtattttaataatccttttctataatgtttttaaagatattttagaattggtagattttycatattgctaataggcatatatcattatgacataaaagataaatctctcactgtcttgatactatactaaatattatattataacctatttaaaaactgataacagctatagatcaaaacaattagacacccatcgttcaaaggtttaatcaaaattctcatgtgtggcaggatggaagagttcactcttgttaaacacaaatatatatgttgctccataagacaactttctgctctaaatcttgaactgtgaagttagttaacaaatgattttaaagaataagtgacaacaattgaaaa

SEQ ID NO: 141490 - DNA, 601 bp, Human
ttggaattcatatgaattcaagagttttcttatcagtctcttgacatgacttgcaaaggaaacatggcacaatagaaacaaatccaattaattacttgaggttaatagtatgttcattctggattttacaatgatggtttgtaaaatttaaatcatgctagaagtatttctgctttgataagttaaaaatacagaattccatattattacacctgagtctattttgataaaaccaaatgctttaaaaacatttcataaattaagatacaatgttatttgattattattattcccattacayagccaaaattatattgaagttgtgtattttaataatccttttctataatgtttttaaagatattttagaattggtagatttttcatattgctaataggcatatatcattatgacataaaagataaatctctcactgtcttgatactatactaaatattatattataacctatttaaaaactgataacagctatagatcaaaacaattagacacccatcgttcaaaggtttaatcaaaattctcatgtgtggcaggatggaagagttcactcttgttaaacacaaatatatatgttgctcc

SEQ ID NO: 141491 - DNA, 601 bp, Human
ctcaagagagtgtagacacagaatgttcaagacaggggttatatgctgatccaattcataatttgaacagaacctcattaaaagattaaggtaacaaaaggtaagtacaactctaaataaaagcaattacaaagatgtaggcaggatcctgtggctccaaactcatgaataaaaattcagaactgtgggtccactatgaatctggaatgaaaatgagaacctagagcactgatgttattatatagcctgaatgaagttagactctgaaggttcaccctggtatatcagattcaggcctttygttctaaaccttccagcccttatattcagggctatatcaatttctgagcaagggcttctagatttacaactaaaaaatgactatgattgggcattaattaacaacttttggaattcatatgaattcaagagttttcttatcagtctcttgacatgacttgcaaaggaaacatggcacaatagaaacaaatccaattaattacttgaggttaatagtatgttcattctggattttacaatgatggtttgtaaaatttaaatcatgctagaagtatttctgctttgataagttaaaaataca

SEQ ID NO: 141492 - DNA, 601 bp, Human
caactaaataaatataataggaatctttggcaaaagttttaatattttaatgacaactttcctcaaactctaagtggtaaactaatagaatcacaccagcagtgtgtagggttggaaattaggtcaatgtaggatgctcttccaatccttggaaggttgagagtgtacccttactgacttcagtgaatatcaaaattagaataagcaaaataaagagtttagagtccttaacacagctaatagaaatagaaaactttctttccctaagttgttacttttctaattttatatccttatcccrtagttgttgttgttgttttacttttttgcagtgactcttttggatatcttattttgatggaaatcattaccaaaaggcttccttcataacaaagtccccgggttttgtgtttttttttttttaaataactgacttataagctattaaaaaaatatactaccagagtaattccacctatctcaaactgcaggcataagatgacaggaaaaataacatgtctcaagagagtgtagacacagaatgttcaagacaggggttatatgctgatccaattcataatttgaacagaacctcattaaa

SEQ ID NO: 141493 - DNA, 601 bp, Human
gtttgggaaatacattttgatggaactgtgatgtaccacccagctcccccttccataaacacttgattgcttcaactattaggagtgcagacaagagacatccttcagttgccagtccttcaggtattgtcttgtagaactacaggaactccatccaaagctacaccagttggggtagggcacatccgatgactagttgatgcaggaatataaagtccagtcattgtgctccaaataagggaaatacaaagggctctgctagcacctaagcatggtatgagatcagccaaggttactctaytctgggatcatgatcaccaagaattcaatctcttgctcttaccagtcctgttacctttctctcccttccacagatgtagattccaaaggcattccttaataaatacccagcatgctaacttccatctcaccgtatgtacaatagagaaaccgcctgaaagccccctgaaaccgccatctaagtggcatgaaattcctacatcatagtggtaagactcacaaaaggatatcattcagtttttctttcaaaaggggattgacttctgtgttacaatttatataatttgtttctgttaccagc

SEQ ID NO: 141494 - DNA, 601 bp, Human
aaaagaggggtatcccacgttaatgattaagtaattctggagacctccttagaattgtagctaaaagtttgggaaatacattttgatggaactgtgatgtaccacccagctcccccttccataaacacttgattgcttcaactattaggagtgcagacaagagacatccttcagttgccagtccttcaggtattgtcttgtagaactacaggaactccatccaaagctacaccagttggggtagggcacatccgatgactagttgatgcaggaatataaagtccagtcattgtgctccaartaagggaaatacaaagggctctgctagcacctaagcatggtatgagatcagccaaggttactctattctgggatcatgatcaccaagaattcaatctcttgctcttaccagtcctgttacctttctctcccttccacagatgtagattccaaaggcattccttaataaatacccagcatgctaacttccatctcaccgtatgtacaatagagaaaccgcctgaaagccccctgaaaccgccatctaagtggcatgaaattcctacatcatagtggtaagactcacaaaaggatatcattc

SEQ ID NO: 141495 - DNA, 601 bp, Human
atattaatagtattgttgcttaatttagttgaaaatcaagagccccagcatattacatctgggtcaaaatcataatcatgaattttagtatctttttaacagaaataaatcagcagtatgaaacattacaaactcgttgagggcaaggcattcaattcctgttcctctgtcacctccacctcgctatagaaaaggctgtgctctggacccactctaaagcataaagggaataaattaacctatggaagtccactgcactgacatgtttctccaaagagaaactaacacagacttaaaaatstttccatccttccagaatttgtgtcaattctgatgaaataaatgacaaattgttttacagtagacaaaagcaccgagccaaaggtgattaatgaaaatcctctgtagtcatattttgagatcttccattaaagatataaatttaggtttgcaaattgttaattttaagtgtgattttacttattttcaaaagcaggttctgacacccttgtggtcataggagatgtcagacattcctagttatggacctctttcagtctgacaggtactaaaaggccttgttcctctcacatttatttcc

SEQ ID NO: 141496 - DNA, 601 bp, Human
aacccttgcttgcaatcaatgctcataactagatctttatatccataaagagctgctgattcttattcaaacattccactggagcatttggattagaaatagatcataattaaacagtatcctaaaatatggatatttacaagtgtcagaattcacttttagcctctgtccctgtcagcaaagtaataataataaacaatgatattaatagtattgttgcttaatttagttgaaaatcaagagccccagcatattacatctgggtcaaaatcataatcatgaattttagtatctttttaamagaaataaatcagcagtatgaaacattacaaactcgttgagggcaaggcattcaattcctgttcctctgtcacctccacctcgctatagaaaaggctgtgctctggacccactctaaagcataaagggaataaattaacctatggaagtccactgcactgacatgtttctccaaagagaaactaacacagacttaaaaatctttccatccttccagaatttgtgtcaattctgatgaaataaatgacaaattgttttacagtagacaaaagcaccgagccaaaggtgattaatgaaaatc

SEQ ID NO: 141497 - DNA, 601 bp, Human
tgatatgatataatagttcttaccaggcctcaaaacccttgcttgcaatcaatgctcataactagatctttatatccataaagagctgctgattcttattcaaacattccactggagcatttggattagaaatagatcataattaaacagtatcctaaaatatggatatttacaagtgtcagaattcacttttagcctctgtccctgtcagcaaagtaataataataaacaatgatattaatagtattgttgcttaatttagttgaaaatcaagagccccagcatattacatctgggtcawaatcataatcatgaattttagtatctttttaacagaaataaatcagcagtatgaaacattacaaactcgttgagggcaaggcattcaattcctgttcctctgtcacctccacctcgctatagaaaaggctgtgctctggacccactctaaagcataaagggaataaattaacctatggaagtccactgcactgacatgtttctccaaagagaaactaacacagacttaaaaatctttccatccttccagaatttgtgtcaattctgatgaaataaatgacaaattgttttacagtagaca

SEQ ID NO: 141498 - DNA, 601 bp, Human
acatagaaaaatgatttctggggcatcttaaaaaattgaacttactatatggccaacttctttccctgccctctctctatatttgataaggacttcaaattgagccagatgcacacatttctttttctctctcttctctctcatatatgtttatgatatgatataatagttcttaccaggcctcaaaacccttgcttgcaatcaatgctcataactagatctttatatccataaagagctgctgattcttattcaaacattccactggagcatttggattagaaatagatcataattaaasagtatcctaaaatatggatatttacaagtgtcagaattcacttttagcctctgtccctgtcagcaaagtaataataataaacaatgatattaatagtattgttgcttaatttagttgaaaatcaagagccccagcatattacatctgggtcaaaatcataatcatgaattttagtatctttttaacagaaataaatcagcagtatgaaacattacaaactcgttgagggcaaggcattcaattcctgttcctctgtcacctccacctcgctatagaaaaggctgtgctctggacccactc

SEQ ID NO: 141499 - DNA, 601 bp, Human
gccatgatattctcaaatggttgatattttatttttatatggcatagattattataaatatgtcataaatcggtgataaaatttcagatgtggaaggtaacacattgacctctttctttaacctccttggaattctctttgtgtgaaagaactcagattcccaacatatctcctgctgaaaatgttttatactatttttttatataaggtaatgaatattagagaggaatactttctgttttacaggcagtatctattattttgggatggtgtataatttaatgatatgaatttttgcaaygcaaatacgccacagacaacttatttctatcaatgacaaattacatgactgcttatacagtaaagaaagtatgtctttactgctgtttccacattgtatatataccctgtctcctttctgtgatgccttcactggggaagtcttgaattagtaacctactcttttaaatataagttcataattttcttttccatgatataagtccatgttttcttttccacttacagtaagaatgctaacacatagaatgacttcagaaggcccaatgtctttgtgcctgattggacagggactcttctc

SEQ ID NO: 141500 - DNA, 601 bp, Human
atggaaagaggatatcagctcttataaaaagaagaaaaacagaaattatgactgatttataaagaggtgttacttttatagagaaatagtttcaactacaaaggtttttattgtattttatagattggaaagtattattttcatgtctcactttgtgaatctataataacaacaaagtgtttttaagtacttagaagtaaataagattaatttggtaattttaagaagctaatcacagacaaggtcaataacaaatgcatacataattctaacatgtacataatgcgttactgttttaaastgttttcaaatgtgtgactgtttcttataacaccaggaggaagtataggatatccattttggaggtgaggaaagattggggagtaatatgtccaagtaatcccacacttaaagacacataaaagataattaaaatatttccataaggatgtgtcttaacaactaataattgtattcacaaactgtgaatgagaagttaattatatctaatacttaattaacaaaattgccatgatattctcaaatggttgatattttatttttatatggcatagattattataaatatgtcataaatcgg

SEQ ID NO: 141501 - DNA, 601 bp, Human
atgttagacagtaggcacaatattggagatgggaattggttcaaaacttccagagaaggatcagcgtaatgaaagctgacattccctgggtaggtggtatgtcctaggcacactgccatgttcttcgtctatgttatctcattttattctcacagctccaggaggacataacattattgtaagtactttatagatgaggaaactgaagcactgacagagtaagatattttcctgaagtcagacaactagtaagtgatatgaaccaaggcaatctggcgccagactccacatgcttccttcytgccctgttttgatttttaatctgaaatgagaagaactatggaaagaggatatcagctcttataaaaagaagaaaaacagaaattatgactgatttataaagaggtgttacttttatagagaaatagtttcaactacaaaggtttttattgtattttatagattggaaagtattattttcatgtctcactttgtgaatctataataacaacaaagtgtttttaagtacttagaagtaaataagattaatttggtaattttaagaagctaatcacagacaaggtcaataacaaatgcatac

SEQ ID NO: 141502 - DNA, 601 bp, Human
gtgaggcattaaaaagtccctcaatatatacaccctgttaatgttagatttaagattttctacctaattgaattgtggctctggaggatgacagcctagaagccacaaaatcaaaactgtctggaaggttaaatacagataataagtcttttgatggtccggatctttaagtaacgctttatatgttagacagtaggcacaatattggagatgggaattggttcaaaacttccagagaaggatcagcgtaatgaaagctgacattccctgggtaggtggtatgtcctaggcacactgccaygttcttcgtctatgttatctcattttattctcacagctccaggaggacataacattattgtaagtactttatagatgaggaaactgaagcactgacagagtaagatattttcctgaagtcagacaactagtaagtgatatgaaccaaggcaatctggcgccagactccacatgcttccttcctgccctgttttgatttttaatctgaaatgagaagaactatggaaagaggatatcagctcttataaaaagaagaaaaacagaaattatgactgatttataaagaggtgttacttttata

SEQ ID NO: 141503 - DNA, 601 bp, Human
catacatgtaaactcacccacatatagagacacattattttttttcccatctatttgtgcacacacacatccttacacacacaaaatcattctgatatttaaaactccagtctatcactacagggtgaagagtaaacatataaacaattcatgttttcatttctccattcaataaatatgtattgaatagttagtagatatcagacactgtagtatactgagaatgctgtagttagggactaagtcagatatggccactgcttttattaaacttatattaatagctcatgatgggacataraaacagaagaaatttaaatagataactatgaagatccattaatgtgttggaggtagggggctggttaacagggatctgaatgctgaaatgagtgagccatgaaaagatgtgaaggaacagcaatgcaggcaaaggaaagaggcagagccaaggctccaaggctggaaggaacttggcttgatccattctaggttcagaataaagatcagtgttgctggagcactgggagaaatacctgagtatgtatattgtgaggcattaaaaagtccctcaatatatacaccctgttaatgttagatt

SEQ ID NO: 141504 - DNA, 601 bp, Human
aaaataattaataaatgttttgggaagatataaatagtcctttttctccttacagttttgcccactgatttcggtatacatcaggggatcttgcctgcagcatttcttactgttgtattctaagggtgattttctatttccctcattccttctacaattattactttgatttcttaaggaaaaattgtccccttctatgtccatttatttatttatccatatcatttatttatgtcattatggacttatatatatttattttatttttgagttataacctgatactattattgtttctttwattgcccaaactgtctcatctttgtccattgggagctttttcaggttggcacgagtgttcttttgacatgctttcatcctttttattttttattttattgagaacttattcactttctgtcactacaagaggcttcaggctcatcttgcattttccctgctccagccctggaagcaatcttttttcaagggagccaaatttccttttaatgaagcatggtgtttaggaatcaatatctggatactaagtgtgcttgctactactggaatgtcactgactaggcagacagtggctgagcta

SEQ ID NO: 141505 - DNA, 601 bp, Human
ggcagtcgcttgcatatatgaaataaacctttgttatgggtttgggagagttaagaaataaaaaaaggttataaatcttttattctaatatcacataactgaatatgatgaccaagccaaatacttaaaacagaataattagtaattcattctgtcatttattaatctatgaacactttattgaatgtctactgtctttgggcactaagtgggtattacgaattgtagagatactgcttttccttctgaaatgttcctattttcaggttgcaaggaaggcatagaagacatcgagcataayatcatcaatactaaagtaaggatatttagaaagatttatagacactcaaaaaggctcacagataggtaacatttgagctggattttgaaggatgaaaaatatgtagctagggaacaaaaatcgaaggtcatttttggaagagagaatcaacaaaagaatagaaccttgaaaactgcatgcacacttaatggagatggtttgactagagggaagttctagacttacatataaatcaatgaagataattctatagttatgtaaaaaaatactatcaaacacactaattaattttaaaaagct

SEQ ID NO: 141506 - DNA, 601 bp, Human
ctgttctaagtttcacctgtatgaactcaatgaatcttcaggaaaaccttcttgggtaagtactattattagtgtcccatgcaatgaatacagaggttaatttatttgacgaaggtcatgtgggctttgtaaatatgttcgctacctgatgctcagttttccttattaccctgtattacacatttagacttttattctgttactgaatggccattcagtttcccagtggctaggtttttattatgttctgcaattctctagtgatgggatcacccatgcagtgggtcttctgattctgaamctgttttctcatcaccagctctcagggagttcttttgagtcctcaccaatactcctggagctcccctaaatattagtacctcagatctgaagcttgtttgaaaattgaatcctggctgcagtgttgatctgtaatactcaaggtaatggacttagccctatttgtcactgtcccattggctctcctcctcattaaggaatatttccaggctcataattgtctgctcacttgtgtctaaaaaagacttaagggctgggtcagtggctcatgcctgtaatcccagtactttgagaggccaag

SEQ ID NO: 141507 - DNA, 601 bp, Human
gctcttcctcatagactgggtgtcccatcagtatataccatgaggtttccaaagaaactatctccagaattctgtaactgttcagataaacacaattaagagacatagtttcaaatgtatttattttatgataactaaaaaaagaagtttttgaacatcatacagttagaattttctaaggtagccttcagactaaacatgttttatacgatgcaattaatttggctattttttacttctaaaaataactactgttatataaaatatgatctttctttagataatatgtattttttaaaakaattaaacacatatgttcaattaagctggatttagaatttcttactaggaatacagttttacaaattcacacatgtatttttctttgttgtaaaataaattcatcaaaaatggtttgttctggcatattctgtgttggatcaggatgattttgcaggctgaggatgtaaagtcacataaaatacaatcccaacaggtaaattttgtgtatatgtaaattatacctcaaataaagctgttaagacaaccaccaccaccaaaccctgaccaaagagaggacattatgaggtggaggaggagc

SEQ ID NO: 141508 - DNA, 601 bp, Human
ttttacttttccattagttatattaaatgatctccatgcttcaatcaagctataactttttacttaattaaaaaagtactattgttctgctttgatacatgatttttctgctcttcctcatagactgggtgtcccatcagtatataccatgaggtttccaaagaaactatctccagaattctgtaactgttcagataaacacaattaagagacatagtttcaaatgtatttattttatgataactaaaaaaagaagtttttgaacatcatacagttagaattttctaaggtagccttcagwctaaacatgttttatacgatgcaattaatttggctattttttacttctaaaaataactactgttatataaaatatgatctttctttagataatatgtattttttaaaataattaaacacatatgttcaattaagctggatttagaatttcttactaggaatacagttttacaaattcacacatgtatttttctttgttgtaaaataaattcatcaaaaatggtttgttctggcatattctgtgttggatcaggatgattttgcaggctgaggatgtaaagtcacataaaatacaatccca

SEQ ID NO: 141509 - DNA, 601 bp, Human
actttgtcactcttttacttttccattagttatattaaatgatctccatgcttcaatcaagctataactttttacttaattaaaaaagtactattgttctgctttgatacatgatttttctgctcttcctcatagactgggtgtcccatcagtatataccatgaggtttccaaagaaactatctccagaattctgtaactgttcagataaacacaattaagagacatagtttcaaatgtatttattttatgataactaaaaaaagaagtttttgaacatcatacagttagaattttctaakgtagccttcagactaaacatgttttatacgatgcaattaatttggctattttttacttctaaaaataactactgttatataaaatatgatctttctttagataatatgtattttttaaaataattaaacacatatgttcaattaagctggatttagaatttcttactaggaatacagttttacaaattcacacatgtatttttctttgttgtaaaataaattcatcaaaaatggtttgttctggcatattctgtgttggatcaggatgattttgcaggctgaggatgtaaagtcacataa

SEQ ID NO: 141510 - DNA, 601 bp, Human
tgtgcataaaagtaaacacaattctgctattaattgttgggaaaaaatagagagactcaaaagctaataatggtcaagtaattcaatgaagttctgaatatttatttaacaaaaatgttcaggtattaaaataatgcatattgcattttactgtcacaggaaaataatcatactatgataagtggtagtcatggttaaaattttaaatgtaagaatgcatctgtaacaatgaaaaaacttacactaaaaaggaggtaactacagttataattaagaaaggttacatatgggtaattggtggtttttttgttgtttaataatgagaacataatatatcttgataaaaaataaacattcatcacaaaataaaagtttattttgttaaaaggaacaatcatctgtccttaataactagcaaagtctctccgatttaaaagatatttgacttgtttttgatgacttcgaaagctaacatcaagactagtaggtagaaattacaaagaaaagcttgcttctcaacaaaaggtgaacttttaatagtataatacttatccaaagattaaatactttatctcagaggctagatgactccctgttaccg

SEQ ID NO: 141511 - DNA, 601 bp, Human
tgccaataaaccagtgagtttcatcaagggtttacaaggaaagtggacacattaacatattaacccctaagattaagatgccataatgacagactctgatgctagcacaatattcatgggaatttaaatgtcacattttttagtttattaatgtttttactagtgctctgatttaacatattttgagtaatcttgctctaatccttatttcccctagcccctattatttggcataatttgtagaattagaaggtttttaggaatatatttagatgtatatacgatgtaaaaacaagaacgygtgcataaatgttattactacatcagaaacacttgtacttctttcactgtgttaaagactcactacttgtcttgtttacaatgaaggcataacttgtcataagaaaaacaatattaagaagaaatgtgggtgagggtggcaatacattttacaaataagcattaacaagattagacaaagaaaggaaaatcacctgtttcacaaatgacttatttaacagcaaaatatgttcagtgtttcccaccacaatcagatcctgtggcccgtaactgacctctggcttctaaatttgtgtgtgtg

SEQ ID NO: 141512 - DNA, 601 bp, Human
tgaagatgaaacaggcctgtcatggtggctcacacctgtaatcccagcactttgggaggcctaggtgggcagatcacaaggtcaggagttcaagaccagcctggccaaaatagtgaaaccctgtctctactaaaaatatgaaaaaaaattagccgggcatagtggcatgcacctgtagtcccagctacttgggaggctgaggcaggagaatcgcttgaacctgggaggtggaggttgcagtgagccgatatcgtgccactacactccagcctgggcaacacagcaagactctgtctcaatwaaaaaaaaaaaaaaaaaaaggataaacgaaaaagttttctcttatttaaatagtcaagagatttttttgtctgttttgctcactgaaatatacatggtgctcaggaaagggtaatagagtaaaatgtttaatgaacatatctgtatgtcaagatttgtgtttcaaacattggcaataccatggtgaatgagtaccaatgtcctgcactcacagagtttatgatccagtggaaggaaccaatgaaaattagcaaacataataattataaatttctataaatcctatgagggaaacaagttt

SEQ ID NO: 141513 - DNA, 601 bp, Human
ctcagtggtttccacagactccttttcttcagtctaaagctgaaatattgatatgaccagggtcctgcttgtggctctttcctttatctatcactctccctattcttatcatcacttgctgtttaaaatgttccctgaaaaacatacatatgttttaaaatatcctataaaatctacgttgccagaccacacatctcccttaagatctggacttctgctatccaagatggtagccattagtcacatgtgcctatttaaatgtaaattaactatagttaaataatattaacaatcatttctrtgtcttactgggaagatttcaacggctcagtagcattccctcactaaaatgttgatgttcatcatcttttacacgagctacagcaatatctttccaaacgatgttactgattttagtcatgcatacttcctgtttatcctccccagtgccacatacctaatctttctaagacgcaaatctcatcaaatcactttcttactgatagtctctaaaaggctgataaccattcacaggtaaaacacaaacttattatggaatactgattactccatgatctggcttccaagactgtcccaggca

SEQ ID NO: 141514 - DNA, 601 bp, Human
actctttccctctgatttcaaaagaaaagatgttctttcctcattctagctactaatcttgctgtctgagctttcatccattcccatttctctaatatttcataccaaccttcactctctttcatacctaaagcctttctgcaaaccttcttcccttcatgtcacaaatctacttaattctcattgttatttttaaattgtaattatctttggtaattctttctgtcctagctcagattttctgtattttataaactttaagctcatcttccatttactcatttattctctctaacatggkgtttatcctcatcatggataaattttatttttcttaatcatgtcctcctagttgccaaatacatttggctcttttcaagtcttacgagttttcagtaggttctggtgacaagcctgctgaaatgaaactggtcctgccttgggctccctgccagtcttccctaatgctccacctcctacctcaacatgacccttctctcagtggtttccacagactccttttcttcagtctaaagctgaaatattgatatgaccagggtcctgcttgtggctctttcctttatctatcactctccctatt

SEQ ID NO: 141515 - DNA, 601 bp, Human
gaggattaaaaagaaacaagaaggtagagagagctacaacttgacattgatccaaagagaaattaaaatcgtcactaagtatgaaaactacagttttctaagcaacataaagatatacaaccaaaaattttagatatttatatgtatctgaaggcatattgcctaaaggataagtttagttatatagtggaaagaacagtgaatttgagttccaaggaacacaaaggaaaggaatatttaatatagagagatctccattctttagtatgtattactaaagaggaaatgaatttccctgaasaacattttattttcttccctagttgactgtgaaaagatacatgtttacggatgtaatctcatgacacagtaagaaacaactcctatttgttattaagatactatcacacatatgtaagttgcatttgtactttgtctggaatctaatatgaaataacttttccccaaatagtgcattcacacgcaatccgattagaattttttcttgatattgttctaatatattatctcaataatctttcacataacatatactccacataaaagcataatggtctgatttttgctatcactctgaatt

SEQ ID NO: 141516 - DNA, 601 bp, Human
ctaactggaggacaaaaacaataaagtttaacattttaaaactgtgctacataaatgcaatagcaagtagcaggcactgataaggctgatgaaatctctgagctgacacacttatcatctatggaattgctactggatagaaaggctattaaagaacaggagacccagtattgcaaatatgttgacctataatgtcaaaataaaacattgctcctggtcctccacttttagaataaactttggaggggaaatgatttcttcccccatgagactgcagaattttaagaatgctttcatttcwatgtctcctgtataacaccagaagtggaatgactgattggtcaaattatatttagaagatttggaagagatgaggagtgatggggaaataattcaacttctgagatgttattttttatgaaaaataaaaattatttcccctaaatgtgttgaggattaaaaagaaacaagaaggtagagagagctacaacttgacattgatccaaagagaaattaaaatcgtcactaagtatgaaaactacagttttctaagcaacataaagatatacaaccaaaaattttagatatttatatgtatctg

SEQ ID NO: 141517 - DNA, 601 bp, Human
ataacttccacaaatgtaaaccacagaagttcattttaaaaagagttacactacacaaaaaaagagacatattttagtcagcactgtaattaagagatggaggaggtaagggatatttgcattaggtaatctatttctctatccacaaagtgatgaaatcaacacttaccaaggaatggctgagaagttaagaatgaaagcattggtgctgagaaagatcttttgttaacttttatgacctctttcaatctcttggatttgaaataagtatataagaatttatgttaggaagtctagacakattttaaatatgtttaaaatgtaaatagatttaataaataaaatttaaatatttacaatggaatctaaaaacactcacagggagaaagacacacacacacacacacacacacacacacacacacacacacacgtagagaagaaagagagagagagagaacaactttgatggctaaaaccttaacataagggagtaaggaagatcatataatttttcagcacatgggcttgtccttgattacttgagatgcggggatactaactggaggacaaaaacaataaagtttaacattttaaaact

SEQ ID NO: 141518 - DNA, 601 bp, Human
tttttattttagagttgaatttaagttttcctaccaatactatttttagtttgagaccggtgtttgaatgtagctcacccaaaatacaggctaaaatgaaaatacacacgcacttacacacatgcatgcacacatcagttctgcaggtgaattatgattcaatcaaggttaagaatcatgatagagaatgaaaaaactaatttattttattttttcatttagttaattttattaataatactatcaaataaagaattaggtagagaacagcattttatttctcattgtcaaagtacagaaygtcagtgacaatagggattagtggacaaaacagaagctactggagaactttgaggaagagggaagataaaaataaattaagcttactaatatctatttcatttaatccagataacttccacaaatgtaaaccacagaagttcattttaaaaagagttacactacacaaaaaaagagacatattttagtcagcactgtaattaagagatggaggaggtaagggatatttgcattaggtaatctatttctctatccacaaagtgatgaaatcaacacttaccaaggaatggctgagaagtta

SEQ ID NO: 141519 - DNA, 601 bp, Human
ctataacagtgtgtgggatcaatgccatgaccttcacagtgtaattttatcaggactgacatccaaaagtttcataataataatgactggtatttatattcaatttcagcattatgcataccctttattatctcagttctttcttatccatgattcttggaaaaatacatgaatttttattttagagttgaatttaagttttcctaccaatactatttttagtttgagaccggtgtttgaatgtagctcacccaaaatacaggctaaaatgaaaatacacacgcacttacacacatgcatrcacacatcagttctgcaggtgaattatgattcaatcaaggttaagaatcatgatagagaatgaaaaaactaatttattttattttttcatttagttaattttattaataatactatcaaataaagaattaggtagagaacagcattttatttctcattgtcaaagtacagaatgtcagtgacaatagggattagtggacaaaacagaagctactggagaactttgaggaagagggaagataaaaataaattaagcttactaatatctatttcatttaatccagataacttccacaaatgt

SEQ ID NO: 141520 - DNA, 601 bp, Human
tctataacagtgtgtgggatcaatgccatgaccttcacagtgtaattttatcaggactgacatccaaaagtttcataataataatgactggtatttatattcaatttcagcattatgcataccctttattatctcagttctttcttatccatgattcttggaaaaatacatgaatttttattttagagttgaatttaagttttcctaccaatactatttttagtttgagaccggtgtttgaatgtagctcacccaaaatacaggctaaaatgaaaatacacacgcacttacacacatgcaygcacacatcagttctgcaggtgaattatgattcaatcaaggttaagaatcatgatagagaatgaaaaaactaatttattttattttttcatttagttaattttattaataatactatcaaataaagaattaggtagagaacagcattttatttctcattgtcaaagtacagaatgtcagtgacaatagggattagtggacaaaacagaagctactggagaactttgaggaagagggaagataaaaataaattaagcttactaatatctatttcatttaatccagataacttccacaaatg

SEQ ID NO: 141521 - DNA, 601 bp, Human
attaaacatgaattacattaacaaatatgattatatttaataatatttttattttgggaaattttacattgtttgcatattacctcaatttattattttaattatcaaggaattaatttttaccctttgacatccagataattcatcatgatttctaaagtatctaggtgtttaagagctaatatgaaaaactattatttcacaactggtatctctctggcatattaaacatagtattttgtaaagctaccttcacagactaagcaaaaagtgagtgttcaatatgtattaattttagacrtgcaaattacttacttgcttgagggctgattataactttagtattgtggggatgctttaactcactctagaataacaggaatagcatttatattatagaatatcaaggagaatttaatattcccccaatatcactaaaacttgagttaaagcaagatgattatgattctatctatgtcattgtagttatctgatcctgattgcccccattttttgcatcagtgatgccaattcaatgttggccttggaaaggtggttgacactcccttccttggcaccttttttctcattcccaggtcag

SEQ ID NO: 141522 - DNA, 601 bp, Human
taatgtcaataaaatatactgagcccaatgaacataattatatttttttctctctgtgagttcattgagggggaaagacatgtactgagaatattaatcatcaagatgagtctaagcaattcaatttccagaagaagatttggaaaggattaaatggagagagaatttattataaaaatgttattttcttcattctactgcctttaaaaaataacaataaaccacaaggtaggaatgtattcattataatttttttatttagaagttaaagtaaggatatagttgaatatgagaaaattarttcaagtaaatgaaagctcatcttacaataaattcacaaaggtactggaagctatattgatctggtatcgtcctagtgatagagattcatagaaaaaaagtattacatcttgagtatgatttctttgttgctgttagttcctcttgcatacttattatctaacctattttacttttctatgttattgaaattgaactcacatatttatttggatatgtttgctctgcaaaattaaaatgaatagggtgttctaggtacttaaacatgcatattctttttaaatgatcttttcaaccctaa

SEQ ID NO: 141523 - DNA, 601 bp, Human
taaagcttaagagtagttcgatgagctccaagttctcattttcaattgcaatgaggagagcagttcttccgagaggatcaatgcaattaatattgattttaaaataaatttcagcttcctctagggatttcttgacactggcataatctcccttttccacagcattcaagtaggctttttctgatggcgagagttctgattctgctcttactatccttagagggatgcggtctctatagggagcattaacatttcttttgtaatagaactgagccatgtttcatgccatgctatttcttcrtctctgaaagtagaaacaaaaaacacaaagattagtgttaatatgcttttaaaattgttaagcatcatacttctccaactcacagtgatatcaataacaacaataccattattagtaactattaagagttaagggttttttttttcttcaacaatataaatactaaatagttgttcaattatgtggaaacaaagttttcttttaaaataaataaaaagagattaacatttggtaaactatttaaaaagttactctgaaagtgaattttatcagagaatgcatttatagttttggaaatta

SEQ ID NO: 141524 - DNA, 601 bp, Human
tgcaggtacctgtttttctccactaggttttttgtggttcaataacagctcaacagctccgacgacttcttttctgatagcatgtaatagagcatctccaacatagacattaaagcttaagagtagttcgatgagctccaagttctcattttcaattgcaatgaggagagcagttcttccgagaggatcaatgcaattaatattgattttaaaataaatttcagcttcctctagggatttcttgacactggcataatctcccttttccacagcattcaagtaggctttttctgatggcgaragttctgattctgctcttactatccttagagggatgcggtctctatagggagcattaacatttcttttgtaatagaactgagccatgtttcatgccatgctatttcttcgtctctgaaagtagaaacaaaaaacacaaagattagtgttaatatgcttttaaaattgttaagcatcatacttctccaactcacagtgatatcaataacaacaataccattattagtaactattaagagttaagggttttttttttcttcaacaatataaatactaaatagttgttcaattatgtggaaac

SEQ ID NO: 141525 - DNA, 601 bp, Human
aaaacacaggcttttcccagcagacagggacactcagctataaagttcttttcctaataatggcaaagattctgataaaagtcctctaggaaagcaaagagagcttgcttgtaaaaaaaaatgtcacacctcctaacagtctagcgtttgcagagaccgagatgtgtatattatcaaataggctagaatttgctagagctaaaataacatccattttataagattttactttaaaagacagatttttgaaccactgcagaatctgcagtgtctttgcagctagtcaattagccttgatgcraggaagtgacgagtacagtgtgaaaggaaaaaggatcaaatagataattcagacacaaggcagttacaaagggaagagtccagacagacaaaaacagactccttattcattcctgtctatgatgtctccacttccttagtggaaaaagacagagagaaagagaaaaacacacattgtatttataattgtgtgccattttagtttattttctgttgataactataaggtatagctacatttgcaccatcagtaaagttgatgtagttaagcccacagtcagagttcagctatctcatagta

SEQ ID NO: 141526 - DNA, 601 bp, Human
ttagaaaatgcaaatacttgagaggtacagctgtggaaagaatttcagtaccacaaggagacttaagtagtagcacctaaacttacacagattaaaaacagactcttactcattcctgtctgtgttctgtatctccttagtggtgaaagactggtatataacatgaaatgtgtctttggatattactattagttgtctaccccaatcaaggcttgttcacgtttgaaagaatacaagaaacaagcaaatttttgtagcagtaaacttttaccaatataatgagagtaatccacaaacaacygtttatgaaagaaacaacaaaatgccagcaaagcaacaagcagaaaagtattgttgctgtggagtgctgttttatcaaagtcttagttcaagtaaggggaagggttgaatggggatgaaacataaaaaagggaccataaaaacacaggcttttcccagcagacagggacactcagctataaagttcttttcctaataatggcaaagattctgataaaagtcctctaggaaagcaaagagagcttgcttgtaaaaaaaaatgtcacacctcctaacagtctagcgtttgcagagaccgaga

SEQ ID NO: 141527 - DNA, 601 bp, Human
ctggaaattgttgcccagtgaaagcctttaagtgtagacaaattcatctgaaatctcacagctcccatgacctgaggatgactatgaaatctttctttttccagagaaataagttaatatgtgacaaatttctgaaagagtatattttgaatatgcatttctcacatttaaaaactactaagtgttctaaaaatcagatttggattttttttctttttattagaacctctttctttactcattttaggatgttacatttattttgttcattggatattgttgttttcaggttttatcattyggcctcaatgacctcaataaaatgaatgatgacgtgtcccagaatctttgggcataccatgagtatgaaaattaggtgaattaaaataaaacacaaatggctttcaatgatcacaagaatgaggaattacaccttatgagagaaaaaagtcctatcaaggacatatttgctacttacaacacagtgatttatgaaaactgtcattccaaaagatgttgaccttccttaggaaatgaattaccaaagaaaatcacaaataaacagccaggctctaatgggatttgatacggcccaagcact

SEQ ID NO: 141528 - DNA, 601 bp, Human
gggcccaggacgaggcctggcagagcaggcatctggaaattgttgcccagtgaaagcctttaagtgtagacaaattcatctgaaatctcacagctcccatgacctgaggatgactatgaaatctttctttttccagagaaataagttaatatgtgacaaatttctgaaagagtatattttgaatatgcatttctcacatttaaaaactactaagtgttctaaaaatcagatttggattttttttctttttattagaacctctttctttactcattttaggatgttacatttattttgttcgttggatattgttgttttcaggttttatcattcggcctcaatgacctcaataaaatgaatgatgacgtgtcccagaatctttgggcataccatgagtatgaaaattaggtgaattaaaataaaacacaaatggctttcaatgatcacaagaatgaggaattacaccttatgagagaaaaaagtcctatcaaggacatatttgctacttacaacacagtgatttatgaaaactgtcattccaaaagatgttgaccttccttaggaaatgaattaccaaagaaaatcacaaataaacagccag

SEQ ID NO: 141529 - DNA, 601 bp, Human
actctcgagaaaaggaacggtgtctcctcctcagggcccaggacgaggcctggcagagcaggcatctggaaattgttgcccagtgaaagcctttaagtgtagacaaattcatctgaaatctcacagctcccatgacctgaggatgactatgaaatctttctttttccagagaaataagttaatatgtgacaaatttctgaaagagtatattttgaatatgcatttctcacatttaaaaactactaagtgttctaaaaatcagatttggattttttttctttttattagaacctctttcttwactcattttaggatgttacatttattttgttcattggatattgttgttttcaggttttatcattcggcctcaatgacctcaataaaatgaatgatgacgtgtcccagaatctttgggcataccatgagtatgaaaattaggtgaattaaaataaaacacaaatggctttcaatgatcacaagaatgaggaattacaccttatgagagaaaaaagtcctatcaaggacatatttgctacttacaacacagtgatttatgaaaactgtcattccaaaagatgttgaccttccttaggaaatg

SEQ ID NO: 141530 - DNA, 601 bp, Human
ggtgttaattttttcaaggtataaacctatcaacattcttcccctttttccttcaagcccttctccagccctctacccactaacattttgtgtttgccaaatccagatgatttaacttcatcattttctgaggattcatttttatctcttcagttctgacagcctttattcatattcccatgatacttttcttttctgtattcacaatcggaccttaggactctcgagaaaaggaacggtgtctcctcctcagggcccaggacgaggcctggcagagcaggcatctggaaattgttgcccwgtgaaagcctttaagtgtagacaaattcatctgaaatctcacagctcccatgacctgaggatgactatgaaatctttctttttccagagaaataagttaatatgtgacaaatttctgaaagagtatattttgaatatgcatttctcacatttaaaaactactaagtgttctaaaaatcagatttggattttttttctttttattagaacctctttctttactcattttaggatgttacatttattttgttcattggatattgttgttttcaggttttatcattcggcctcaatgacctca

SEQ ID NO: 141531 - DNA, 601 bp, Human
taatggtgttaattttttcaaggtataaacctatcaacattcttcccctttttccttcaagcccttctccagccctctacccactaacattttgtgtttgccaaatccagatgatttaacttcatcattttctgaggattcatttttatctcttcagttctgacagcctttattcatattcccatgatacttttcttttctgtattcacaatcggaccttaggactctcgagaaaaggaacggtgtctcctcctcagggcccaggacgaggcctggcagagcaggcatctggaaattgttscccagtgaaagcctttaagtgtagacaaattcatctgaaatctcacagctcccatgacctgaggatgactatgaaatctttctttttccagagaaataagttaatatgtgacaaatttctgaaagagtatattttgaatatgcatttctcacatttaaaaactactaagtgttctaaaaatcagatttggattttttttctttttattagaacctctttctttactcattttaggatgttacatttattttgttcattggatattgttgttttcaggttttatcattcggcctcaatgac

SEQ ID NO: 141532 - DNA, 601 bp, Human
tcaatgtcctccttatcatctacataacaatcccagaccccattcttaaatccaacatttgtaactaactcttaggtattaatactaacaaatcaaaaaactacgcatgtccaatttggtctcataagtcttttcttataggctttatctcagttaatggtgttaattttttcaaggtataaacctatcaacattcttcccctttttccttcaagcccttctccagccctctacccactaacattttgtgtttgccaaatccagatgatttaacttcatcattttctgaggattcattttyatctcttcagttctgacagcctttattcatattcccatgatacttttcttttctgtattcacaatcggaccttaggactctcgagaaaaggaacggtgtctcctcctcagggcccaggacgaggcctggcagagcaggcatctggaaattgttgcccagtgaaagcctttaagtgtagacaaattcatctgaaatctcacagctcccatgacctgaggatgactatgaaatctttctttttccagagaaataagttaatatgtgacaaatttctgaaagagtatattttgaatatgcatt

SEQ ID NO: 141533 - DNA, 601 bp, Human
cccaactaaattcaataccctgatttatgaaggactaccttaaatatgaaagaaaatatttaatgatctatacccatctatttatctggaaagacctgcatcttttcattacatgctgcattgagaaaatcatttaatatactaaaaatcacaaatctgtaaaacatgtataaggtcaaaaagaaaaccaatgtcagaactgcaggaagataaggtgattttatttgcttcaatgtcctccttatcatctacataacaatcccagaccccattcttaaatccaacatttgtaactaactcytaggtattaatactaacaaatcaaaaaactacgcatgtccaatttggtctcataagtcttttcttataggctttatctcagttaatggtgttaattttttcaaggtataaacctatcaacattcttcccctttttccttcaagcccttctccagccctctacccactaacattttgtgtttgccaaatccagatgatttaacttcatcattttctgaggattcatttttatctcttcagttctgacagcctttattcatattcccatgatacttttcttttctgtattcacaatcggacc

SEQ ID NO: 141534 - DNA, 601 bp, Human
aaaaaaaaaaacccaactaaattcaataccctgatttatgaaggactaccttaaatatgaaagaaaatatttaatgatctatacccatctatttatctggaaagacctgcatcttttcattacatgctgcattgagaaaatcatttaatatactaaaaatcacaaatctgtaaaacatgtataaggtcaaaaagaaaaccaatgtcagaactgcaggaagataaggtgattttatttgcttcaatgtcctccttatcatctacataacaatcccagaccccattcttaaatccaacatttstaactaactcttaggtattaatactaacaaatcaaaaaactacgcatgtccaatttggtctcataagtcttttcttataggctttatctcagttaatggtgttaattttttcaaggtataaacctatcaacattcttcccctttttccttcaagcccttctccagccctctacccactaacattttgtgtttgccaaatccagatgatttaacttcatcattttctgaggattcatttttatctcttcagttctgacagcctttattcatattcccatgatacttttcttttctgtattc

SEQ ID NO: 141535 - DNA, 601 bp, Human
gttcagtaaattcatcagagactatcagtgcaatgattcctgcttagtgtagagaatcagaggctctctgtgctgtctcctatgggaaagaaataagctattactcttctcattaaaaaaaaaaacccaactaaattcaataccctgatttatgaaggactaccttaaatatgaaagaaaatatttaatgatctatacccatctatttatctggaaagacctgcatcttttcattacatgctgcattgagaaaatcatttaatatactaaaaatcacaaatctgtaaaacatgtataaggkcaaaaagaaaaccaatgtcagaactgcaggaagataaggtgattttatttgcttcaatgtcctccttatcatctacataacaatcccagaccccattcttaaatccaacatttgtaactaactcttaggtattaatactaacaaatcaaaaaactacgcatgtccaatttggtctcataagtcttttcttataggctttatctcagttaatggtgttaattttttcaaggtataaacctatcaacattcttcccctttttccttcaagcccttctccagccctctacccactaacatttt

SEQ ID NO: 141536 - DNA, 601 bp, Human
ggcctcacttcagacctgctgtgtcagaacctctgcaggtaggtcctagtagtctgtgttgtaacaagcctttccagtgacgatgctaaagattgacaaccactgatctaacaaaaaaattgaaaagcaaggtctgcttctgataaacatttactgaagcagctgaaactgaaattaaatctggacttagaagacatctaagctctgctaaaaataatgaaaagtcaagttaccaatcaatggactgaaatgagggttaagaagtcattctcagttattccctctagagaaataaggtatyaagaaggttaaagccaagttcagtaaattcatcagagactatcagtgcaatgattcctgcttagtgtagagaatcagaggctctctgtgctgtctcctatgggaaagaaataagctattactcttctcattaaaaaaaaaaacccaactaaattcaataccctgatttatgaaggactaccttaaatatgaaagaaaatatttaatgatctatacccatctatttatctggaaagacctgcatcttttcattacatgctgcattgagaaaatcatttaatatactaaaaatcacaaatct

SEQ ID NO: 141537 - DNA, 601 bp, Human
tatattaaataccacttaacagctagtacttaagggaatgagtcaaaatttcctgaaaaccaggttagcatagtatagtatgagacatctaacataaaatatacagctgtaggttctctacaacctgcaacatcctctgaatcagtggttctcaaagcactgttgctagactggcagcattagcattacctggggtactcactagaaatacaaatcccaaggcctcacttcagacctgctgtgtcagaacctctgcaggtaggtcctagtagtctgtgttgtaacaagcctttccagtgaygatgctaaagattgacaaccactgatctaacaaaaaaattgaaaagcaaggtctgcttctgataaacatttactgaagcagctgaaactgaaattaaatctggacttagaagacatctaagctctgctaaaaataatgaaaagtcaagttaccaatcaatggactgaaatgagggttaagaagtcattctcagttattccctctagagaaataaggtatcaagaaggttaaagccaagttcagtaaattcatcagagactatcagtgcaatgattcctgcttagtgtagagaatcagagg

SEQ ID NO: 141538 - DNA, 601 bp, Human
gggaatacataataaggatgttactgaaattgggaaactctcatatattaaataccacttaacagctagtacttaagggaatgagtcaaaatttcctgaaaaccaggttagcatagtatagtatgagacatctaacataaaatatacagctgtaggttctctacaacctgcaacatcctctgaatcagtggttctcaaagcactgttgctagactggcagcattagcattacctggggtactcactagaaatacaaatcccaaggcctcacttcagacctgctgtgtcagaacctctgcargtaggtcctagtagtctgtgttgtaacaagcctttccagtgacgatgctaaagattgacaaccactgatctaacaaaaaaattgaaaagcaaggtctgcttctgataaacatttactgaagcagctgaaactgaaattaaatctggacttagaagacatctaagctctgctaaaaataatgaaaagtcaagttaccaatcaatggactgaaatgagggttaagaagtcattctcagttattccctctagagaaataaggtatcaagaaggttaaagccaagttcagtaaattcatcagag

SEQ ID NO: 141539 - DNA, 601 bp, Human
atttttagtagaactttaaaaccaaaatttcttcagctaatcactctggaatcttcactgtttataatgtatagcaaagtctttttttccaaagtgggaatacataataaggatgttactgaaattgggaaactctcatatattaaataccacttaacagctagtacttaagggaatgagtcaaaatttcctgaaaaccaggttagcatagtatagtatgagacatctaacataaaatatacagctgtaggttctctacaacctgcaacatcctctgaatcagtggttctcaaagcactgytgctagactggcagcattagcattacctggggtactcactagaaatacaaatcccaaggcctcacttcagacctgctgtgtcagaacctctgcaggtaggtcctagtagtctgtgttgtaacaagcctttccagtgacgatgctaaagattgacaaccactgatctaacaaaaaaattgaaaagcaaggtctgcttctgataaacatttactgaagcagctgaaactgaaattaaatctggacttagaagacatctaagctctgctaaaaataatgaaaagtcaagttaccaatcaatgg

SEQ ID NO: 141540 - DNA, 601 bp, Human
gagacagtctgaatgtgtacatccagagacttcttaaaatttgtctaattcatatcctgaattcaaataagtaattaatgatttaaatgacacccattcaaatcgatgcagtggctaaagccagaccagcatatgtcttcagagactcttgagttccagcactggtatttccttgctttgtgatctgggacatattattacgtcacttaagccttttaatactttcatttccccatttgtaagtggagatagcaataggacctactttcataggataatataaagattaagtgagataaarcaagtaaaattctaatcacagttactggcatggtgacaaactcagtgaatatcatctagtattaatattgttgttattttttgtcatacaatttttattattatccagactatatcaaggttggttgctagctattaatttataggtcttttcagtctggccaacccactgcacaattgagtcccctttcctgtccctcctttgtaaaatgaggtgattgattaggttgatctccaagaatcctcccaattataaaataccctgcattatttttagtagaactttaaaaccaaaatttct

SEQ ID NO: 141541 - DNA, 601 bp, Human
taatgccaacactattattacatgataccttataaaaacacttttacagaatttgaacatcactagactttgagaagtaggtaagattcagaccacaggcctgattaacagccaagaaaaaaccaaggctcagagagattcagacacttgtccaattagtaagtggtgaactggactggaagccagcattgctgtcacttcacttcactctgtgctctttcccagcacttcacagcttctaatgactttgttatttcttagtgcaacaccatggtaaggagtgtctggggtcacaattaayatttattgggcaacaaaattataaatggcattataatattcatgatagagacagtctgaatgtgtacatccagagacttcttaaaatttgtctaattcatatcctgaattcaaataagtaattaatgatttaaatgacacccattcaaatcgatgcagtggctaaagccagaccagcatatgtcttcagagactcttgagttccagcactggtatttccttgctttgtgatctgggacatattattacgtcacttaagccttttaatactttcatttccccatttgtaagtggagatagc

SEQ ID NO: 141542 - DNA, 601 bp, Human
gaaagagagtgaagggggagctactacacactttcaaacaaccagatcttgtgagaagtctatcacaggacagcactagggagatggtactaaaccattagaaatcaccccatgattcaatcacctttcaccagctcccacctctaatattggggattaaattcaacatgagatttgggtggggacacagagccacaccatatcaacaatggtggcatttttcaaatgaaaaaagaggtcttgaactctagagggtaaattgctgatgcttaatcttttcacatatttgtgttatttgtayatttgtttgtcaataggaagacagagataatggcataacacagtaataatgccaacactattattacatgataccttataaaaacacttttacagaatttgaacatcactagactttgagaagtaggtaagattcagaccacaggcctgattaacagccaagaaaaaaccaaggctcagagagattcagacacttgtccaattagtaagtggtgaactggactggaagccagcattgctgtcacttcacttcactctgtgctctttcccagcacttcacagcttctaatgactttgttat

SEQ ID NO: 141543 - DNA, 601 bp, Human
actaagaatcttctatatttttattcagcagtgtatattttgggttatatatttgcattaacatgctagtaccaatatcttacttcagactgtttgattttctgatcacataacaggcaatgtttctaaagacacaattgtattaacaaatctactgaaactacatatgtcaaaaaaaatctcctatatgcactgaggtggaaagaaaataagtaaactgaaatatactttcttttgctctccctgaattgggtttctgtttccaattgtattagtccattctcacattgatataaagaaytacctgagactgggtaatttataaggaagagaggtttaattgactcacagttccacaggctatacaggaggcatggctgggagggctcagaaaacttacaatcatggcagaagagtgaaggggaagcaagcatgtcttcacacggcagcgggagagagaaagagagtgaagggggagctactacacactttcaaacaaccagatcttgtgagaagtctatcacaggacagcactagggagatggtactaaaccattagaaatcaccccatgattcaatcacctttcaccagctcccacct

SEQ ID NO: 141544 - DNA, 601 bp, Human
gtgaatatagcaggcagaaagaaagggtatgttgaaaacagttactgagccttctaatcataatatgtattttcataattcccaattatattaacatgttatgtattcaagtaattacagtgtttatatgacttactattattcctaaatgattaatatttcagtattatggttaatgaaattcaattaatatactgctcactgaaacataatgctattaactttagatttaatcatgttaataatggattagagggctctaataaaatgaccccacaaaatcttttcgacaaaacccacrtatgaaagattcatttgtctctttcttattttaatgtaaactcattctttatactagcactaaaacttcacagggtatttgctttgaggaatatttagcctcttcaatgcacacatgcattattaatttaatcaaatataataatataaagtgctttagggtaagaatataatcactttcaaatggtatcagagttttctatttaccatgctctttcaatgctaggcatagaacctggtgactggcagccgtaatccccttctttttcttttgtttagatttttttgctatttattttat

SEQ ID NO: 141545 - DNA, 601 bp, Human
gagaatgcttgataaattgtaatactgaattttttggtagcaatttttattattgtgacctaaggtgactagggtaaaatattgaaatatatttacaattcactttggtctgtttgctttttgaaattatgtattatgttttgaagaaaattattcaatatattgctaattgagaattctctgatattttggagagtgggaaatacataacatataaagtccaaataaatgtgtaattatttctaatttttactttactcatccaaatattaatgtgtcaaaaattcacatttatatatartggtactagtgttgcttagtgattaaacttatatctccaagtcaaatgaatgtatataatttccctcagggactccagaaatcaaaaagggatgttgcaattaaggagatgagtattaggcaaagttaagcccactccacttacgtattatcaccttttttaagggaagagagattatacatccagttgacaaatttacaactataaatttctcttacccactccttctgggtgggttttagcattccttcagaaagctgtattctgtaagtcagttctcacatactcaaagcttacagt

SEQ ID NO: 141546 - DNA, 601 bp, Human
tgaaaatacataccaaacagtcaaagaaaacattttctgtattccccactcatgcacatgcatttattcctcacttactgaacccctgttacttagtagtgactgcttaaacaagtgttcaacaaagattcgaaggctgctactagggtcaacaagaatgaactctgcaactccttagcagtacccacatggtgctggagggagaaaaatggcagttgaagtacttagttacttatagtggcattggggaagtccacctctctttttaaaatgacaataatgaaagaacttaccacaaggsttgttatgaggtttaaataagataacaatctagaatgatcttaagagaatgcttgataaattgtaatactgaattttttggtagcaatttttattattgtgacctaaggtgactagggtaaaatattgaaatatatttacaattcactttggtctgtttgctttttgaaattatgtattatgttttgaagaaaattattcaatatattgctaattgagaattctctgatattttggagagtgggaaatacataacatataaagtccaaataaatgtgtaattatttctaatttttacttt

SEQ ID NO: 141547 - DNA, 601 bp, Human
tgactgtctactcacaggactaagtgaccttaatatgatgaaagtgcttaggcagtggcagagtgatttataaatgtaaggaggagaaagtaattttactctaatgatattaaaaataaagatacagaaaatggttgtgattgtttttatttttctattaatgagaaagtaaatttcagaatattagataaaattttagattatgaatactgaaagaactagtctattgagtgggtgtaagatttctacattttatgactctttagttgaacactgcataattaatgattttctgagaaayatatctatatttatgtttaaactgccagtgtatttaataatttccttctcattcattgccttttgtttttgtggtatgtccaagcagtatagtccttgagacagcactgactttatcctgctaaaaaagctgtatattctattgcttaaagatttttaaaatgtcaaaagaaaaaaggagaaaataaaattcactctaaaacacactccccagagatatagattcagcatatatatatatatatatctatatatacacagatatctgtattttgtagagaaaattgggagcaagtcttta

SEQ ID NO: 141548 - DNA, 601 bp, Human
catggataatatatcctggtgaaaaaatgtgctggtccaaaatgctaggatgggaactagaatgattcatgaatgaggaatagcaaagtcagagatacatgtgtagggtaggaagtctgaatgcctggctattatgattggctaacagtagacatgtggctgggtcttttatttcaaaaggaattgagataaaactgaggaattagatgatcttggttcatccacgaactagccacatggccttgaccacatcattcgctagcttcacttttagagaaaacgtcactgactgtctactcayaggactaagtgaccttaatatgatgaaagtgcttaggcagtggcagagtgatttataaatgtaaggaggagaaagtaattttactctaatgatattaaaaataaagatacagaaaatggttgtgattgtttttatttttctattaatgagaaagtaaatttcagaatattagataaaattttagattatgaatactgaaagaactagtctattgagtgggtgtaagatttctacattttatgactctttagttgaacactgcataattaatgattttctgagaaacatatctatatttat

SEQ ID NO: 141549 - DNA, 601 bp, Human
gattgtttagttgacagacttcacttttctttttcaaaactatataatactgacttctacaatggttgaactagtttacagtcccaccaacagtgtaaaagtgttcctatttctccacatcctctccagcacctgttgtttcctgactttttgttcaaccattgtggaagtcagtgtggcgattcctcagggatctagaactagaaataccatttgacccagccatcccgttactggttatatacccaaaggactataaatcatgctgctataaagacacatgcacacgtatgtttattgyggcactattcacaatagcgaagacttggaaccaacccaaatgtccaacaatgatagactggattaagaaaatgtggcacatatacaccatggaatactatgcagccataaaaaatgatgagttcatgtcctttgtatggacatggatgaaattggaaatcatcattctcagtaaactatagcaagaacaaaaaaccaaacaccgcatattctcactcacatgtgggaattgaacaatgagaacacatggacacaggaaggggaacatcacactctggggactgttgtggggtggggggag

SEQ ID NO: 141550 - DNA, 601 bp, Human
ccaattatagtgcttgattcatctgaaaggtagaacaataatttcctggcgggccgattttgtaagtgtagatgtcaaggtttagaatgcatgctttttgttgctgaaaatttaagctgtgtatctcctgaaatggcatctgcttctttattgtgtactgctatatatacatcaggaataacaattaaatattatttgtattttaggtaaatactggagaaatatattacaactcttaaggagacatcaaacaaatagcaactttaaatcaccagcaggttggactaggatgaatcactaraggaacttgagggttattatcactaactcttagattgtttagttgacagacttcacttttctttttcaaaactatataatactgacttctacaatggttgaactagtttacagtcccaccaacagtgtaaaagtgttcctatttctccacatcctctccagcacctgttgtttcctgactttttgttcaaccattgtggaagtcagtgtggcgattcctcagggatctagaactagaaataccatttgacccagccatcccgttactggttatatacccaaaggactataaatcatgctg

SEQ ID NO: 141551 - DNA, 601 bp, Human
gagagatgctcctgaagtttcattttgtcatgctagagagttgtagaataattatttatataaagattccttattttaggctctttaaacattagttgagattctactttctatcagacattgtccttagtattatctctatctgaactactttatttgatgtgcaaaatcctctataattaggtcaatctctatattaaaatctactgtgcactacacttcagtatgcttcccatggtctgagcatttcaccattaaactttccatacagctttttaaattggtgtttgccttttccctytcacctatccagttctgccactcagaacccatcttaagtattataatttttataacgtccttttgtaaaattgaactgtcattgggctgcttttttgcctttaatggaggaagggggaagggaagttattataactttcctacaagtcaagaggaacccattttcagaaaaggagtttctaagaatagtaaggaggatgagtgcatactccacaattgcagattcccttatttcccatcaaaggctcttattacaagatacatctaactttacccaagctttagtacaagtccatggccc

SEQ ID NO: 141552 - DNA, 601 bp, Human
gtatcaggttgaagaaataaatcacaacacacacacacacacacaaatatttacttcatgcagaaaaattctggagatctggggaaagatccagaagatctaaaatgtaaataaaagttactgaaagataaagaacacctggagaaaagtcaaaagtgaggcataaacaaccagagaaatttcttattctaagcaaatgatgagtctgtgcactgatagtattcaccaggtatttggttaaagtaatgaaaacaattatgtacgattaaatatattctggggaaatcccaaattggtgggyagggttcaaggttggaaattttctaaaaaatagcactttattttactgagtctcttaggtacaacatagatcttccttaatttacttgacatgtgggcctgtatatttcagttaggggtaattggcgtattcacgtaagttactgacttttggcttccatattattttaaaatcattgtatatataacaacttttatttgttgcagttctctgctttagttttgtattttaaatgagtaataaacaaaaggcttgtttgctaacaaagtaagaaatcctattctacataaacaaagatca

SEQ ID NO: 141553 - DNA, 601 bp, Human
tgttttttaggagaagtaattggaaaattcggaggactttctggaaaggaatgtatgatatttgaaatttttaaaaaattacatttatatttattaagaaaccagaatgttctattatcatagatgtcctagagtatcaggttgaagaaataaatcacaacacacacacacacacacaaatatttacttcatgcagaaaaattctggagatctggggaaagatccagaagatctaaaatgtaaataaaagttactgaaagataaagaacacctggagaaaagtcaaaagtgaggcataaayaaccagagaaatttcttattctaagcaaatgatgagtctgtgcactgatagtattcaccaggtatttggttaaagtaatgaaaacaattatgtacgattaaatatattctggggaaatcccaaattggtgggcagggttcaaggttggaaattttctaaaaaatagcactttattttactgagtctcttaggtacaacatagatcttccttaatttacttgacatgtgggcctgtatatttcagttaggggtaattggcgtattcacgtaagttactgacttttggcttccatattattt

SEQ ID NO: 141554 - DNA, 601 bp, Human
ctcgaaagtattattttaggctcaaacttctgctttaaaagactaaacagaattcaaatttgcacttatacagacaaaaaattatttgttagtctaagcctagggctaataatttaccagaatgtttatgaagactggtggataagagaaaagacttgtgctttttacttcttcagagtggttgcaactttaaatacactaatagcttttttttttctttttttttttttctgaggtagagtcttgccctgtcacccaggttggagtgtaatggcatgatcttggctcactgcaatctccrcctcccaggttcaatcgattctcctgcctcagcctcccgagtagctgggattacaggcaggcaccaccacacctggcttaattttttggattcttagcagatatggggtttcaccatgttggccaggctggtcttgaactcctgaactcaggagacctacccgcctcagcctcccaaagtgctgggattacaggcgtgagccaccgtgactggcctaaatacactaatagtttgatttgatgtctgatgaaacattgatccagaaaataattataataaacaccttaaaagaaattcggc

SEQ ID NO: 141555 - DNA, 601 bp, Human
ataattgggactacaggcatagcaccaccatacctggataatttttttatttttttatttttttatttttagtagagacagggtctcactgtattgcccaggctggtctcaaactcctaggctcaagtgatcccacctcccctcagcctcccaagtagccggactacaagcatagcaccaccacgcctagatcatatttttgtagggacagcatctcactatattggccaggctggtcttaaactcctaggctcaaatgatcctcctacctcagcctcccaatgtgctgggattacaggcrtgagccactgcacccacctggctctatgtttaattagctatataatcttgtgaaagtctcttaaagatagtaaggggcatttgttatatgcaaaggaatatcccttgtaacacgaaacttctgtgactcaaatgcctttttaaagttctggttgatagtaaaataatagaaactttatgaaaaaggtgtttgttttttcaagggcttcaataaaaatgtgctaagttctttagcttccccttgtgtttagcatcattgttttactctaacatagtcaaaagcaacacttaaaaaaacccc

SEQ ID NO: 141556 - DNA, 601 bp, Human
ggtttatatgtccttggccggttttttttttttttgtaggagagatatggtcttttcccctacaaaaagaccagacaaaattggaaaaaaaaactttccaatatgatgcattattctttttttaatctgaattatgacattttacagcatcttaaaataggtggttatggaaactctttacttgatgaatgtctttatttcttttaaataagcccaacttattttccagctgacactcttttctttgctttctcagagatgttgaggtccaaaataatcaagaaatacactcaaaaacagytaatgatttgttttaaacccaagctctttctctgcagtagaagtcctttaattcctcaattaggttttgtcttttgtttgtttttactgtgttttagcttctgctttcctatcattcagcctagtgactaaatgtggcagcaaaaataagtgggctggcctcatgcttcctcttttcatctgtgcttttctggtatattttccagatgacaagaggtgctccataactagcattactgttttattagaaataagcaagcattgagtcgagtcagcagtgtgaattccactgaatcaggtc

SEQ ID NO: 141557 - DNA, 601 bp, Human
tgaactggacacgcattccacacagttacagcggacctcgtggggtcgaggcactgagactcctttctgaaccaagagttttattatctcataattatttgtatgggctgccaaaatgattggtgtaatgtctggagtgaattcagagaactgcttatcaaggagtataggaggcacctaaaaaaaaaaaggcagaggtgatgaatatttattcttttgttcaagtctgtgaatttcatacaccatgctatagcaatatggaacagggtttatatgtccttggccggttttttttttttttgtaggagagatatggtcttttcccctacaaaaagaccagacaaaattggaaaaaaaaactttccaatatgatgcattattctttttttaatctgaattatgacattttacagcatcttaaaataggtggttatggaaactctttacttgatgaatgtctttatttcttttaaataagcccaacttattttccagctgacactcttttctttgctttctcagagatgttgaggtccaaaataatcaagaaatacactcaaaaacagttaatgatttgttttaaacccaagctctttctctg

SEQ ID NO: 141558 - DNA, 601 bp, Human
aggtaaatcaagaacatgagtggtgtttttaatttgtttgttgattgatttttaacatgaagttcatattgtagtaagattggatttaaatgattatttattgcctttttcaaataacatttgaattaaaaacctgttggagtgatacacttatcaaaaaagagtttataaaataaaggccatgatatacagacaagtagggttctaggcagttttaagaagacacaatccacagtgtctgctctatttgttatttaactgctttagcactcttgctatgcactctaactctcacccgagrtgtcccttggttgtactaaggctacaccctatgtgtttcctctgtccctacattctccccacctcccctgtctccttgctcacagcagtcttgtttcttgcttccatatcaaggggtttgaaataaatcaagaaacagaaccaacaatcttgagattaagagagctttaaagagctgtaattgtggaacattttgaatcaatttagtttaccatgccatggatagtgtctgattgacatgaatctcttcacattttctccattcccccaagactggataaacagaaggttaggaggtcat

SEQ ID NO: 141559 - DNA, 601 bp, Human
ttcagaataaaaaatatgtagagagagatgttactgtccctcaactactaacagaagcacaaaatggcatcttgctatagatctcagatatgcagatatcaggtaaatcaagaacatgagtggtgtttttaatttgtttgttgattgatttttaacatgaagttcatattgtagtaagattggatttaaatgattatttattgcctttttcaaataacatttgaattaaaaacctgttggagtgatacacttatcaaaaaagagtttataaaataaaggccatgatatacagacaagtagrgttctaggcagttttaagaagacacaatccacagtgtctgctctatttgttatttaactgctttagcactcttgctatgcactctaactctcacccgaggtgtcccttggttgtactaaggctacaccctatgtgtttcctctgtccctacattctccccacctcccctgtctccttgctcacagcagtcttgtttcttgcttccatatcaaggggtttgaaataaatcaagaaacagaaccaacaatcttgagattaagagagctttaaagagctgtaattgtggaacattttgaatca

SEQ ID NO: 141560 - DNA, 601 bp, Human
tctaatagggtgaggaataagtaaaaacattccctctcacatgcataatttatgagaactcaagcagaagtttatatctcaaaatcaacaaaagtttcttgcgaactataacgtttcagtttcataaacttccaaaagacaatctattggctttctgtatttttccaggaaatatattgaatggaataagctgttaaggccgcaactctaaaagctggcaattctggtgttttgtgatgaatgacagagaaaatatcagtcactaaataatggcctaagagaaaataaccttgaagtataratgtgaacatttgtacaacagaaacaagagaaagccttctccatcattgacaaactacatgattgtatctgaataatggaaacctgatgatcttattgctagcactttcttgtcaatcatcagagtcagaagtacccgttttatgctgaaaaacaattcatttgagggccaagggaaggtatccaatacacaatgtagtttatcaaagatattatcattagcctaatgtttttgattcttgtttttgccaaatgaaagctgcatcataaagagctgcttatgtacattttctcaggtgaa

SEQ ID NO: 141561 - DNA, 601 bp, Human
gcattatcaatcctagagagttttactgtgtgtcttttgtttctaaaaattcaaacataaaataattaacctctatttagaaaaattatgactatgtctaatagggtgaggaataagtaaaaacattccctctcacatgcataatttatgagaactcaagcagaagtttatatctcaaaatcaacaaaagtttcttgcgaactataacgtttcagtttcataaacttccaaaagacaatctattggctttctgtatttttccaggaaatatattgaatggaataagctgttaaggccgcarctctaaaagctggcaattctggtgttttgtgatgaatgacagagaaaatatcagtcactaaataatggcctaagagaaaataaccttgaagtatagatgtgaacatttgtacaacagaaacaagagaaagccttctccatcattgacaaactacatgattgtatctgaataatggaaacctgatgatcttattgctagcactttcttgtcaatcatcagagtcagaagtacccgttttatgctgaaaaacaattcatttgagggccaagggaaggtatccaatacacaatgtagtttatc

SEQ ID NO: 141562 - DNA, 601 bp, Human
gtttgctccttctgtgcatgcagagggcatgccactccgtgttccctaacactccaaaggagaaagggaatagggtgtgaaacaaaaaccacagagctatgtgatcgctttccctgttctatgccacctagaagccatttgtaaacacacagcttcagaattcagcttcagcatcatgaactgccaaattatagcacaggcattatcaatcctagagagttttactgtgtgtcttttgtttctaaaaattcaaacataaaataattaacctctatttagaaaaattatgactatgtctaayagggtgaggaataagtaaaaacattccctctcacatgcataatttatgagaactcaagcagaagtttatatctcaaaatcaacaaaagtttcttgcgaactataacgtttcagtttcataaacttccaaaagacaatctattggctttctgtatttttccaggaaatatattgaatggaataagctgttaaggccgcaactctaaaagctggcaattctggtgttttgtgatgaatgacagagaaaatatcagtcactaaataatggcctaagagaaaataaccttgaagtatagatgtg

SEQ ID NO: 141563 - DNA, 601 bp, Human
aaatagttaaaatcaaacaaaatgattttattttgtatatgtttgcctaaatattatcgaagtagtacgtccctttccccacctccaaaggagctagctactatttcttttttctttccccatatagcatttaccttcattgtatgcatagaaggcagtcaacaaaaattatatgtgaagctttgttattttttcctcaccaatggtcaagttattcctcaacataaaatctcttagaagaactgccatcaaggtattatacaaatgggttgtttgacttgaagaaaaaacaatgtagcaytaattccacaaacatgtattgagctcatacctaatgtaccagtgccattgtagttgctaaagatagcaaaataaataaagatttcagttcttggattcaaggagctcagagtctcatgaaggggagagacctaaaacaattaattataacataatgtggtaaatgtacatgctctatatatagaagagagagaaccagtctaacctgataaatgaggggaaatttattaagacccagttttaacatcatgaagaaagagtaggatctagtcagaggtaattgttttatttcaaaccaatg

SEQ ID NO: 141564 - DNA, 601 bp, Human
tgatatcaaccactgaaaagcatggagatggagctaaaaagaaactgtatttttgtgtgttattgaagttaagatggtatgaatttaaattagaaagttataacattagaacattaaatgtaatccccatggtaaccacaaagaaaatagctatggaatatacacaaaagaaaatgagaaggtaattacaaaaaacagctatacatgaaagaagatagtaatgcaggaagtaaacaaaaacaaatggcaaaatgacagaagtaagtatcctttattagcaataactttaaatgtaaatgartgaaactctccaactcaacggacaggaattgacggaatgaataagacatggctcaactatatgctttctacaagagactcaccttaaattcaaacacgtaaatagtttgaaagtgaaagaataaaaaaggcaatgacatgaaaatagtaacaaaagggagaaagagtggcaatactaatatcagacaaaatagattttaaataaaaaaggtgaaaaaagaacattatatattaataaaaggtttattacaagaagatataattattataaacattgacacacctgatgatagttcatgaa

SEQ ID NO: 141565 - DNA, 601 bp, Human
agcaaatatttcctgaaatcagaaagacactatataagcggttttttttgtttgctttaatcttccacatccataataaggatattaggtaaaacaatctaagtagttggtaacattattgtgagtaaaaagtgttggtctatttgttccaaaaggtcctttcacatctttttggcaaggcccaagattccaactgtggcttcactttttcaaacaagttaatttgagaatctctagaatataggaagcagtcaataatttcttgttaaataatttgttatttaatgagtacttgaaaggytgaattggtgaatgcctgaatgaatgaattatagatggagaaaacgttaactgtaaatcaatagaagttgtttctgagaaatacttgataacaaagactttaaacaaagactttaaaacatctgtcttgaaggtgcttaaagaactaaaggagaaatcacaaaaactatgtatgaacagaaaggaagtatcaataaagaattttttaaaaaaagaaacaaaaaataaattctagagctgaagtgaaaaaacagtcgattcgaaagcagatttgggcggactgaagaaaaaattagtgaac

SEQ ID NO: 141566 - DNA, 601 bp, Human
agttaactgaagcctcatttatgataggaaaaattgggaaaacttaaatgtccgcaaattagggattaattttataaataatgattcattcattatttatgaattccatatatcacttcaaaataataaagtaaatatgtaattattgatattttaaaaatctctaagacatatttttcaaaggaaaaaataaataacacagccatacacataacataatcccatttatatatacaatttaaaactgtgggtgtgtcagtgaatgtgtaggcccataagtgtgtaggtatgttttgtgtgyacgtggatgcagatatctggttttggagatgtacacaggaaaacatctgggactatttcccctaatacattcaacaataattcccaactttgagcaatgaattagaaatggtaaaaagggtctataacttttattatttcatgcctttaaatcattttaattgtgtatattgagcttgtagttaggtattctgtaattctaaattatttacattatcatattatgatgaattgttattataattatgaagttctagggaagaaggattagcaaatatttcctgaaatcagaaagacacta

SEQ ID NO: 141567 - DNA, 601 bp, Human
gcatgaaaaaaaaaagatgaacatgactaagatagaatcccaatactcgagaatctcacactgagggagtaaaaatccaaatcagtatatgtgaaatatttggatggggaatcacaaggataagcacaaggtaatataggtgtacacagaagggatagctcatacagcgggtggggaggaagtgttgactagtacttaatgggagctacgacactgagttagtaccaaatgagtcccataaaaatacacagtggccagattctctctctcttcaaacatataaacacgcaaatgcacacaygcacacacatggggaaatataggagaacatctttataatcttgtccttagggaggccctttataaaaaagggagatattttaaaataacaaaagcatatgattaacacagaaaagtgtaaaatgttgtacgcccagacaaaaaacatacaaaaaatctacaatatgtaaacaaagcattgatattcatactctataagggttgtctacaaaacaatgagaataaacacctaatccaatagaaaaatagacaagatataatcatacaaaaaacgcaaaactccaaatggctaatgaaaaaa

SEQ ID NO: 141568 - DNA, 601 bp, Human
tggcctacaaaaatatatgacagtattcagggcaaccacaactgctagaaaatgaagagagaattccataaaagagggagtcagaaaaaagattcccaaattctctgcagaatcctgagccatgcatacgtagggcagactgcagacagtctaggtaaaggggatttagagaagtactgaactgagattttaagtatactgactttaaactacaaaacgcacacacgcacatacacacaaacagacaaaacttgaaatgattataacagaatctagagtctccacaacaacttacagcatmcaagatacaatgcaaaatttctccttctagaaagaagcaggaaaatgtgatccattctcaagagaaaagacaatcaatgaagactgaccctgagatgacccagataatggatttagcagacatagactttagttattataactaagctcaagatggcaaatgaaaaaatatggtaataataaatgaaaacataagaaatctcagcagagaaatagaaattataaaacagcaaagtggaaagttcagaactgaaaataaaatacctaaaatataaaaatattactgaatgagcttaacagc

SEQ ID NO: 141569 - DNA, 601 bp, Human
gtatgttgaagtcctaaccccagaaccttagagtgtgacagtatttagagataaagtctttaaagaggtaattaagttaaaatgaaatatagagggaagaccaggtgtaaatgcagaaagaagagagttatattcaagccaaggagagaggtctcaggaaaatccaaccctctctatgtgttgctctcagtcttctagcctctagagttgtgagaaaataaatttctgttgcttaagctacccagtaaggggtaccttcttatggaagccctagggaactaacatatagaccaaccccccygaaaagaacagctataactttgaagaaaacacaatgaaaaactaacctttaattataaaaatgaataaaaacaggcagattctggaagacagtaaaaacttggaagaaaggaccaggccaatgagtttcttatttacttatttgtttgcttgtatatagctagtagcctgagggcaggctaccactgtggtacattgtggagtggcaagaactctgaaaatatgaataataatggcctacaaaaatatatgacagtattcagggcaaccacaactgctagaaaatgaagagagaattcca

SEQ ID NO: 141570 - DNA, 601 bp, Human
cttacccttcaaggtacaaaaaaattctaagtactaaaatatacgggaattacaagtaaggagacgaataaattcattaaagatgaggtaccttctgttagaggagaattttgaatcctaaaattataagtacattaattttaaaactactcacttgaatttgcacttctatttcataccaactgttcattagcaaaggtttctttaccatacatttgccaatacggggtagctcatgaagagagcactggctttgagtatctagtcaagttttgtataagaaaacttctaggctgagttrttctttttcaaaataaagttgaactctgaacctacatagtatcttgaggaagtggttagtactttgtgtatgtggtgggaggggaggtcattctgaggacataaaagacattactgctaaaatatgaatgttgattcttaaatatttttaacataaaatttcagataaacagatcttaaaaaaaaccacgcactctctctactcaagggctatttttaatcgttacaagtctcaacgagcatggtatttttaaactaggaagctggaaaaaaacatttttatttttaaattgtcctttgt

SEQ ID NO: 141571 - DNA, 601 bp, Human
attattagttctttccttcttcctgccgtcccatcccaatgcacatatttgcattgaggacattacacagcttaaaacaatttgaaatattgctgtatctacttgcaactacagtgagataagtgggttcacaaactttaatcatatgttgctttttctggacaccgcatccgacctcataaggaattattactcactagatcataacatcataggctgttttgtcagataagacacttgcgaaatctaccagttgaaatgtgatcttggtcattatccagaattggcctatattaaaaaytgtctatctctctcctcttgtaactgtatatggaggtttgaattgcttgctaggaattatccctgccaacctatgacagatacagcgaagtgactcagaggaaccgtgggaatgtgcctcagtgccccactccattttaggagccaaggcgtacacataggcattttgcatgtcctttttaagagcctcaagacctgataaaactttgttagaatgtaatatgttgtttttgagtgtttgtatttttacagactaagagaaacatgaaaacttttttttctccttgctgcaaatcaaaag

SEQ ID NO: 141572 - DNA, 601 bp, Human
aggtgcaaaaatattattagttctttccttcttcctgccgtcccatcccaatgcacatatttgcattgaggacattacacagcttaaaacaatttgaaatattgctgtatctacttgcaactacagtgagataagtgggttcacaaactttaatcatatgttgctttttctggacaccgcatccgacctcataaggaattattactcactagatcataacatcataggctgttttgtcagataagacacttgcgaaatctaccagttgaaatgtgatcttggtcattatccagaattggcmtatattaaaaattgtctatctctctcctcttgtaactgtatatggaggtttgaattgcttgctaggaattatccctgccaacctatgacagatacagcgaagtgactcagaggaaccgtgggaatgtgcctcagtgccccactccattttaggagccaaggcgtacacataggcattttgcatgtcctttttaagagcctcaagacctgataaaactttgttagaatgtaatatgttgtttttgagtgtttgtatttttacagactaagagaaacatgaaaacttttttttctccttgct

SEQ ID NO: 141573 - DNA, 601 bp, Human
atgtgaagagcttattacagtaccaggtgcaaaaatattattagttctttccttcttcctgccgtcccatcccaatgcacatatttgcattgaggacattacacagcttaaaacaatttgaaatattgctgtatctacttgcaactacagtgagataagtgggttcacaaactttaatcatatgttgctttttctggacaccgcatccgacctcataaggaattattactcactagatcataacatcataggctgttttgtcagataagacacttgcgaaatctaccagttgaaatgtgaycttggtcattatccagaattggcctatattaaaaattgtctatctctctcctcttgtaactgtatatggaggtttgaattgcttgctaggaattatccctgccaacctatgacagatacagcgaagtgactcagaggaaccgtgggaatgtgcctcagtgccccactccattttaggagccaaggcgtacacataggcattttgcatgtcctttttaagagcctcaagacctgataaaactttgttagaatgtaatatgttgtttttgagtgtttgtatttttacagactaagagaaaca

SEQ ID NO: 141574 - DNA, 601 bp, Human
aatcctccatttctctctctgcttttattactgcacccaagcttgcttccttccttccttccctccttccttccttccctccctccctttctccctttcttttcttttcttttttttctctttcgctctctctctttcctttcttttctctctcttttttttgtcttactctgtcgcccaggctggagtgcagtggtgtgatcttggctcactgcaacctctgcctcctgggttcaaacgattctcctgcctcagcctcctgagtggctgggactacagtcatgtgccaccatgcccggcyaatttttgtattttcagtagagacagggtttcaccacgttcacaagactggtctcgaactcctgacctcaggtgatccatccaccttggcctcccaaagcgctgggattacaggcgtaagccactgtgctgggcctatttcttatctgacatatttcagttacttgccccactctattctaaacacaacatctaaactgatcttttcaaaatcacacatttaatcatgacacatagctgcataaaatcttttaaaagctgcttttagcatttaggataaaaactaaaattcttaaagagg

SEQ ID NO: 141575 - DNA, 601 bp, Human
atataggaattgcctaggtttatccctatgcattcccttcctttactccacgacttttcctgaatcctccatttctctctctgcttttattactgcacccaagcttgcttccttccttccttccctccttccttccttccctccctccctttctccctttcttttcttttcttttttttctctttcgctctctctctttcctttcttttctctctcttttttttgtcttactctgtcgcccaggctggagtgcagtggtgtgatcttggctcactgcaacctctgcctcctgggttcaaaygattctcctgcctcagcctcctgagtggctgggactacagtcatgtgccaccatgcccggctaatttttgtattttcagtagagacagggtttcaccacgttcacaagactggtctcgaactcctgacctcaggtgatccatccaccttggcctcccaaagcgctgggattacaggcgtaagccactgtgctgggcctatttcttatctgacatatttcagttacttgccccactctattctaaacacaacatctaaactgatcttttcaaaatcacacatttaatcatgacacatagct

SEQ ID NO: 141576 - DNA, 601 bp, Human
tttttattctagagggtcaagtagaggaatcacttactgatcctaaggattaataaatcaatgttctctgctataagagaggtgagtccaggaagaagaggtcatacacatagtgaccaagaagtggctatatttttaggaggaatctgtgcattctttgtttctatttcaacttttatataggaattgcctaggtttatccctatgcattcccttcctttactccacgacttttcctgaatcctccatttctctctctgcttttattactgcacccaagcttgcttccttccttccttcsctccttccttccttccctccctccctttctccctttcttttcttttcttttttttctctttcgctctctctctttcctttcttttctctctcttttttttgtcttactctgtcgcccaggctggagtgcagtggtgtgatcttggctcactgcaacctctgcctcctgggttcaaacgattctcctgcctcagcctcctgagtggctgggactacagtcatgtgccaccatgcccggctaatttttgtattttcagtagagacagggtttcaccacgttcacaagactggtctcgaactc

SEQ ID NO: 141577 - DNA, 601 bp, Human
attacttacatgaccacgtaccattttacattcttttatctagataataaaaggcattaaacaagtaatcctggtttaatcaacctctaaagattgcctgaaataaaagctaaactttcagttataaagtactggctctttatttaacaacttttcttttctttcttttaatcttatggagtccctgggattgttgtagacagtttctcattatctgaataaccaacatagtcccttcaaagaaagatagctgtttccactgtctgtcttccatgtcttacttggtgttttataaagggaytaaaagaacgtttcagtcttaaaaaactgaggaagaagagtaattttacataggatcaggtatagtgatctgaacatacataatggaaaagaaaaggagaaggtggactcccacctccctcaaaaaacccatggatgttttgttttgcagtttagtttttattctagagggtcaagtagaggaatcacttactgatcctaaggattaataaatcaatgttctctgctataagagaggtgagtccaggaagaagaggtcatacacatagtgaccaagaagtggctatatttttaggaggaa

SEQ ID NO: 141578 - DNA, 601 bp, Human
gtgaataaatttgaagttcactttaattattttcactaccattcaagatataagtctctgtaagatatagcaaagatatctaagaaaaaaatacagtaatctgtaaagagatttaaagtgaatatctttctatatttctttacataattttttattttaatacttggcttgtttgccttgaccagtaaactatagacatttaatgtataagtctggtacagtgctgtcccccaaaataaaacgtgagccatatttgcaatttaaaatgttctaatagacatatttcagaaaagaaagtagwaataggtaaaattaattttaataattaattttaataatggcatttaacatatctaaaattatttcatagtaggatataagcaatataaacatttattaatgagatattttgcattcttttcctttcttttttgtaccaagcctttgaaatctcgtgtgcattttacgctttcagcatatttccattttgacaaactatattttgagtgcttaaatgcctcatgtggctagtggctacgatattggaaaaggcagtccaagtgttgttaaagtcatagatgatggatatctttagaaattt

SEQ ID NO: 141579 - DNA, 601 bp, Human
aaagattcctgaattctgttacatttaaagttttattccctgtgctcccagaataaatgaatcaccaaaatgtgaataaatttgaagttcactttaattattttcactaccattcaagatataagtctctgtaagatatagcaaagatatctaagaaaaaaatacagtaatctgtaaagagatttaaagtgaatatctttctatatttctttacataattttttattttaatacttggcttgtttgccttgaccagtaaactatagacatttaatgtataagtctggtacagtgctgtccyccaaaataaaacgtgagccatatttgcaatttaaaatgttctaatagacatatttcagaaaagaaagtagaaataggtaaaattaattttaataattaattttaataatggcatttaacatatctaaaattatttcatagtaggatataagcaatataaacatttattaatgagatattttgcattcttttcctttcttttttgtaccaagcctttgaaatctcgtgtgcattttacgctttcagcatatttccattttgacaaactatattttgagtgcttaaatgcctcatgtggcta

SEQ ID NO: 141580 - DNA, 601 bp, Human
taattaataatggaataaacaaatccatgattccagtttaaagattcctgaattctgttacatttaaagttttattccctgtgctcccagaataaatgaatcaccaaaatgtgaataaatttgaagttcactttaattattttcactaccattcaagatataagtctctgtaagatatagcaaagatatctaagaaaaaaatacagtaatctgtaaagagatttaaagtgaatatctttctatatttctttacataattttttattttaatacttggcttgtttgccttgaccagtaaacyatagacatttaatgtataagtctggtacagtgctgtcccccaaaataaaacgtgagccatatttgcaatttaaaatgttctaatagacatatttcagaaaagaaagtagaaataggtaaaattaattttaataattaattttaataatggcatttaacatatctaaaattatttcatagtaggatataagcaatataaacatttattaatgagatattttgcattcttttcctttcttttttgtaccaagcctttgaaatctcgtgtgcattttacgctttcagcatatttccattttga

SEQ ID NO: 141581 - DNA, 601 bp, Human
atggtataagcaatgatagtactttgaaaattgttaagtatgatacaaatattgtgacaattagatcttaactgtattcaatgtgaagtaatttattaattaataatggaataaacaaatccatgattccagtttaaagattcctgaattctgttacatttaaagttttattccctgtgctcccagaataaatgaatcaccaaaatgtgaataaatttgaagttcactttaattattttcactaccattcaagatataagtctctgtaagatatagcaaagatatctaagaaaaaaatacrgtaatctgtaaagagatttaaagtgaatatctttctatatttctttacataattttttattttaatacttggcttgtttgccttgaccagtaaactatagacatttaatgtataagtctggtacagtgctgtcccccaaaataaaacgtgagccatatttgcaatttaaaatgttctaatagacatatttcagaaaagaaagtagaaataggtaaaattaattttaataattaattttaataatggcatttaacatatctaaaattatttcatagtaggatataagcaatataaacattt

SEQ ID NO: 141582 - DNA, 601 bp, Human
taactttttggaacagagtttaaagataatatattccatgaattattttaacatcatattaaatagatgatcatagaaatggttatttcaaacagaacttctctgcaacattttctaagggtttatggtataagcaatgatagtactttgaaaattgttaagtatgatacaaatattgtgacaattagatcttaactgtattcaatgtgaagtaatttattaattaataatggaataaacaaatccatgattccagtttaaagattcctgaattctgttacatttaaagttttattccctktgctcccagaataaatgaatcaccaaaatgtgaataaatttgaagttcactttaattattttcactaccattcaagatataagtctctgtaagatatagcaaagatatctaagaaaaaaatacagtaatctgtaaagagatttaaagtgaatatctttctatatttctttacataattttttattttaatacttggcttgtttgccttgaccagtaaactatagacatttaatgtataagtctggtacagtgctgtcccccaaaataaaacgtgagccatatttgcaatttaaaatgttc

SEQ ID NO: 141583 - DNA, 601 bp, Human
agtgctggaaagtccatttgatagcaagcagaacctatctgcttcatttcatctagacatattattgccaaatgtgagtaactatttaaccacctccaaactttacaatgcaatttttggtgcatcatacatatgctaaatgtagtcaaaatatttacttatatttctgtcaggataaatttactttacccaaaacattgttgaaagttgaagacaatgtgaacattttttccttccctaatttcaggaagacaatgatatatattcttggacatttctgtaggcacctagttccctgatygcaaaggaattcaaaagtcacaatagggaatgttttcatatctacccttagaatttaagaacagtgggcaatggtctaaaattatgtatatatatacacacacacatacacacacatattcttaaattatatatatagtttatatatacatatataactatatatgtatatatataatttaagttaaaaatcttaatttctagtaagtcatgtattccactagttgaaagtaaaaagtaaaagttccagaaagtgtcagatacttcctttttccttctccgtatacataaacaacatcta

SEQ ID NO: 141584 - DNA, 601 bp, Human
gcttcaacgccagcactctttctctcctaaaatagagattgtatttcttggttcaaacagaaaataggcctccatacttgatagtaaatagaattaaaatcttagcaataataaacataatcctaattaaacaaagtgcctcttttctttttgtagctagattttctgtggaaataagtaaaagctataaggagatttaaaaatgctcaagaatttcttgctaagctcttctctagtgctggaaagtccatttgatagcaagcagaacctatctgcttcatttcatctagacatattattkccaaatgtgagtaactatttaaccacctccaaactttacaatgcaatttttggtgcatcatacatatgctaaatgtagtcaaaatatttacttatatttctgtcaggataaatttactttacccaaaacattgttgaaagttgaagacaatgtgaacattttttccttccctaatttcaggaagacaatgatatatattcttggacatttctgtaggcacctagttccctgatcgcaaaggaattcaaaagtcacaatagggaatgttttcatatctacccttagaatttaagaacagtg

SEQ ID NO: 141585 - DNA, 601 bp, Human
tatgttaagtgaaataagccagacatagcaatgcaattacagcatgatctcactgatatgtggaatcttaaaagtttgaattcacagatgcagagagtagaatgatgattaccaggggccggatggtgggggtggagttgaggaagatgttggtcaaagggcgcatcatttcagttagataagtttaagacattttttgtataatgtggtgactatagctaataacaatgtattatattcttgaagatcattgagagtatattttaagtgttatcaccacaaaaaaagataaggaaatgargtaacgcatatgttaattagctcaatttagccattgcataatgtatgcacatttcaaaatattatattgtaatcaataaatatatgcagtttttatttaattaaaaaaagaaatgaacctcttttacaaaaagaaaatcgtatgcatgactctaggcctaactcaaatcagtctttgagttcctctccttctaacccatggaccattctgctgagatggtaggccttccagcatgcatatttacctgcatctttctcatttaaaactctgaactatttcatagtcctcaggaaagagccc

SEQ ID NO: 141586 - DNA, 601 bp, Human
tgtataaggattatctgagagaaagcatctgaaaggtggtagttgtatgtgctaggactctccaatataagaaaaagtttgactagtatagttgcgcttggtttcatcacgttcctaaggttgaattatccacatagctcctctttaggaaaattgccacttgaaagccacacaggtacataaaattcaataagttcacaatttaattaacattttggaccataacactgtttacccatctatgtttattgtgttgataagtggtacaacgtctacctagatgcaacatgaactcttctcyatccattcatagcataatttaagatttagagagttcctaccaccaaaaaaaaccagtgttttgtaactcaccttctccctgaccaagtataattaaccaaatataataatgaggaaacaaaaaactcaaataaaaaatggggactaaaatttgaagagacagcatcaaaagatatatagatggcaaataaacacatgaaaagatgcccaacatctgttgcacattagggaaatgcaaatcaaagtcacaatgaagtatcactgcatacctattagaatgactaaaattaaaaaaaatatc

SEQ ID NO: 141587 - DNA, 601 bp, Human
acaaaagctctgctgactatcttggctgacagattttctgggcttaaaaaagataacaataataatactctgttttttaatgatctgttaattgaggttggaattaaattagtctataatatacagagaaaaagttatgtgttttggaaacagcagaggcaacacagtcaccgacctctcaggttgtgctatttgctccaacttgtatggcaacagagctggcaactgcacaaaaacaacacataaaagagccaaaaaagagaaaaagggacaaaaagagttatagttccctataattctrtcagtctttgatatcattttcacaaagcagacaggaataaagagtaaagtatctgttgaatggaaattattctttggcgtaattttattttttattctttattggctcatctaattgtcaatgattcctgctgatcaaacatctgggatgttcctccccggctgcaccatctctccagctcctctgccatctctctcatctaggtcttttattttttacaaggattattgagtaatcagcttccctctctcattctttttttaaacagcctaagttatgttcctaaaaatgaggcatgta

SEQ ID NO: 141588 - DNA, 601 bp, Human
tgcccaacaagtgtcaagttcaaaaatttcgtacccagtcataaaatcacctaagtgttttcttaaatatacatgttaaattcagatttgcagatcaggattcaaggaagagctaaatgcatattacaggggcatgacatttgatgtcacataaccagaagggaagacaataactaaatttcatatgatgatagtgttggtgaggcagaggctgattaaacttctgaaaccattcctgagtctacatttaaaattggtttggcaactgatctgagacaatgagtgagcagtaatggaaagytgaaaatgagaaaggcaaaggaaataaagcatgtgtgtgtgggtgatgaacccaacgttgaacttagcaaacaaaacagcaagcaaacaaaacccaatttaggtggtaggaaggtcgagtcaataaataatgttcgttctttgaaaatcacaaagggtagcagttggtacaaagtctacctctattcaccaatacccttctcagagcacatatacattgttccaaactattatggaaaatagattaaaaatgctagttatttctaggtagctacctagatgctttcttaaaacttgaata

SEQ ID NO: 141589 - DNA, 601 bp, Human
ctatacctagtttctcacagatatttaccctatgcaccaccatatgccttcatcatgactccaaagttatatggcaaatttactgtactttgtattatatatttggatattgtagggattaagagcacataagccttagagaaatcccattgggatttgaatcttggatctgctgcttcctgattgtgtgagtattaataaattattaaattcttattgtgtctttttcccaatttgtaaaatggggatagtagaaatacttatctcatagggttattgaaaaattagatgaattaatatrtgaaaagtatgagttcctaggtcatagtatatgttcaataaatattaggtatcaccattattgcatataaacacaggtttacacacacaaggatatatgtatatacacgtatgtgcatatacatatacaatcacttatagacatatatacacaagtatgtaatatgtgttcactttcagcataataataataattaaaagatttatgcaaggaaattacattcagaagataataataactgaagcataagggaataccaataagataactagttgcccaattaagtttttcagccttgtt

SEQ ID NO: 141590 - DNA, 601 bp, Human
aaatctcaacaataatctccaccaaatcactgaactcttgtgcaagtggaaaagccgaacacagtgtaatcgcaggcaaaggatgctagctggctaattcaccattaagcacgatgccaataggggacttaaaccagtgttaaacagactgggattcagtgggcatgagaaacatgagtaggtgataaagatcctggataaaaaaggaagaaaatacctatacctagtttctcacagatatttaccctatgcaccaccatatgccttcatcatgactccaaagttatatggcaaatttacygtactttgtattatatatttggatattgtagggattaagagcacataagccttagagaaatcccattgggatttgaatcttggatctgctgcttcctgattgtgtgagtattaataaattattaaattcttattgtgtctttttcccaatttgtaaaatggggatagtagaaatacttatctcatagggttattgaaaaattagatgaattaatatgtgaaaagtatgagttcctaggtcatagtatatgttcaataaatattaggtatcaccattattgcatataaacacaggtttaca

SEQ ID NO: 141591 - DNA, 601 bp, Human
caggatggtctcgatctcctgacctcgtgatccgcctgcctcagcctcacaaagtgctgggaggactaacttttaataaccactgccttacagaaatacctttgaataatgtgggacagtcttctagtttttctaatgttttctattttcctattttttgctttcctcatttaaagtcaaccttcttattaaggttatcaacaagcaaatttagctcagtaaagattcctttaaaaggaattgcatagaagtcacacaagcagatattctatggtgtagttttagtataatatctaattaygggaataaacacaaaaatctcaacaataatctccaccaaatcactgaactcttgtgcaagtggaaaagccgaacacagtgtaatcgcaggcaaaggatgctagctggctaattcaccattaagcacgatgccaataggggacttaaaccagtgttaaacagactgggattcagtgggcatgagaaacatgagtaggtgataaagatcctggataaaaaaggaagaaaatacctatacctagtttctcacagatatttaccctatgcaccaccatatgccttcatcatgactccaaagtta

SEQ ID NO: 141592 - DNA, 601 bp, Human
ttatagtagagatgaaatgtaaaggaaaactgtggccatattttgggatatgtatgaaaatgtttgttgaggacatgcttgagtctaaattgttgcaactcaaattgtgggctgagtccagtaacattgaaatcaacaggaaggctgttagagatggagaatatcaggccccacttcaaatctgctgaataaaaatctgcatagcatgattcctatgaatgttaaaacttgataaacgctggtttaaaggatttgatgtctaacgaaattacctatagctccattgtatctgataaatatwcaaagagtagttttaattcagtgtaaatatatattccaatgtctataaagtaagaaatatacagctgaccttgaaactctgggaatgtctgtgtgggtatatgtgtatgtgtgtgagcgtgcatgagttcttgagtgatagggacaagccatacagtggtggttctcaaaattgagcaagcagcaggatcacctggaggctgttaaaacacatgagccccaccccagtatctgattcagtaggtacaaggtgaggccctaaactctgcatttttgcccagttctcaaggttactccaagg

SEQ ID NO: 141593 - DNA, 601 bp, Human
aagagagttgaaactttggattggctgtatcatagtgatttacataagggcaatctgattcctttgctctaaaaggaccacaaattcatatacataccagtatgctctgggtattactgtgtattcttcagcaattcaaaaataatctgtatgggggaggagttatttcctctgtccagaatacttttcaaaaactcattttataatgtcgatagcagggtctaaggattatttacaggcagaagaacttcagggaattaactttttccatagctgaaacatctttttttttttttttttwaatcttttatttcatctcctacatccctcatggtcactaatggcttttaaatgtctctgtctctctctgcttcctggtgatacctctggtcgtgctcttcattaaacaattcttctggcccctctgagcatagtcatatcacatgattaatcagacccacctacttcattaatcaaaacattattttcacctgcctttccagggcaggtgaaacactaattaagccaatagcattcagcatcatatgtgagtcagacagtggctagataagtgaggggagtgccatgatctgtaagaacc

SEQ ID NO: 141594 - DNA, 601 bp, Human
aaagagagttgaaactttggattggctgtatcatagtgatttacataagggcaatctgattcctttgctctaaaaggaccacaaattcatatacataccagtatgctctgggtattactgtgtattcttcagcaattcaaaaataatctgtatgggggaggagttatttcctctgtccagaatacttttcaaaaactcattttataatgtcgatagcagggtctaaggattatttacaggcagaagaacttcagggaattaactttttccatagctgaaacatctttttttttttttttttaaatcttttatttcatctcctacatccctcatggtcactaatggcttttaaatgtctctgtctctctctgcttcctggtgatacctctggtcgtgctcttcattaaacaattcttctggcccctctgagcatagtcatatcacatgattaatcagacccacctacttcattaatcaaaacattattttcacctgcctttccagggcaggtgaaacactaattaagccaatagcattcagcatcatatgtgagtcagacagtggctagataagtgaggggagtgccatgatctgtaagaac

SEQ ID NO: 141595 - DNA, 601 bp, Human
tcaaaatagagtttttgcttatataactgtagagtattgataaacagtggtttagatcattaacaagcactgttctctttaagagttttattttttccccgtataatccttcccatcagaatttgataaagaaatcatagtctactattttcctttttttaattccccatggaataaaatatttttaatagtattaaactttaggacagctgaaaagtcttgataaaagagagttaagaaaacctatgggaaatgcaagatataacaagcagttgccatcatcttatcagtagtcacacaktgacaaaacactgtaagggactaagtactaagtaactcattccgtgcatgcagaacgagtaaaagaaagttatgtactttgttcactacagtctaagtgaggtcttggattcaaactctgttcttcctggtcaaatctcactacagcatggggcacctgaggacaatcaaagaactttcttaggagaatttaaggtttgtttgaattaatatttttgttgctggatacacacatatatactctgtaaaattacctaaaaaaaagcaaggaatttaatcctcatagaaaagttgccattgc

SEQ ID NO: 141596 - DNA, 601 bp, Human
atggtaagcaagcaagcagtctctggatatgcagaaaggatgctgtgtttggggatgaagaaagagatgaggtgacattcaaagagtaatccaatagttgaggtgttcaaccatttggattagatgaacaatggtttttcatgcaactgtttctcttcatcttgtcttgcatatctactcatcaatatatatagtgggcaaataaatatgcaaacaattgaattaagtttataataatgggttcagtaaatacagataaaaccagataaaatagtatggttttaaggctggggtagggggkactatcctcattatcttgtacggcacttacttaaggaaatttcaagctccatgaacagtcaagctaaattttattctagacaaagccaggtatttgaaagtcaaaatagagtttttgcttatataactgtagagtattgataaacagtggtttagatcattaacaagcactgttctctttaagagttttattttttccccgtataatccttcccatcagaatttgataaagaaatcatagtctactattttcctttttttaattccccatggaataaaatatttttaatagtattaaact

SEQ ID NO: 141597 - DNA, 601 bp, Human
gtgcttgttccttttacaggactctccacccaactccacatttcccatctttcttctttagttctaagccatatggctgtccttgaagcaagactttttcctttcttttttctgatggtaagcaagcaagcagtctctggatatgcagaaaggatgctgtgtttggggatgaagaaagagatgaggtgacattcaaagagtaatccaatagttgaggtgttcaaccatttggattagatgaacaatggtttttcatgcaactgtttctcttcatcttgtcttgcatatctactcatcaatrtatatagtgggcaaataaatatgcaaacaattgaattaagtttataataatgggttcagtaaatacagataaaaccagataaaatagtatggttttaaggctggggtaggggggactatcctcattatcttgtacggcacttacttaaggaaatttcaagctccatgaacagtcaagctaaattttattctagacaaagccaggtatttgaaagtcaaaatagagtttttgcttatataactgtagagtattgataaacagtggtttagatcattaacaagcactgttctctttaagagt

SEQ ID NO: 141598 - DNA, 601 bp, Human
gttaacccaaactgatattctgagattttgaatcatgaaatttgtcacatattttctaatagccaaatgatgagatagatattatagcagagaggtttaaaataatgagctaaattgagaaaatgtgatttctcagcaaaccatagtatgatagagaaaaggataattaaaatgcaaattttaaccatggctataataacaaggagaaaggaaaacaaggttttcactagctacatttttttcctttctttttttttgagacagagtctcactctgtcgcccaggctggactacagtggcrtgatctgggatcactgcaagctccgcctcccgggttcacgtcattctcctgcctcagcctcccgagtagctgggactacaggcgcccgccaccacgcccggctaatttctttttgaatttttagtagagacggggtttcaccgtgttagctaggatggctacgatctcctgacctcgtgatccgcccgcctcggcctcccaaagtgctgggattacaggcatgagccactgcacccggcgggaaaacaagattttcactagctactttaaggttttctacttcacagtgatttgcttcag

SEQ ID NO: 141599 - DNA, 601 bp, Human
gtcattttagtttcttcagcagttttgagagttaacccaaactgatattctgagattttgaatcatgaaatttgtcacatattttctaatagccaaatgatgagatagatattatagcagagaggtttaaaataatgagctaaattgagaaaatgtgatttctcagcaaaccatagtatgatagagaaaaggataattaaaatgcaaattttaaccatggctataataacaaggagaaaggaaaacaaggttttcactagctacatttttttcctttctttttttttgagacagagtctcrctctgtcgcccaggctggactacagtggcgtgatctgggatcactgcaagctccgcctcccgggttcacgtcattctcctgcctcagcctcccgagtagctgggactacaggcgcccgccaccacgcccggctaatttctttttgaatttttagtagagacggggtttcaccgtgttagctaggatggctacgatctcctgacctcgtgatccgcccgcctcggcctcccaaagtgctgggattacaggcatgagccactgcacccggcgggaaaacaagattttcactagctactttaa

SEQ ID NO: 141600 - DNA, 601 bp, Human
actatcatccttcactgtgcattctgcctggaaagtatttgacacattttcattgatggtatcaaggaaagattaggactactctatctgcttacattttattgtatctatagtatttttcaaaatgaaatgttctgcgtttgggaaactagaatttttagacattcaatataagttagccattatggaaaatgtaacatcctaaactcttctgtaagaattgttccaaagacattttctaagaagaaaattcctttaaaaacattcttaatgagatatatttaatttaaatgaaacaggsggggttattttacctttaataccaactgcaatgtgaaaattattttattccaaaggacacttcggacacttatagattatgtgagcctttttaatttttcttcttttctttcattttttgagacagagtctcactttgtcacccaggctggagtgcagtggtgtaatcttggttcaccgcaacctctgcctcccaggctcaaactattctcctgcctcagcatcccaggtagctgggattacaggctgtggccaccatgcccagctaattttcacatttttagtagagatgggtgatact

SEQ ID NO: 141601 - DNA, 601 bp, Human
tcagacagcaggacaggacaagagaatagaggattcattaatatagtcatcaaatcagactgtgcatttttatatatattacgcttctggttaaagattaacgcattcctactctgatgtctttagcctggctctccccttcaacactatacctcccccgaaaggatcagttttctctgccttaataatggtagcttagcagacaggatgataggatacagggggactttagatgtcattcactctaaatctttcattttgtagatgaagacactgaaaatcctgagagcttgtgaccacmcataatttaatagtctcctagtggtagaacctgggcatggatttaagtccagtgccttttgcagaacagcccaacaacatagcacacaccccttataatcatggatctagcaaggcactgagaactcagtctcggatatgaggcactcacaattcaccagacttggtgaacaatataatggtttgacagatctctttgatatataaacatttttcctcatgccccattatttcagcaagatgatcatttgcacgcattttttaattctaggaaatctcttttcatcctaaaattctcaga

SEQ ID NO: 141602 - DNA, 601 bp, Human
agccttcattaaagttctttctttcttttcttttcttttttttttgagatggagtcttgctctgtcacctacactggagtgcagtggcacaatctcggctcactgcaacctctgcctcccaggttcaagcgattctcctgtctcagcctcccgagtagctgggactacatgtgcctgccaccatgcctggctgatttttgtatttttagtagagacagggtttcactatgttggccagtatggtctcgaacccctgacctcgtgatccacccacctcagcctcccaaagtgctgggattayaggtgtgagccaccacacccagcccaaagttctacttctttcatgaaaagtgttatccattttataatttattttactaagctaattacataagtctacatctggaaattttacagatgtccatacttttttgtgcaaagggataatttatagcaaaatttgtttgttacaatcggagttagaatgaattctgagggaaaattcaaactgggtttcaggaaggcctgacaaccagcattcaaaagtttgtttttcccatatcttactacgtattatcttcagaaacaaatgcctctcttt

SEQ ID NO: 141603 - DNA, 601 bp, Human
ggagggagcttggattacaggcgtcggcagcccagccaggacagtgcagtttttgtgctaaaagggaataccagaaggacaggtaagggtgtttcctcaccaatactactgcctccctaagtcaagtctaagggagactccaagaaaatccctcataaagtctgggagtttctacaaggaggaactactacctcacccctgctggggcatctgtttgggcaggtggcttgctcatctccccctgggttcagctcatcacagaaaatggaaaacagtgaggtttggccatagggtagcccayggcagtctggccttctgtcttttaatgtggtaaggttctgtgatgctgttgtgaggtaagtgcatattagaagaaaaggctgggtttgagccttcttgccaggactcaagagggatttgttagggttccaggacctcgttagggattgactgctggttacaggagtggagggactggaagactcctggaagagttgaatctctgactcagagaactatgcagtgtggaggcacaacagggctctcaaagaacagccgtgcacccctcaggagggtcagcatcacacaggtggctcagtaa

SEQ ID NO: 141604 - DNA, 601 bp, Human
taaaactggaaactcatgccatcattttgtttaaacttgagctatagataagattgccaatcaatgtctgttggctaatgtggtaatgtgttggtatcttttttttttgttattgttccagattgaatatcactttttatagttctagtcaccacatacctgtcagatgactgtggatttatgtttgttataagcatggtagcgaaatggccagtttcatttattctggcaacatttactgaatttttgaagaaacaagcctttagaaaaaccagagggtgctattaactaaataaaaaaygaattcagctagtaaattatccatggtaactaaaaagcctgaagagaacaaagattaagacagcttctgtcacaaaatgtttatcctgttcccgcaatgggaacatttcgaaattgctctttgctgtttataaacagaagacatgatttctcagagtcgtgatggaggcctaattacaagcattgatgtcaagactgtggggaccaacaaaggaaagatcacagtgcaaatgagtcagagaacttccttttaaaaatatttgtagatgtctggaagtttttactatttttttctaccttt

SEQ ID NO: 141605 - DNA, 601 bp, Human
gtataaagaagaagttatgagctcagtacaagtcaacattttatttcgacttccttcatagctgagcagactctgttctcgtccgatgggttaaaggagatgaaacttcaactgtaagtttagactagatgacctctaagcaaaactcacaatgctgatatattacaattcctctggagatcaaggaggagacattaaatctgattttcttgaccacccaaaatcttacttcacttctgacctttgaaaggcacaaatgtgtgggaaaaacagagatcctgataaaactggaaactcatgycatcattttgtttaaacttgagctatagataagattgccaatcaatgtctgttggctaatgtggtaatgtgttggtatcttttttttttgttattgttccagattgaatatcactttttatagttctagtcaccacatacctgtcagatgactgtggatttatgtttgttataagcatggtagcgaaatggccagtttcatttattctggcaacatttactgaatttttgaagaaacaagcctttagaaaaaccagagggtgctattaactaaataaaaaacgaattcagctagtaaatt

SEQ ID NO: 141606 - DNA, 601 bp, Human
ccaatccagaggctgtctttaagccagagaaattctagcagcgagtggagactgatctacgtaatctttaaagttcattccaacttaatgaatttataattcggttgctttcagatttgtatgtatcatgaaataaaatatattttaaagtacttgctaaccagagcatttatatttcattatgtctgacagataaactttattatctttatacctgctgctactaaactggaaagtcaaatgtgattattaacagtcatcgaaatagcgaaattcaaatattttgtgaggatttacataraggaagaaaggctttgggaaggaggtataaagaagaagttatgagctcagtacaagtcaacattttatttcgacttccttcatagctgagcagactctgttctcgtccgatgggttaaaggagatgaaacttcaactgtaagtttagactagatgacctctaagcaaaactcacaatgctgatatattacaattcctctggagatcaaggaggagacattaaatctgattttcttgaccacccaaaatcttacttcacttctgacctttgaaaggcacaaatgtgtgggaaaaacagaga

SEQ ID NO: 141607 - DNA, 601 bp, Human
tagaatcttagcttagcctctctaggtttccgttcacttcaaaaaacagaggtttggattacatggcttttacaaagtatgattttatcctaactgcataaattgccaacgattgcttcttcctattaggattgtgacaattttaccaaaagcagtcatcacaatcgctgccatgagagatgaaaaactgccctgtacaagagggcacagacttgctctggtctgccccacaaagcagaaattggatctttgataagaaaagcatagaaaggcagcttcttgccaaatgtaaggaagaatwttctggcaattagagttgctctaaaactggaatggattaccctgtgacatagagattccaatccagaggctgtctttaagccagagaaattctagcagcgagtggagactgatctacgtaatctttaaagttcattccaacttaatgaatttataattcggttgctttcagatttgtatgtatcatgaaataaaatatattttaaagtacttgctaaccagagcatttatatttcattatgtctgacagataaactttattatctttatacctgctgctactaaactggaaagtcaaatg

SEQ ID NO: 141608 - DNA, 601 bp, Human
tagatgcagtataaacatttgacaaaatttaacatgcattcatgataaaaactttcagtaaagtgtgaataaaagggaaatttattaatttgatcaagggcatttataaaaatttataactacttttctgtaaagggccagagaacaaataatttaggctttgcaataaatgggcatgaatgtgttccaatgaaactattaaaaaaactggcaaacaatctgatatcagggccgtagtttgctgcctcctgtggtggttattacatgactgtatgcgttttaacattttatatctctgcaytcaactccaaaaagttagtgttataacttaatttgaatgtagccaaaattacaaaattgatattgaggaatgaatacagtgatagaaaaaataattaaaaatattatggtaatacattgattacaggtaatatatgagtaactataaattttttacattttctgtatgtttgaaatttttcataataaaatgttgaatgaaataaaagcatagtagacatgatggtctatcattaattagtgaaaataaacaatgactatttaaaattattgataaagttttgtttttatattttgttat

SEQ ID NO: 141609 - DNA, 601 bp, Human
caggtccagttgatttcatggtgcattcacccaaacatttcaagaaaaaataatactagtgctaatcaaactcttgcaaagataacaacagtaagaaacatttaagaggcaagtattacactgataaacaatcagacaaaactctttaaaactacacaccaatagcccttataaatatgcacaaaaatcctcaataaatagtagtgaataaaagttagcaatatataaaaataataataaatcatggccaagtaatgtttttccaggtaatgaaaggttgtttcaatatttaaaaatcaawcagcataatttatcccatcaacagctttttgaaaaaatgtgatcatttcaatagatgcagtataaacatttgacaaaatttaacatgcattcatgataaaaactttcagtaaagtgtgaataaaagggaaatttattaatttgatcaagggcatttataaaaatttataactacttttctgtaaagggccagagaacaaataatttaggctttgcaataaatgggcatgaatgtgttccaatgaaactattaaaaaaactggcaaacaatctgatatcagggccgtagtttgctgcctcc

SEQ ID NO: 141610 - DNA, 601 bp, Human
gcagaaagaagaaaataacaaaggtaacaaaaatcaataaaatctgaaacataaaatgaaagataaatcaatgaaaacaaaatctagttttcttaagtggtcaataaaattgataaaacgctagccagaatgattaacaaaaaaagatgatataaataatcaatatcagaaattaaagaaggaacatcaatatagatcttatagatattataagaataataagcaactagaatgaatacctggatgctcatacatttcacaacttaaatgagcttttttccctgagacataaactttaaamctcactcaagaggacataaagcaacctgaatagtcctatagttattaaaggaaatgaactggtagttaatatccttccaacaacaaaaaaattcaggtccagttgatttcatggtgcattcacccaaacatttcaagaaaaaataatactagtgctaatcaaactcttgcaaagataacaacagtaagaaacatttaagaggcaagtattacactgataaacaatcagacaaaactctttaaaactacacaccaatagcccttataaatatgcacaaaaatcctcaataaatagtagtga

SEQ ID NO: 141611 - DNA, 601 bp, Human
atcaataattaaatgtacctagaaaatccccaaatatttttcaactaaacaatacagttctattatctttcggctcaaataggaatacatgagaagagttaaaaatattttgaaatgattgaaaatgaagatacaaccaaaaactctttgtgaggcatctagagtagtgcttagaggaaataacgtcgctttatcaaaaaagaatgaggggttcatctcagtgatttcaccttcaattaagacagtataaaaagaagagcaagtttaaaccaaaacaagcagaaagaagaaaataacaaasgtaacaaaaatcaataaaatctgaaacataaaatgaaagataaatcaatgaaaacaaaatctagttttcttaagtggtcaataaaattgataaaacgctagccagaatgattaacaaaaaaagatgatataaataatcaatatcagaaattaaagaaggaacatcaatatagatcttatagatattataagaataataagcaactagaatgaatacctggatgctcatacatttcacaacttaaatgagcttttttccctgagacataaactttaaaactcactcaagaggacataaagc

SEQ ID NO: 141612 - DNA, 601 bp, Human
gaacattcaccaagatagaccatagtgtggaccatgaaacaaacctcagcacatttatttaggttgaaatcatactaagtaagttctatgactacaacacaaataaacaaccaatcaataattaaatgtacctagaaaatccccaaatatttttcaactaaacaatacagttctattatctttcggctcaaataggaatacatgagaagagttaaaaatattttgaaatgattgaaaatgaagatacaaccaaaaactctttgtgaggcatctagagtagtgcttagaggaaataacgtcactttatcaaaaaagaatgaggggttcatctcagtgatttcaccttcaattaagacagtataaaaagaagagcaagtttaaaccaaaacaagcagaaagaagaaaataacaaaggtaacaaaaatcaataaaatctgaaacataaaatgaaagataaatcaatgaaaacaaaatctagttttcttaagtggtcaataaaattgataaaacgctagccagaatgattaacaaaaaaagatgatataaataatcaatatcagaaattaaagaaggaacatcaatatagatcttatagatatta

SEQ ID NO: 141613 - DNA, 601 bp, Human
agggatataacataaagataaaaaggcgaatttgctgagaagatataaaaattctatgtgtgcttgcagttaacaaaagaaccctataatacaagatgccataactattaaaactgaaacaagaaacaaagaaaagtagaattataagtggaggtttcagcattcctctctctgtaaccaacagaaccagtagacagaaatttagtaatgatatagaagacctgaacaacactatcaacaacatgagaacagcagaatacacatttcttgcttgtgcacatggaacattcaccaagatagrccatagtgtggaccatgaaacaaacctcagcacatttatttaggttgaaatcatactaagtaagttctatgactacaacacaaataaacaaccaatcaataattaaatgtacctagaaaatccccaaatatttttcaactaaacaatacagttctattatctttcggctcaaataggaatacatgagaagagttaaaaatattttgaaatgattgaaaatgaagatacaaccaaaaactctttgtgaggcatctagagtagtgcttagaggaaataacgtcgctttatcaaaaaagaatg

SEQ ID NO: 141614 - DNA, 601 bp, Human
agaagaagcaatgttactaggtatatagagggatataacataaagataaaaaggcgaatttgctgagaagatataaaaattctatgtgtgcttgcagttaacaaaagaaccctataatacaagatgccataactattaaaactgaaacaagaaacaaagaaaagtagaattataagtggaggtttcagcattcctctctctgtaaccaacagaaccagtagacagaaatttagtaatgatatagaagacctgaacaacactatcaacaacatgagaacagcagaatacacatttcttgctygtgcacatggaacattcaccaagatagaccatagtgtggaccatgaaacaaacctcagcacatttatttaggttgaaatcatactaagtaagttctatgactacaacacaaataaacaaccaatcaataattaaatgtacctagaaaatccccaaatatttttcaactaaacaatacagttctattatctttcggctcaaataggaatacatgagaagagttaaaaatattttgaaatgattgaaaatgaagatacaaccaaaaactctttgtgaggcatctagagtagtgcttagagga

SEQ ID NO: 141615 - DNA, 601 bp, Human
ctcccatggctacattaatataaaagtagatgtatttcagaagaagcaatgttactaggtatatagagggatataacataaagataaaaaggcgaatttgctgagaagatataaaaattctatgtgtgcttgcagttaacaaaagaaccctataatacaagatgccataactattaaaactgaaacaagaaacaaagaaaagtagaattataagtggaggtttcagcattcctctctctgtaaccaacagaaccagtagacagaaatttagtaatgatatagaagacctgaacaacactaycaacaacatgagaacagcagaatacacatttcttgcttgtgcacatggaacattcaccaagatagaccatagtgtggaccatgaaacaaacctcagcacatttatttaggttgaaatcatactaagtaagttctatgactacaacacaaataaacaaccaatcaataattaaatgtacctagaaaatccccaaatatttttcaactaaacaatacagttctattatctttcggctcaaataggaatacatgagaagagttaaaaatattttgaaatgattgaaaatgaagatacaaccaa

SEQ ID NO: 141616 - DNA, 601 bp, Human
tacaaatatttaatccaataacaggcataaaaggaaaaacgcaatgaagaacagatagcaatgggggtaggtttccagtttacccatatcataattatactcaatgaaatgtatgatctaaacacactaatgaaaataaagagatgatcatatacgaaaaaagtacaggcacaactctatcacaattcatccatagaagtaaaggaaaaataaaaatataacataaaacaataatgaaaagaaagctcccatggctacattaatataaaagtagatgtatttcagaagaagcaatgttackaggtatatagagggatataacataaagataaaaaggcgaatttgctgagaagatataaaaattctatgtgtgcttgcagttaacaaaagaaccctataatacaagatgccataactattaaaactgaaacaagaaacaaagaaaagtagaattataagtggaggtttcagcattcctctctctgtaaccaacagaaccagtagacagaaatttagtaatgatatagaagacctgaacaacactatcaacaacatgagaacagcagaatacacatttcttgcttgtgcacatggaacattc

SEQ ID NO: 141617 - DNA, 601 bp, Human
tattttaaaatatatgagtagagagctatacatgtaaataattagggttatacaaatatttaatccaataacaggcataaaaggaaaaacgcaatgaagaacagatagcaatgggggtaggtttccagtttacccatatcataattatactcaatgaaatgtatgatctaaacacactaatgaaaataaagagatgatcatatacgaaaaaagtacaggcacaactctatcacaattcatccatagaagtaaaggaaaaataaaaatataacataaaacaataatgaaaagaaagctcccrtggctacattaatataaaagtagatgtatttcagaagaagcaatgttactaggtatatagagggatataacataaagataaaaaggcgaatttgctgagaagatataaaaattctatgtgtgcttgcagttaacaaaagaaccctataatacaagatgccataactattaaaactgaaacaagaaacaaagaaaagtagaattataagtggaggtttcagcattcctctctctgtaaccaacagaaccagtagacagaaatttagtaatgatatagaagacctgaacaacactatcaaca

SEQ ID NO: 141618 - DNA, 601 bp, Human
aaacatgatatagcttagtttaaatattgtctaaatagatgtataacagcagtttctttgggacccaatctcacagttctctgagctgtagaacaggtctatacaatgcaatgttcttcacagtgtcttccttaggtcaactgtatcagtatcaactgggagtttgttagaaatgcaaatttggactttgtcttagtacatgtaacttaaatctggtgatggagaaaatgaacctgagttttggcaagccctccttatgattcctatccacttagaaatttgagaagaactggtattgtgmtataatcccagaatttcatgacagcacaaaaccacaaaaaactacatatattacttttagaagtaggtctaaacaattttatgtatacatctaagaatcatgacagaagaaggggactggagagctaggcgcttaatcacagactgcctacctcttacagaaatgcataatctcctttggttaaaagagtaccttctgctgtcttaaacttttcaaggtcattaacctcaatgcattaataaaattaccaaattatgttttcattttgaaatatacttgctttccataaaattgatagaa

SEQ ID NO: 141619 - DNA, 601 bp, Human
tactcactacgtaccagagttcttatatatgaaaaaatacatgtactatacataaacatcacacaaatgtaataaatacaaacatgatatagcttagtttaaatattgtctaaatagatgtataacagcagtttctttgggacccaatctcacagttctctgagctgtagaacaggtctatacaatgcaatgttcttcacagtgtcttccttaggtcaactgtatcagtatcaactgggagtttgttagaaatgcaaatttggactttgtcttagtacatgtaacttaaatctggtgatgragaaaatgaacctgagttttggcaagccctccttatgattcctatccacttagaaatttgagaagaactggtattgtgatataatcccagaatttcatgacagcacaaaaccacaaaaaactacatatattacttttagaagtaggtctaaacaattttatgtatacatctaagaatcatgacagaagaaggggactggagagctaggcgcttaatcacagactgcctacctcttacagaaatgcataatctcctttggttaaaagagtaccttctgctgtcttaaacttttcaaggtca

SEQ ID NO: 141620 - DNA, 601 bp, Human
tatccattaatctatgtaagcatactcactacgtaccagagttcttatatatgaaaaaatacatgtactatacataaacatcacacaaatgtaataaatacaaacatgatatagcttagtttaaatattgtctaaatagatgtataacagcagtttctttgggacccaatctcacagttctctgagctgtagaacaggtctatacaatgcaatgttcttcacagtgtcttccttaggtcaactgtatcagtatcaactgggagtttgttagaaatgcaaatttggactttgtcttagtacrtgtaacttaaatctggtgatggagaaaatgaacctgagttttggcaagccctccttatgattcctatccacttagaaatttgagaagaactggtattgtgatataatcccagaatttcatgacagcacaaaaccacaaaaaactacatatattacttttagaagtaggtctaaacaattttatgtatacatctaagaatcatgacagaagaaggggactggagagctaggcgcttaatcacagactgcctacctcttacagaaatgcataatctcctttggttaaaagagtaccttctgc

SEQ ID NO: 141621 - DNA, 601 bp, Human
cagaggtcctagtcataacaccggtaatcccgtctgaagcaaaagaggtgaatctattatttactacggagaattattagcatgatttaatctacctcatatttcataattactaaatcacatatcttccagatgttactacctaaatttgttcaagtccaatcttctatcatcttctcctatgttcactgctctatttcaggcaatcatcatcatttgaaccattccctgcataaatgacctaaatggatccttataatttatagggtaaaataaaagcccgatagcaagatgtggaaartccttctcaccttctccctgcccacatttttaggatcatccaaaatagatagtgaactctgcttgttaaacactctgacttttgcatattgtgccttttctgtcttgaatgctcatgcatgttcatgatcatgatagatatccacttgtactgtcctctgtataattccatgtcattacagaaaagttcagttccttctctcatgttacagtagcccctcttatagaccttattacattgtaagatccttgtttacatgcatttctctttcatctacctgaccgtgacccacttgaaggc

SEQ ID NO: 141622 - DNA, 601 bp, Human
aggttctttttctgaaaagaacaattataacaagattttctttttttgtaggatgatacagttttttttggtccagttccatgacttaaccaaaaggacctatgaatggactttgttcctgttcaggaatcctcagataggaggtagaacctatacaatcctagcagaggtcctagtcataacaccggtaatcccgtctgaagcaaaagaggtgaatctattatttactacggagaattattagcatgatttaatctacctcatatttcataattactaaatcacatatcttccagatgtyactacctaaatttgttcaagtccaatcttctatcatcttctcctatgttcactgctctatttcaggcaatcatcatcatttgaaccattccctgcataaatgacctaaatggatccttataatttatagggtaaaataaaagcccgatagcaagatgtggaaagtccttctcaccttctccctgcccacatttttaggatcatccaaaatagatagtgaactctgcttgttaaacactctgacttttgcatattgtgccttttctgtcttgaatgctcatgcatgttcatgatcatgata

SEQ ID NO: 141623 - DNA, 601 bp, Human
tgatctcaggcttccagcctctgtaactgcaagaaataaatttctgttgtttaagccacccaatctatggtattctattgtgacaagccgaggtgactaatacaatggagaaattaaacaaggctggcccctatgacagatgtttctaaaaggttctttttctgaaaagaacaattataacaagattttctttttttgtaggatgatacagttttttttggtccagttccatgacttaaccaaaaggacctatgaatggactttgttcctgttcaggaatcctcagataggaggtagaacytatacaatcctagcagaggtcctagtcataacaccggtaatcccgtctgaagcaaaagaggtgaatctattatttactacggagaattattagcatgatttaatctacctcatatttcataattactaaatcacatatcttccagatgttactacctaaatttgttcaagtccaatcttctatcatcttctcctatgttcactgctctatttcaggcaatcatcatcatttgaaccattccctgcataaatgacctaaatggatccttataatttatagggtaaaataaaagcccgatag

SEQ ID NO: 141624 - DNA, 601 bp, Human
taatatgaaataaaaatattggtcagtgagattaaataagaaacatatattggttttaatgtgtgctttacatggtgaaatcttttccctttctagaaatttatcagataattaagtagtgaaagaccaaaaagaccagtgtttatactggcatattattttctcttcaagtacataattctgattaaacaactaagattcaaatctttatagctttctgccataaaactaaagaataccttagacaatcccacactttggggagcagactaaagttacatcatttataaaataggaaaarcacttggcccttttctagttaataagaaatgggatctatgagacatgcagttagaactatttagaagaatggtgctataaagaaaagccacaatgatggttaaaacaaatcttcttattaataaaaattttgatttttgaaaatattatttaaattacacagcgaaaaaggaattaaaatctaatcatttctgccaaactgttgaagataaatatgagaagtgttacatacagaaaaggggctggataatatttagaaataaaccagccctaatgaaactgaagtaacgttttataactg

SEQ ID NO: 141625 - DNA, 601 bp, Human
ctctgatgcatacttgtgaatgtcaagtaataaatagaaatgagtaaaaattaaattaatatgaaataaaaatattggtcagtgagattaaataagaaacatatattggttttaatgtgtgctttacatggtgaaatcttttccctttctagaaatttatcagataattaagtagtgaaagaccaaaaagaccagtgtttatactggcatattattttctcttcaagtacataattctgattaaacaactaagattcaaatctttatagctttctgccataaaactaaagaataccttagrcaatcccacactttggggagcagactaaagttacatcatttataaaataggaaaaacacttggcccttttctagttaataagaaatgggatctatgagacatgcagttagaactatttagaagaatggtgctataaagaaaagccacaatgatggttaaaacaaatcttcttattaataaaaattttgatttttgaaaatattatttaaattacacagcgaaaaaggaattaaaatctaatcatttctgccaaactgttgaagataaatatgagaagtgttacatacagaaaaggggctg

SEQ ID NO: 141626 - DNA, 601 bp, Human
cagtgttaagagagaaagatgaactgaatcataatattggatcagaagtttattgaatgtaggaaaatatgttaggctatctttatatcctctgtagtctctgatgcatacttgtgaatgtcaagtaataaatagaaatgagtaaaaattaaattaatatgaaataaaaatattggtcagtgagattaaataagaaacatatattggttttaatgtgtgctttacatggtgaaatcttttccctttctagaaatttatcagataattaagtagtgaaagaccaaaaagaccagtgtttatrctggcatattattttctcttcaagtacataattctgattaaacaactaagattcaaatctttatagctttctgccataaaactaaagaataccttagacaatcccacactttggggagcagactaaagttacatcatttataaaataggaaaaacacttggcccttttctagttaataagaaatgggatctatgagacatgcagttagaactatttagaagaatggtgctataaagaaaagccacaatgatggttaaaacaaatcttcttattaataaaaattttgatttttgaaaatat

SEQ ID NO: 141627 - DNA, 601 bp, Human
ctttaccccgactgcagatgcatggacattaggatcctgctgatcagagctgacagctccgtgttgtaaagtaatcctttaggaagaaataaagaactactttaaacacacataggttttctaggatcattaattcctgtattcctccttctctcaattatttgttttcagtctgtatgtaccctagtttggtttttccccaagcctttatttctattcagattcctttgaaagagaattgcttattttgcagacctatataatagagaggtacttttggattacttgtcagattcttatkcagggagctttgtctaaggcatttttaggtgctggacatctagtagagtgctttatatatgataggaactcaaaaagcactctggggagaagaattatagacatattaaaaaacaaagtggttagagaatatggatcatttttataaatgtatcttgacacagatgtaacacagaggatttgggaacagtgagatgagtatgagaggatgagatgagttggagccaagtcatgaagagtttagcagcagtgttaagagagaaagatgaactgaatcataatattggatcagaagtttatt

SEQ ID NO: 141628 - DNA, 601 bp, Human
aaaatagctaattactgaagatataaaaaaaaaagttaagatgtttttctctttcattatgacaagtgtcagagtgaaacttggatactaaacattacctaattctctgctcttagtctcgctatgtatgatgccaccttttccttcaaagaccaagatcacattgtccttcctttcctcacttctctcttaaaagacacacatatttaagtccgtaactattgatagctgtccccctataattgatagctaattctatcagcgatacaattagctcataaatatttatacttgagaaatmtccccctatgttggtagctaattaaattcctcttcatttaacctaatatagctcaggactatattttaaaatacacaaaaaatgaaacaagaagtattcttaataatgcaatcattttcttgaacttcttagaacatttagcacaatgccctgaatatcgtgggtgctcaagaaatattttctcctgtcaagtattcatagcccggtgaggcagacaggcacaactaattacaataaaaatgctctaagagattaacacaaagtggggtgggaatagggaagaggaagtgattaattctg

SEQ ID NO: 141629 - DNA, 601 bp, Human
aaatgttcttgaacattcccacacatagcttccgcataaaatagctaattactgaagatataaaaaaaaaagttaagatgtttttctctttcattatgacaagtgtcagagtgaaacttggatactaaacattacctaattctctgctcttagtctcgctatgtatgatgccaccttttccttcaaagaccaagatcacattgtccttcctttcctcacttctctcttaaaagacacacatatttaagtccgtaactattgatagctgtccccctataattgatagctaattctatcagcratacaattagctcataaatatttatacttgagaaatatccccctatgttggtagctaattaaattcctcttcatttaacctaatatagctcaggactatattttaaaatacacaaaaaatgaaacaagaagtattcttaataatgcaatcattttcttgaacttcttagaacatttagcacaatgccctgaatatcgtgggtgctcaagaaatattttctcctgtcaagtattcatagcccggtgaggcagacaggcacaactaattacaataaaaatgctctaagagattaacacaaag

SEQ ID NO: 141630 - DNA, 601 bp, Human
aaatgtgaatcaattaattctccttgaaactaatagatagtattttttaatctctctggggagacaatgtattataggctcctgatcttattcaacactcagactcttgcttgactggcagtgtaaaacaatcaagtttgaactagaagaaaattattttctatctttaaatcttgataaatgttcttgaacattcccacacatagcttccgcataaaatagctaattactgaagatataaaaaaaaaagttaagatgtttttctctttcattatgacaagtgtcagagtgaaacttggayactaaacattacctaattctctgctcttagtctcgctatgtatgatgccaccttttccttcaaagaccaagatcacattgtccttcctttcctcacttctctcttaaaagacacacatatttaagtccgtaactattgatagctgtccccctataattgatagctaattctatcagcgatacaattagctcataaatatttatacttgagaaatatccccctatgttggtagctaattaaattcctcttcatttaacctaatatagctcaggactatattttaaaatacacaaaaaatga

SEQ ID NO: 141631 - DNA, 601 bp, Human
atgtaaatacaacctaacttacaaatcgtcccggcagttgctgaattgctaactttttacatttaatatgcaggaaatataacatttatctgaatgctccttaagtaggtaaaatacatgatttgagaaaaaaattgctactgtaaactttgaccagcaattatttaaaaagtaagcaggttaattaaaatgtcagatttgaattatcctgctattaaaacatataaaaagcaaaataaaatttaactgtgtactatcgaggtaaatttgtatcccttttaaaaaagggtcaaggcctggygcggtggctgatgcctgtaatcccagcactttgggaggccgaagctggcgaattacctgaggttgggagttcgcgaccagcctgaccaacatggagaaaccccgtctctactaaaaatacaaaaaatagccaggtgtggtggcgggcacctgtaatcccagctattagggaggctgaggcaggagaatcacttgaacttgggagactgaggttgtggtgagctgagatcacgccattgcactccatcctgggcaataagagtgaaactccatctcaaaagaaaaaaaaaagggtcaaata

SEQ ID NO: 141632 - DNA, 601 bp, Human
ctggttaaccgtctgtttgtcacagtgggaaggaaatgggacagatatatagaggaatagcctatgagagctgtgtgaccatcagacacagtgcccatgaagctgtgtgctgttagcaaagcccattatgagaataactgagagagctgacaatagacactgtctattgctcatccagccataagggcacagagagttttgtgtgcatgacagtaatggctagattagtcttagatttccatttgcactatttttagatggttaagtttttgtgtaggaaactagagaatgaaagagatayataaacggactttagtacctggaaaacacatgaggaaatattgaaatctacttgaattttccaacatgagtggttttacacatgttctatcttttaatgtacttgtaagcttttgtagtatataggctacctttttaaattctacatcaaaaaaatagtatctattgctttctttttcatgaagtcatttagaagaaaagatgattttactaaaatttaaaataaatgtgtcaggtattctttttcctgtcggaagttttcatttctattcaaagccatgttaattctgttttctgcatt

SEQ ID NO: 141633 - DNA, 601 bp, Human
atgacttttaaagtcacctacaaaatgactgtgtcttcaaacgtggttactgtatggaggaaaatcacttcacttattaattcagctactggttaaccgtctgtttgtcacagtgggaaggaaatgggacagatatatagaggaatagcctatgagagctgtgtgaccatcagacacagtgcccatgaagctgtgtgctgttagcaaagcccattatgagaataactgagagagctgacaatagacactgtctattgctcatccagccataagggcacagagagttttgtgtgcatgacaktaatggctagattagtcttagatttccatttgcactatttttagatggttaagtttttgtgtaggaaactagagaatgaaagagatacataaacggactttagtacctggaaaacacatgaggaaatattgaaatctacttgaattttccaacatgagtggttttacacatgttctatcttttaatgtacttgtaagcttttgtagtatataggctacctttttaaattctacatcaaaaaaatagtatctattgctttctttttcatgaagtcatttagaagaaaagatgattttacta

SEQ ID NO: 141634 - DNA, 601 bp, Human
atgtgatattattgacttttttgttacttgagaaattaccatcctctcttatagtatacaagattctatgatggctcatgaataaggtatgacttttaaagtcacctacaaaatgactgtgtcttcaaacgtggttactgtatggaggaaaatcacttcacttattaattcagctactggttaaccgtctgtttgtcacagtgggaaggaaatgggacagatatatagaggaatagcctatgagagctgtgtgaccatcagacacagtgcccatgaagctgtgtgctgttagcaaagcccrttatgagaataactgagagagctgacaatagacactgtctattgctcatccagccataagggcacagagagttttgtgtgcatgacagtaatggctagattagtcttagatttccatttgcactatttttagatggttaagtttttgtgtaggaaactagagaatgaaagagatacataaacggactttagtacctggaaaacacatgaggaaatattgaaatctacttgaattttccaacatgagtggttttacacatgttctatcttttaatgtacttgtaagcttttgtagtatata

SEQ ID NO: 141635 - DNA, 601 bp, Human
tattggagctaagataaaacagatgtagaattagaccaacaagagcattttagctgtaagtgattttgttcatgtgatattattgacttttttgttacttgagaaattaccatcctctcttatagtatacaagattctatgatggctcatgaataaggtatgacttttaaagtcacctacaaaatgactgtgtcttcaaacgtggttactgtatggaggaaaatcacttcacttattaattcagctactggttaaccgtctgtttgtcacagtgggaaggaaatgggacagatatatagargaatagcctatgagagctgtgtgaccatcagacacagtgcccatgaagctgtgtgctgttagcaaagcccattatgagaataactgagagagctgacaatagacactgtctattgctcatccagccataagggcacagagagttttgtgtgcatgacagtaatggctagattagtcttagatttccatttgcactatttttagatggttaagtttttgtgtaggaaactagagaatgaaagagatacataaacggactttagtacctggaaaacacatgaggaaatattgaaatctactt

SEQ ID NO: 141636 - DNA, 601 bp, Human
tatcaaatctatttctgaaaaaaatgaggtatcaatggctgacatttaaaaattatgtgcaaataaaaagatgatgaataactaaaatgaagttttaaatattggagctaagataaaacagatgtagaattagaccaacaagagcattttagctgtaagtgattttgttcatgtgatattattgacttttttgttacttgagaaattaccatcctctcttatagtatacaagattctatgatggctcatgaataaggtatgacttttaaagtcacctacaaaatgactgtgtcttcaaacrtggttactgtatggaggaaaatcacttcacttattaattcagctactggttaaccgtctgtttgtcacagtgggaaggaaatgggacagatatatagaggaatagcctatgagagctgtgtgaccatcagacacagtgcccatgaagctgtgtgctgttagcaaagcccattatgagaataactgagagagctgacaatagacactgtctattgctcatccagccataagggcacagagagttttgtgtgcatgacagtaatggctagattagtcttagatttccatttgcactattttt

SEQ ID NO: 141637 - DNA, 601 bp, Human
catggatgtatcaaatctatttctgaaaaaaatgaggtatcaatggctgacatttaaaaattatgtgcaaataaaaagatgatgaataactaaaatgaagttttaaatattggagctaagataaaacagatgtagaattagaccaacaagagcattttagctgtaagtgattttgttcatgtgatattattgacttttttgttacttgagaaattaccatcctctcttatagtatacaagattctatgatggctcatgaataaggtatgacttttaaagtcacctacaaaatgactgtgtmttcaaacgtggttactgtatggaggaaaatcacttcacttattaattcagctactggttaaccgtctgtttgtcacagtgggaaggaaatgggacagatatatagaggaatagcctatgagagctgtgtgaccatcagacacagtgcccatgaagctgtgtgctgttagcaaagcccattatgagaataactgagagagctgacaatagacactgtctattgctcatccagccataagggcacagagagttttgtgtgcatgacagtaatggctagattagtcttagatttccatttgca

SEQ ID NO: 141638 - DNA, 601 bp, Human
taggccatgctagttatgaggatgtttttgcaagggatttcattgaattcctcctgcccagggtcagaagagagcagtgggaagatgtcaagactgagtgaaccggtcaggccaagaaactgctgcttaggaatacaggatcaagaaggagctggaaggccggcgaagtggctcatgcctgtaatcccaacactttgggaggctgtggtgggtagatcccttgaggttaggagttcaagactcagcctggccaacatgttgaaaccctatctctactaaaaatacaaaaattagccgggcrtggtggtgggtgcctgtagccccagctactcgggaggctgaagcaggagaatcacttgaaccctggaggcagaggttgcagtgagccaagatcacaccactgcactccagcctgggcgactgagcaaaactctgccttaaaaaaaaaaaattatgttttctttaagatccatggatgtatcaaatctatttctgaaaaaaatgaggtatcaatggctgacatttaaaaattatgtgcaaataaaaagatgatgaataactaaaatgaagttttaaatattggagctaagataaaacagat

SEQ ID NO: 141639 - DNA, 601 bp, Human
ggcagacagacaaagattgttagagcagaactctcatttatgaaggaagaggttggtggggtctgaccattgtaaatctctaatccgtttccctggccaagttgcaagtcaagaaccacaaataagacgggagccagagggtagggggtgggcgggggaggaagagaagttcagatatcaaaattgagatgccatcctaggccatgctagttatgaggatgtttttgcaagggatttcattgaattcctcctgcccagggtcagaagagagcagtgggaagatgtcaagactgagtgaacyggtcaggccaagaaactgctgcttaggaatacaggatcaagaaggagctggaaggccggcgaagtggctcatgcctgtaatcccaacactttgggaggctgtggtgggtagatcccttgaggttaggagttcaagactcagcctggccaacatgttgaaaccctatctctactaaaaatacaaaaattagccgggcgtggtggtgggtgcctgtagccccagctactcgggaggctgaagcaggagaatcacttgaaccctggaggcagaggttgcagtgagccaagatcacaccactgc

SEQ ID NO: 141640 - DNA, 601 bp, Human
tatataccctgtgacaatgactggtgtccgttttgcttaaacagagtcatcaagagacaggtgacttaagcctaggacctcctgcttcctaatgttaagggctattgatatatactttagtttttcaatatcttgaagcaaaaaataatttgtggcttgcacatttatattatttagaaaaaataattcaagtgcaataactgatttatttgggttgaatgatataggcctatagtatttaagatatgtaattatatgttgcttttcatgacaatagaggaaatcactggtagagacaaaygaaagtaatacataatcccaataatccagtatatttgattttggaataaaatttatattaagcattttacatcatgcttgtctggccttaatctcctttgatttatgttataattagtttgtaatatgttattacttacaaagaaaccaatatagggacaaagaaattcctaggaattttaggggatcataaatcatgacagtgttatgtataacctattgattgcagaggaatcagataggtgagaagggttgggtctgggaaccagagcttttccctgaaataaagaggacctgggag

SEQ ID NO: 141641 - DNA, 601 bp, Human
cagaagtaagatgtagagcaggggccccaagggtatcactatataccctgtgacaatgactggtgtccgttttgcttaaacagagtcatcaagagacaggtgacttaagcctaggacctcctgcttcctaatgttaagggctattgatatatactttagtttttcaatatcttgaagcaaaaaataatttgtggcttgcacatttatattatttagaaaaaataattcaagtgcaataactgatttatttgggttgaatgatataggcctatagtatttaagatatgtaattatatgttgyttttcatgacaatagaggaaatcactggtagagacaaacgaaagtaatacataatcccaataatccagtatatttgattttggaataaaatttatattaagcattttacatcatgcttgtctggccttaatctcctttgatttatgttataattagtttgtaatatgttattacttacaaagaaaccaatatagggacaaagaaattcctaggaattttaggggatcataaatcatgacagtgttatgtataacctattgattgcagaggaatcagataggtgagaagggttgggtctgg

SEQ ID NO: 141642 - DNA, 601 bp, Human
atgaatggaagcttcctgaggccctcaccagaagcagatgttgatgctgtgcttcttatagagtgtgcagaaccataaaccaaataaacctcttttctttataaattacctagtctcagatatttcttcattgcaacaaaaatggactaagacaggaggcaggggacaagcagatcaatgaatgatctaaaatgtcaagctaaagaatgtggcagtatcctgtaagaaatgggaaaccattttggcactttaaacagggtagcctcagatattagtttagaaatataattcaggaagcaaratggaagacataagaaacaaggcagagaccaggggcaggggtacttagatttgggcatcagtggagagcaaggggaagacagtgccaagataataggagcaggaacagatatttattgaccgactacacatggaagggatgagaagaaggtaggatctagaataagataaatgtttttgatgtaagtttctgggtggattgtggtgatgttgactaagaaaaggaattaagcaggaggaagaatatgttttagagagactctgataaattctctttgattgaatttaagtcttcaggagg

SEQ ID NO: 141643 - DNA, 601 bp, Human
atttggaaaaaaaaattgccacatggaagggcagaataaggccattctcgaataagagaagaaaataacgtatttggggatttgtatttataatccatcaggaaatattgaagagtaaagtgttaatgggggattgaaagatgagacaagaaaaggaagtgatacagaggatgttcgtctctttcaaatagcatgttgaaatgtaatccctgatgttgaaagtggggcttagagggatgtgtttgagtgatgagggtggattgtgggttgctcacaaaaggcttagtgtcatcctaggagyaattagtgagttctcacactatcagttctcacaagagctgattgttgaaaggacccctgcacctccctccctcgcttccttcctctttccccctgtgatgcctgcttcccttcactcttttgccatgaatggaagcttcctgaggccctcaccagaagcagatgttgatgctgtgcttcttatagagtgtgcagaaccataaaccaaataaacctcttttctttataaattacctagtctcagatatttcttcattgcaacaaaaatggactaagacaggaggcaggggacaagcagatc

SEQ ID NO: 141644 - DNA, 601 bp, Human
agcctgacactgggcattcagtcagggagaagaccagaaaaggcctcctgcaaaaggtatatctgaggtaggatttggaaaaaaaaattgccacatggaagggcagaataaggccattctcgaataagagaagaaaataacgtatttggggatttgtatttataatccatcaggaaatattgaagagtaaagtgttaatgggggattgaaagatgagacaagaaaaggaagtgatacagaggatgttcgtctctttcaaatagcatgttgaaatgtaatccctgatgttgaaagtggggcytagagggatgtgtttgagtgatgagggtggattgtgggttgctcacaaaaggcttagtgtcatcctaggagtaattagtgagttctcacactatcagttctcacaagagctgattgttgaaaggacccctgcacctccctccctcgcttccttcctctttccccctgtgatgcctgcttcccttcactcttttgccatgaatggaagcttcctgaggccctcaccagaagcagatgttgatgctgtgcttcttatagagtgtgcagaaccataaaccaaataaacctcttttctttataa

SEQ ID NO: 141645 - DNA, 601 bp, Human
tagaagacatggatcacagcctgacactgggcattcagtcagggagaagaccagaaaaggcctcctgcaaaaggtatatctgaggtaggatttggaaaaaaaaattgccacatggaagggcagaataaggccattctcgaataagagaagaaaataacgtatttggggatttgtatttataatccatcaggaaatattgaagagtaaagtgttaatgggggattgaaagatgagacaagaaaaggaagtgatacagaggatgttcgtctctttcaaatagcatgttgaaatgtaatccctratgttgaaagtggggcttagagggatgtgtttgagtgatgagggtggattgtgggttgctcacaaaaggcttagtgtcatcctaggagtaattagtgagttctcacactatcagttctcacaagagctgattgttgaaaggacccctgcacctccctccctcgcttccttcctctttccccctgtgatgcctgcttcccttcactcttttgccatgaatggaagcttcctgaggccctcaccagaagcagatgttgatgctgtgcttcttatagagtgtgcagaaccataaaccaaataa

SEQ ID NO: 141646 - DNA, 601 bp, Human
acaaagcctgtgcccctctcttcataagaaagtaccttaccagaggctaatagcttaaaattgcacatagaatagtttcaacaactaaatattttgtgttttttggtaacatgtagttcttctcagggtaatgagaaaataacctggaaaggagcaggaggaagtatgtattcactggtgggaaacggcatgaagatgcatagaagacatggatcacagcctgacactgggcattcagtcagggagaagaccagaaaaggcctcctgcaaaaggtatatctgaggtaggatttggaaaaawaaattgccacatggaagggcagaataaggccattctcgaataagagaagaaaataacgtatttggggatttgtatttataatccatcaggaaatattgaagagtaaagtgttaatgggggattgaaagatgagacaagaaaaggaagtgatacagaggatgttcgtctctttcaaatagcatgttgaaatgtaatccctgatgttgaaagtggggcttagagggatgtgtttgagtgatgagggtggattgtgggttgctcacaaaaggcttagtgtcatcctaggagtaattagtgagt

SEQ ID NO: 141647 - DNA, 601 bp, Human
tacctgtcacaaagcctgtgcccctctcttcataagaaagtaccttaccagaggctaatagcttaaaattgcacatagaatagtttcaacaactaaatattttgtgttttttggtaacatgtagttcttctcagggtaatgagaaaataacctggaaaggagcaggaggaagtatgtattcactggtgggaaacggcatgaagatgcatagaagacatggatcacagcctgacactgggcattcagtcagggagaagaccagaaaaggcctcctgcaaaaggtatatctgaggtaggattyggaaaaaaaaattgccacatggaagggcagaataaggccattctcgaataagagaagaaaataacgtatttggggatttgtatttataatccatcaggaaatattgaagagtaaagtgttaatgggggattgaaagatgagacaagaaaaggaagtgatacagaggatgttcgtctctttcaaatagcatgttgaaatgtaatccctgatgttgaaagtggggcttagagggatgtgtttgagtgatgagggtggattgtgggttgctcacaaaaggcttagtgtcatcctaggagtaat

SEQ ID NO: 141648 - DNA, 601 bp, Human
agtgacccaaggagagaaaattcatataaggccagtggcctgtggcatgcattaaggcaaaaaagatcagaattcccctctagagaagtttgccttaaaaatatcaagataattgcccaaaggggttgggatgacaggggttatgatgtggagtcagagtcactggaatgacgggatgccaaaggtttgagacagcacaaactaagaagcagagaattgaggatgaataagccaggcaataagtaaactcggaataaggatgaagtagctgactcattttaatgctgacacacagagtaayaatcccatggcccagcactacgtcaactccagctcttcccaaagctggggcttgctctaggttctgcccttgcaaagataaacccttactcagaagactgaagggctataattctttgcatgtttttttataactaaatgcctgttacttgaaataagctgtgaattctagtgcatataaccaggagattccagctaaatatgcctaattggcattcaggatggaaattgcttttttaaaaaggtaaaaaatttcatatttttaattgagcaactaattttaagacagaaaatttaacta

SEQ ID NO: 141649 - DNA, 601 bp, Human
tgaatgaactctggctattttattgaaaataatgtccctttaacttactccaaaaaatgaaataagctgaggagtatctgaactcaaatggagaattgtttgtttcaaagggaccataataatacattaatatagtgtaataaaacgatgatagagatttcatacttcttggtaaatcgttaaaatgagactatatttaaattacaaaaataaaacgaaaaccttctcatacacggcatgatgactaaggaggtaggatttctgtctattgggagattagcattagattggaatggtgttrcagaaccaagtcaattatggcttctggcaactcccagccccagtggcattgtcccctgtatgcccttttatggaaaggtagtccttgtgtaagactctggagcttctcacccaatacctccatggactaagtcaatcatggtcaagtgacccaaggagagaaaattcatataaggccagtggcctgtggcatgcattaaggcaaaaaagatcagaattcccctctagagaagtttgccttaaaaatatcaagataattgcccaaaggggttgggatgacaggggttatgatgtggagtca

SEQ ID NO: 141650 - DNA, 601 bp, Human
acctatttccagaggaattttttatgcatttggaatactttagtctgtgaatcaataaataaaaaccatctattctcatgttctatgcagtttttcatcagtgatgagtgtcttatgagaaaaattgcctccctaaggatggttgaagtaaaattcagagttttgcttgacaaaaaaacagtaataacacttcagagatttaaccatagattcaaaggtgtaatggaatgtaattatttatgaagaaaatgggaaaactataattacgattataaaatgctacttgtctaaggtataaatmtgaaagacttaactatatttcattccactaagagttctgttttgctgctattgctagtggtcctagacgtatatcactagtatataagttcaagcagataagttcaactttgtctttcttgtgcattgctgtatttctggtgcccagaacagtactggaaaacacagtatgtacccagtaattatgtattgaatgaataaataaataacttgtgctacgttgtttagattccagagtttcaaaaaaacatgtattgtatcgtgtattatcctacagaagttaatattacttctcttaata

SEQ ID NO: 141651 - DNA, 601 bp, Human
ctacataagtgcttctgcctttcaacagttaaattttcctctttttcatggtttaccgatggctctgagttacagttaacaagaaaaagaaagaaagaggaagaaagaaagaaagaagaaagaagaaagaaagaaaaagaaaggaaggaaggaaggaagaaagaaaaagagaaaattctgctattctgggacaggtgtaagcaaatgcttggcatgttcgtgcccccaaggagacttcatgcatggagtcctgggaatcacacctgtctcaggttctcagtgactctttggttctccatartcttagggtttgggctaagtctaaatagagagttgaagatgattcttatctctgtaatgaagttacctagaaaagcacacctcacaaagaagcaataagaaaatgtcataatattcttaaatagtgttttctccttgatgaaattgggacatttaatgttttaaaagatccaaattgctggcagcttccttgtatctagcttgataattaaaggccttctaatttgttgttgttgctgacgttctggaaaacagaacgcacattttggaaatatgttgattaggagaatatagaacttct

SEQ ID NO: 141652 - DNA, 601 bp, Human
ttctgattctctgactctcggtgagtcagaaattatgttatcttattgcaatcactaagcaagtggtttctttgttcatgatttaggattttaagagggtctataacatagtctatggtgcttagaaaatctggagataaaaagctctaagctggtgatgactagatccaccttccactactcaccttctaactcctagtcaacatttgaaacttggcttaagaatcctctctccttagaagcctgttctgcctcccatcagtcctgagctgcctcctatctccaaccccagtcaaggtcmcctcttccatactttcatgacatcctcaaatttcttttctcaatattgaaattatttattgctttttatctctactatatcatttttttgttgaaaacagggactttttaattctttgtatcccgaaaattaagcatgtttatggcatatagtaggtgcacaataaatattcaatcaattaacaaatgagtgaatggaaagcagtctttagttggggcctacataagtgcttctgcctttcaacagttaaattttcctctttttcatggtttaccgatggctctgagttacagttaacaa

SEQ ID NO: 141653 - DNA, 601 bp, Human
tgctgcattggtgaagagaattgtacatattgtttcctgcaggcatggagaatgggactcagcattgttgaagagaattgtacatattgtttcctgcaggcatggagaatgggactcagcagatttggctcaaggaaataaaaaggcaatcacttagataaagcattggcctgtggatagctccttctgattctctgactctcggtgagtcagaaattatgttatcttattgcaatcactaagcaagtggtttctttgttcatgatttaggattttaagagggtctataacatagtctatsgtgcttagaaaatctggagataaaaagctctaagctggtgatgactagatccaccttccactactcaccttctaactcctagtcaacatttgaaacttggcttaagaatcctctctccttagaagcctgttctgcctcccatcagtcctgagctgcctcctatctccaaccccagtcaaggtcccctcttccatactttcatgacatcctcaaatttcttttctcaatattgaaattatttattgctttttatctctactatatcatttttttgttgaaaacagggactttttaattctt

SEQ ID NO: 141654 - DNA, 601 bp, Human
acatgttgagtaattacacatattctggaatcacacttaacagttggcacagcatatttaagttataatattcagtcaatcatttaattgagaattcttatcaagcataaaatgctttgtgcagggactttgttaggcatgaagaatttgaggtcaccaaagcacgtgcccttccctcatggagcatacaatccagagggggaaacagacaatgaggaagaaatgccacaaataacctgctgtcacattctgaaaagacctagaagtcaaggtattaagacagagtatgctagttccccarccttgactagcagaactcaaggagggctgtgtgaagagcgggacttctattaaaatagtagtgactgccctcgatgcaggaaattcacttgtgaagaaatcctagttaatcagacactgccttagtcatgggagatgtgttataaatgttcatgacatgcaatcagtaagaacaaaaaggctaaagacctgaacatgtacaataaagaatacaaatatattcaaatacacaatttaaaaaaagagtaatactaacatgctgtgttcttacccctattgttccaaaactttctggctttct

SEQ ID NO: 141655 - DNA, 601 bp, Human
tctctcttctgtctctctctgtctctctctctctctctctatacacacacacacacacacacacacacacacacatatatatatttagatgcctaaattcttggcatctaatatgatagggagtagatgcaacatgttgagtaattacacatattctggaatcacacttaacagttggcacagcatatttaagttataatattcagtcaatcatttaattgagaattcttatcaagcataaaatgctttgtgcagggactttgttaggcatgaagaatttgaggtcaccaaagcacgtgcmcttccctcatggagcatacaatccagagggggaaacagacaatgaggaagaaatgccacaaataacctgctgtcacattctgaaaagacctagaagtcaaggtattaagacagagtatgctagttccccagccttgactagcagaactcaaggagggctgtgtgaagagcgggacttctattaaaatagtagtgactgccctcgatgcaggaaattcacttgtgaagaaatcctagttaatcagacactgccttagtcatgggagatgtgttataaatgttcatgacatgcaatcagtaa

SEQ ID NO: 141656 - DNA, 601 bp, Human
gagcatggctctgggcagtccccgccccctcacctttctctctctctcttctgtctctctctgtctctctctctctctctctatacacacacacacacacacacacacacacacacatatatatatttagatgcctaaattcttggcatctaatatgatagggagtagatgcaacatgttgagtaattacacatattctggaatcacacttaacagttggcacagcatatttaagttataatattcagtcaatcatttaattgagaattcttatcaagcataaaatgctttgtgcagggactttgttaggcatgaagaatttgaggtcaccaaagcacgtgcccttccctcatggagcatacaatccagagggggaaacagacaatgaggaagaaatgccacaaataacctgctgtcacattctgaaaagacctagaagtcaaggtattaagacagagtatgctagttccccagccttgactagcagaactcaaggagggctgtgtgaagagcgggacttctattaaaatagtagtgactgccctcgatgcaggaaattcacttgtgaagaaatcctagttaatcagacactgccttagtc

SEQ ID NO: 141657 - DNA, 601 bp, Human
ccaagtgactaatgaatatgagtgttaatttccaaaacattactatgagaactttcaaaattagaacacaaagtgaggaaggcgtgaagaatgatttgtcttatgtcaatggtatggctgcaccaaaagcttcacgtggtgtatcttctgctggaattgcttgaaaccctgatttccaaaatgatgaaagggaaataccatcttccagtttaccaggagcatggctctgggcagtccccgccccctcacctttctctctctctcttctgtctctctctgtctctctctctctctctctatacacacacacacacacacacacacacacacacatatatatatttagatgcctaaattcttggcatctaatatgatagggagtagatgcaacatgttgagtaattacacatattctggaatcacacttaacagttggcacagcatatttaagttataatattcagtcaatcatttaattgagaattcttatcaagcataaaatgctttgtgcagggactttgttaggcatgaagaatttgaggtcaccaaagcacgtgcccttccctcatggagcatacaatccagagggggaaacagacaa

SEQ ID NO: 141658 - DNA, 601 bp, Human
caatttctctttggaattagagttgttactgagatgagaggaaaatcaatgccactgccagtaggagaaagctccatttggtgctgatgacaatgcctggtgggcaatgaagttagagtggtaaggatctcttagggcatcgcagtcacaaaccatgtaaaataaaattgaaaacaaattaatatttttttatttttaattaatctctaatattacttgctaatcctaatatgataacatttaaaaatacttccaaagcaattttactgagaagatccaagtgactaatgaatatgagtgytaatttccaaaacattactatgagaactttcaaaattagaacacaaagtgaggaaggcgtgaagaatgatttgtcttatgtcaatggtatggctgcaccaaaagcttcacgtggtgtatcttctgctggaattgcttgaaaccctgatttccaaaatgatgaaagggaaataccatcttccagtttaccaggagcatggctctgggcagtccccgccccctcacctttctctctctctcttctgtctctctctgtctctctctctctctctctatacacacacacacacacacacacaca

SEQ ID NO: 141659 - DNA, 601 bp, Human
atagaaatgtctagttaaagttgtaaactggaaatgcttgttaaaatggagactcctgacaattcttgtatgctaaaatatttgagaacaaatgctgtaatgataagaagggtatttgctgataaaatgaggttaaacaaaacatttgacaggaagcaatgtcaaaaacacaagttaagagtatgtttcttatttggataggctgcctttttcgtgggatttttataatagcccagagaggaagcatctctcaataatgggtttgctttctatcacaaatgttgtgctcaataatacagcwtttctgcttcatttatgctttctcccataaagcagtcaagtgaaagattaatttacctggaactcccaatcaaccattaaatgaagtccagagttacaaagaaatacgaattaatgagttttcagagctagttgtatcagtattactgggaagccataaatagcacgataagatcatcaataatgggctcctagagagtggccaatgtagcaaccctgaagagtactggtttcccaggcatttcctgggaacgtgaatggaatgagcagcagggtgacatttactcaaaggctgggtgac

SEQ ID NO: 141660 - DNA, 601 bp, Human
ttgctgtgttcttctcctttcacgaaaactaaaaaggcaagagggcattccgggatgtgatccctttacaaaaaaattgcagtttggcttctttgcagatggatctacatattgttctctataaacagtctttctgcacccttatagcatacatctgcttactgcttttcatgaacacattttctaagcatatcaaaataattcacgtgaaatgcctgaatgttgtattgtcaaaccaaatattcaggaactcactcttgaaataccaagaatatcaagcaattaatttctatatatcccygctggggaaataaagtttcatcaaaaggccctgccaacaaatcttgcagcagtaatttaggaatccggagacactcacggatgaaaactgtcatatctgtaagatttgtcattaggcctactaagcgtcctaaagattagggagcgatacattttgacaaatcgccactataaatgaagtctgagaggcatgtactatgagcattttttctttagtgatgatagctgttgctaatctattcacagtttctaatttcatttgtagtgacttaactgggcatatttctggggcagctagtca

SEQ ID NO: 141661 - DNA, 601 bp, Human
gccaggcagattgaagagaagggcatcctggatatggaaatacgattctttcttttttctttttttttttttttgagatagaatctcactctgtcaccagtctggagtgcaatgatctcggcacactgcaacctctgtctcccagattcaagccattcccctgcctcagcctcctgagtagctaggattacaggtgcatggcaccacgcctggctaacttttgtatttttaatagagacgggggtttcaccatgttggtcaggctgatctcgaactcctgaccttgagatctgcctgcctygatctcccaaagtgctgagattacaggtgtgagccacagtgcctggccagaaatacgattcttttaccatgtgctaggagtttttcatttctctgtgacccctagatgggctttgcctcctatctgagtcctgggatatttctggtgataatcctggcactgtatatttgggtttggttttccatggcagggagtaaagccagcttgtctcaaggctccattttggaattagaactctcttaacttgtagggctaatttaaggtatatttattaaatgactacatgtgtatggcagtgga

SEQ ID NO: 141662 - DNA, 601 bp, Human
gtttagtgatcaccattatgcccttccagttcctactttctaggagaaagtgtggtgtgatattaagaatatggtcccaggggttacacctgggtttgaagctgactgtgcctagtcagggagtttaactctgacaccctacctcttccctgattttttattttgcagggtgaagataaactccatgggtaattctgaagattaaatgagctaagagatttatggcatctgttgctaactaatgttagttcttgtcctctttgcatttttttcctttttgattgataatgtgacttaatarccttttaaaaatctgattctcaaagcttgtgcatagtaggacacatattatgattacctctgagaaagtaaaataatatacttacatttaactgtgtccctttgcatgattttgatggtaattcatgcttgtggagcatttccttcagctaaatcgttagatgccttcagctttggcagtagagaggtttagaggtaggaaacttgcatgtaagtgatagagtaagagaatacttctggtaaatttggatagatgtgacccagactctgtaggcagtcatctttggaggagcccaaaagt

SEQ ID NO: 141663 - DNA, 601 bp, Human
ttttgccaaccaattatattccacaattatgtggtaataccacaaaactattttttagtttcacaaaattttatcaggcaatgaacttcaacattctagctagaaaaaaagaatggatgaggttaactgtcttctgaacctaaaactcaaaatgaatgcagtgcgctcaccaaataattaatgctaaattatgcggctgatagagctctcatctgtttaatctctgtttccctgattagcatgacagaataggctgtttagtgatcaccattatgcccttccagttcctactttctaggasaaagtgtggtgtgatattaagaatatggtcccaggggttacacctgggtttgaagctgactgtgcctagtcagggagtttaactctgacaccctacctcttccctgattttttattttgcagggtgaagataaactccatgggtaattctgaagattaaatgagctaagagatttatggcatctgttgctaactaatgttagttcttgtcctctttgcatttttttcctttttgattgataatgtgacttaatagccttttaaaaatctgattctcaaagcttgtgcatagtaggacaca

SEQ ID NO: 141664 - DNA, 601 bp, Human
tgaaaaggaaaaggacattcctttctggttatactgttatattactattctaaaaaataatttatttttttaatcgataatgtttttattcttatttcttcaaagtgggagttttactagtcaatggacaatggctaaagagtgctgcacatgaatcaaaagaatgagtgaacaagagtgtataatctatatgacatttgaaacacagaataagttaacaatgacagaactgttgttctcatacaggacacaggatgaaggaaaattagttaattacagttaatatgcactcaacattgayggaatgatgctaagagaaagagataggacatatcaaataaaaatttaaaagttttcataaatattaacatggcaagattaagaagttagttatgttatgtaccaggtaatcagaagcctcattagtcactgaactctccaatcatatatatatatatataatatcaatcatatatacagtaagaggagattcctgtttaaatagatggctggatttaacggaataaataaataaaggattctgttgaaacacagcatttattaactcatttaaaaaattaaatgtgagtcccagctcata

SEQ ID NO: 141665 - DNA, 601 bp, Human
ttcttcggatctaacagcatttcttagactcatccttttcccttgtcttttgggacaactgaattctcactcttaccctgatggcttcctgccccaacctatcttggtggcttcctgccccaacctatctcctaaagcaacatgaatcatttaatattacaatttgaactttatggctgtgaagaaaatctgggcttctagctagttttccacctgcactttaagttttgtaatttctctatcttcttacctaattcactacttcattctcatgttcaaacctgctattttctatgttaartatctcctatagatttttttaaatttgtttgtttgttttggcctgtaagatcttattgaccttaatcattcttccaaaatctctaaacaatcactcaataattttaaactaaattattttaaacatgtgattcaagcatataatatttcacacattttacttatttcctcttacacaatttaaaaactatcaaggagaaagtttataagtgtattagttacaattaaatgcaaaccttaaattcactgctatcaaagtttttcagaacacacaaagtttttgttgtcagtgtgttagtta

SEQ ID NO: 141666 - DNA, 601 bp, Human; identical to SEQ ID NO: 31079

SEQ ID NO: 141667 - DNA, 601 bp, Human
atgggtttgatagctatctaaggttcctttcaactctaaaatttcatgatccatttgtcattttcaattcaagtactttcggatatcgtgatagcaaaagtttaatttgcatttagaaacgaatataaactatgagattgaagagataaaatggacttttaaaattaatgcagcatgggtatgagaaagaaaatagagaatgctgtagaattagggactttttcccttagcacattattataagctacctgacaataccattaattttttttcctttttactctacacaatagcacattcrtatgtctgaaactataaggatcacagccataaggctgaatgtcaactgtcagagggcaaatgcgaatcggctacaacactggaaatctgagcctggaacctgtagggtcacgtgggggttatctcacagcgctcaccttccaccagttggtccaggctggaaatcttcttgagcccatcaatggtgtagattgttctcactccctggggcaaattcacgttatccgacagagttcgggtcaaatcagccagcagggcctcaaaagatcggaaccggtctggggagatggcatacacaatc

SEQ ID NO: 141668 - DNA, 601 bp, Human
ctagtaggctgggcacagtgcctcacgcctgaaatcccagcattttgggaggctgaggtgggtggatggcttgagcccaggagtttgagaccagcctgggaaacatggcaaaaccctgttttttgtttttgcttttgtttttaaagaaagaaaaaagaaaagaaaaagaaactagtaaagtggtcccctctgaggaattttaggaagagcaaattttatatctattcaaaaattaattttaaaaaattcattatagcaaggagaggcatagagaaagccagtgaaatagggaaataaagtwgaggatgctctattagggaataggaaaagatgggtaacccagaggctgtggtaggaaagagattccctaactgtggggtgaagcatgggtttaatcctgagagggggattatgatagaaacttggaaaaagcccttatgcaaactgcagctccagagtcaggcaacgtccatacagggttagtgaaaagccaaggcatacatgagaaccaaagaagaagagggactcatctctaatagcgcagatctgatgaacaaattcacttacttgtatccagaagattacatatctacagagtttt

SEQ ID NO: 141669 - DNA, 601 bp, Human
tatagtatattgttataattgttccattgtatttgttattgttgttaatttcttgccatgcctaatttataaattaaactttatcatataccttgcatcatatacatacctttatcataggtatgtattcacaggaaaaaaagcacagtatacacagggttcagtactatttgcagtttcaggcaaccactgggtgtcatagaacgtatttccttccaggataagggggcattgctgtatatgtgtccttcacatgcactggtatctctgagaggaccctcaagaaactagtaggctgggyacagtgcctcacgcctgaaatcccagcattttgggaggctgaggtgggtggatggcttgagcccaggagtttgagaccagcctgggaaacatggcaaaaccctgttttttgtttttgcttttgtttttaaagaaagaaaaaagaaaagaaaaagaaactagtaaagtggtcccctctgaggaattttaggaagagcaaattttatatctattcaaaaattaattttaaaaaattcattatagcaaggagaggcatagagaaagccagtgaaatagggaaataaagtagaggatgctctat

SEQ ID NO: 141670 - DNA, 601 bp, Human
attaatgatggtaactttgtataaaggagtactatgaagtcagtaaaagaacacagtagttttggatgtaccagtatggaaaggtcttcaggatatattgttaagtacacaaagcaaggtgcagaactgttggcataaaaagttaccttctgggcaaattacagtactgccccactttatccatggtttcagttacctgcagtcaactgaggtccaaaaatattacatgaaaaaatccagaaagagacaattcaggagttttaaactgcatgcagttctgagtagtgtgatgaactctcasgccatcttgcttcttccatctctatcacaagaagggcaagtacagtacaaaaggatgttttgagagagacgccacattcacataacttttattatagtatattgttataattgttccattgtatttgttattgttgttaatttcttgccatgcctaatttataaattaaactttatcatataccttgcatcatatacatacctttatcataggtatgtattcacaggaaaaaaagcacagtatacacagggttcagtactatttgcagtttcaggcaaccactgggtgtcatagaacgta

SEQ ID NO: 141671 - DNA, 601 bp, Human
caaaattcatgggcaaaagcttaaggagaaacaagatatttacacagcatcaaagtttcttcccgaaatattagttacaaaggggaaaattataactttagagtgaatatacctgacagacactgccttcaccaaatgatcacaggtaaccaacaagacatatcaacatcatgtaccccctgaaatgatgtactgaggacaaaacatgacttctgtgcataacatcaatctaatcatcagacaaacccaaactgtgggacattctacaagataactgactggtattcttcaaactgtcaargtcattaaagataagaaaagactgaagaaccgtcatagcttcaaggagaagcagacacaacaactaaatgcaatgtgtgattctggaatgaaaaaaggatatcagtggggaaacgaaggaaagccaaatgaggcctgtagttcaactactgtattgtaccaaagttaacttcttagttttgttcattgcaccatgattgtgtgtgctgttccattacaggaagatgggtgaagggtaaacaggaacttcctatctctgtgatacttgtataagtccaaattaatctgaaaatataatgtt

SEQ ID NO: 141672 - DNA, 601 bp, Human
agaaagatctgatttaggagtaataggccttaaaagagtggttaaaataatgtcagttgatgagatcacagtggatgatccaaagacaggaaaatggaggacagtaatgtttagaaatttggaaagtaaagagggaaaagaaaatcaccattagaacactatagtaataactgctataggcaagatccaccaataaatgccaaaattcatgggcaaaagcttaaggagaaacaagatatttacacagcatcaaagtttcttcccgaaatattagttacaaaggggaaaattataactttaragtgaatatacctgacagacactgccttcaccaaatgatcacaggtaaccaacaagacatatcaacatcatgtaccccctgaaatgatgtactgaggacaaaacatgacttctgtgcataacatcaatctaatcatcagacaaacccaaactgtgggacattctacaagataactgactggtattcttcaaactgtcaaggtcattaaagataagaaaagactgaagaaccgtcatagcttcaaggagaagcagacacaacaactaaatgcaatgtgtgattctggaatgaaaaaaggat

SEQ ID NO: 141673 - DNA, 601 bp, Human
gggggtcccaaacattaggaccctagcaggtggtaacactatttaataagagctggaacatgagagaaagaatgaattctggaaaatggaaaagaatgagtccacaattatacatgttgagctttaaagaactaaggaagagaaacagttctatatatccaggtagttggagtgcagaagaaagatctgatttaggagtaataggccttaaaagagtggttaaaataatgtcagttgatgagatcacagtggatgatccaaagacaggaaaatggaggacagtaatgtttagaaatttggmaagtaaagagggaaaagaaaatcaccattagaacactatagtaataactgctataggcaagatccaccaataaatgccaaaattcatgggcaaaagcttaaggagaaacaagatatttacacagcatcaaagtttcttcccgaaatattagttacaaaggggaaaattataactttagagtgaatatacctgacagacactgccttcaccaaatgatcacaggtaaccaacaagacatatcaacatcatgtaccccctgaaatgatgtactgaggacaaaacatgacttctgtgcataac

SEQ ID NO: 141674 - DNA, 601 bp, Human
gggagagagaagtccagatatcacctagaaagtcatcacagccgaccaggagaggaggtgaactgaatgttacgtatccacactagggacagaggagtggatgttacgaggagtacttagcagatacaaccagccagaattggcaattgactggatgtgggttccgagggaatatgaggcaacaaaaacactgaagtgatgacactgaaaattctctttgggcctacttcccatacaccacaatagatacaattagaaggggaacaggtttggattaggcagtaaagaaggaaattaagtygactttgcacatattaaatttgaagttcctagaagccaatcagttggagatttccagcaagcagaaataggaatggagaagagaaaacaagttggagaaatgtcttagcagaatcaaccgaatttgatgatagcctggatttgagagattaagagagagagacgttaagggtgatgttaagttatgtgatgtcttagtcctttggctgctataacaaaagaccatcaactggaggcttataaacaacacacatttatttctcactgttctggaggctgggaagtccaagatcaagacacc

SEQ ID NO: 141675 - DNA, 601 bp, Human
ggttagaaagcaagatgtgtctatgaaaagattccaccacaaggcagtaagtaataattgctaagtaagtggtctaggccatcctaattcagaggagaaagaagtcacttcccacttcccactgggctatctatgaaagggaaatggaattcacactggccttggaagcaagggtaagattaccattgacaaaaaagagaggggagaacattccagataaaaataaaataataatatgctctgttgcacagtacagaaagggatattctctgatatattaaaacattttctcaaaaaaaaatgaaataaaaatgattccatagacagacgagttagataaaaccacatcaggcaacaaggtcagagttttacacatgatcagccctgggtgataaacaggttgcactggctgcagtgtgaatgaggggctgaagtgaacatggggagagagaagtccagatatcacctagaaagtcatcacagccgaccaggagaggaggtgaactgaatgttacgtatccacactagggacagaggagtggatgttacgaggagtacttagcagatacaaccagccagaattggcaattgactggatgtg

SEQ ID NO: 141676 - DNA, 601 bp, Human
tcattttaaaaagtaacatggaaaactacttggagccacgaaaatgtttatacccataatctcattgctaaaaaattttgcataataacaaaacaacaaataacaaaactgtgacaagcacacacaacattaacaatgaaacctaaaaattaaaaacaacctcctaaatcctgagtcataggtgcaagacctaacttagccactctgggaagggaaagaaacctaagtcaggagactatcttcaaataggttagaaagcaagatgtgtctatgaaaagattccaccacaaggcagtaagtrataattgctaagtaagtggtctaggccatcctaattcagaggagaaagaagtcacttcccacttcccactgggctatctatgaaagggaaatggaattcacactggccttggaagcaagggtaagattaccattgacaaaaaagagaggggagaacattccagataaaaataaaataataatatgctctgttgcacagtacagaaagggatattctctgatatattaaaacattttctcaaaaaaaaatgaaataaaaatgattccatagacagacgagttagataaaaccacatcaggc

SEQ ID NO: 141677 - DNA, 601 bp, Human
taaaatggtaataatcattttaaaaagtaacatggaaaactacttggagccacgaaaatgtttatacccataatctcattgctaaaaaattttgcataataacaaaacaacaaataacaaaactgtgacaagcacacacaacattaacaatgaaacctaaaaattaaaaacaacctcctaaatcctgagtcataggtgcaagacctaacttagccactctgggaagggaaagaaacctaagtcaggagactatcttcaaataggttagaaagcaagatgtgtctatgaaaagattccaccrcaaggcagtaagtaataattgctaagtaagtggtctaggccatcctaattcagaggagaaagaagtcacttcccacttcccactgggctatctatgaaagggaaatggaattcacactggccttggaagcaagggtaagattaccattgacaaaaaagagaggggagaacattccagataaaaataaaataataatatgctctgttgcacagtacagaaagggatattctctgatatattaaaacattttctcaaaaaaaaatgaaataaaaatgattccatagacagacgagttagata

SEQ ID NO: 141678 - DNA, 601 bp, Human
ttgtacctattataattgcaacaaaagaataatcaaaataaagtggtattgaggttgcagcaacaaaataatacaaggtgctaaaatatatgacaaaggataaacacacaataaagtataaatagaaaacaccattacagacattaaaatggtaataatcattttaaaaagtaacatggaaaactacttggagccacgaaaatgtttatacccataatctcattgctaaaaaattttgcataataacaaaacaacaaataacaaaactgtgacaagcacacacaacattaacaatgaaacstaaaaattaaaaacaacctcctaaatcctgagtcataggtgcaagacctaacttagccactctgggaagggaaagaaacctaagtcaggagactatcttcaaataggttagaaagcaagatgtgtctatgaaaagattccaccacaaggcagtaagtaataattgctaagtaagtggtctaggccatcctaattcagaggagaaagaagtcacttcccacttcccactgggctatctatgaaagggaaatggaattcacactggccttggaagcaagggtaagattaccattgacaaaaa

SEQ ID NO: 141679 - DNA, 601 bp, Human
acaaaaatacagggtacaaaaatagatggcaaaggataaaaacaaaacaaagaatatatggaaaacacatggagggtgcttaaatagtaagccaagaaatgcaagttaaagcagatttaagatgtactcttgtacctattataattgcaacaaaagaataatcaaaataaagtggtattgaggttgcagcaacaaaataatacaaggtgctaaaatatatgacaaaggataaacacacaataaagtataaatagaaaacaccattacagacattaaaatggtaataatcattttaaaaagyaacatggaaaactacttggagccacgaaaatgtttatacccataatctcattgctaaaaaattttgcataataacaaaacaacaaataacaaaactgtgacaagcacacacaacattaacaatgaaacctaaaaattaaaaacaacctcctaaatcctgagtcataggtgcaagacctaacttagccactctgggaagggaaagaaacctaagtcaggagactatcttcaaataggttagaaagcaagatgtgtctatgaaaagattccaccacaaggcagtaagtaataattgctaagt

SEQ ID NO: 141680 - DNA, 601 bp, Human
aaacaaaataacaagataaagtaagcttacaattactgtagtatacttcctcttacatacactaagccaccccacaccccgaagtcttttggtataacttctactgcaacaatgaaataaaagtgaatttatcttaaacaaacaaacaaacaaataaaaaaacacaaggtatttttgagcaaaacagcccaaaatttgctttggaagctttgcattacttcctataggtgaacttgaacaaggatggcatgattgcaaagctcttagcggtggtactagaaattgcaaacatcatgatttactggttggttatcatacaaccagtttttcttgtttgtttgtttgttttttcagtttgttcaagccctaaggattctatgataagtctgattcttcacttgaaatgtaatactctgggtgtctaagacactccaacaaatagcaagatgctgaagcagcatctggctgaattttgttgtggcatttaatgaaggccaaaaactaatctttgtttttaagtagagagagagataaagaaaatgacagtttttttaaaagtaaggaaataagcatgaaattatgtttggatccaactaatact

SEQ ID NO: 141681 - DNA, 601 bp, Human
tcccagctacttggggggctgaggtgggagaatcacttgagcctgggtggatgaggctgcagtgagccatgattgtgctactgcactccagcctgggcaacaaagcgagatcccatctctctttatttaaaaaacaaacgaaaaaacaaacaaaataacaagataaagtaagcttacaattactgtagtatacttcctcttacatacactaagccaccccacaccccgaagtcttttggtataacttctactgcaacaatgaaataaaagtgaatttatcttaaacaaacaaacaaacaaataaaaaaacacaaggtatttttgagcaaaacagcccaaaatttgctttggaagctttgcattacttcctataggtgaacttgaacaaggatggcatgattgcaaagctcttagcggtggtactagaaattgcaaacatcatgattttctggttggttatcatacaaccagtttttcttgtttgtttgtttgttttttcagtttgttcaagccctaaggattctatgataagtctgattcttcacttgaaatgtaatactctgggtgtctaagacactccaacaaatagcaagatgctgaa

SEQ ID NO: 141682 - DNA, 601 bp, Human
tggctcacatatgtagtcccagctacttggggggctgaggtgggagaatcacttgagcctgggtggatgaggctgcagtgagccatgattgtgctactgcactccagcctgggcaacaaagcgagatcccatctctctttatttaaaaaacaaacgaaaaaacaaacaaaataacaagataaagtaagcttacaattactgtagtatacttcctcttacatacactaagccaccccacaccccgaagtcttttggtataacttctactgcaacaatgaaataaaagtgaatttatcttaaacaaacaaacaaacaaataaaaaaacacaaggtatttttgagcaaaacagcccaaaatttgctttggaagctttgcattacttcctataggtgaacttgaacaaggatggcatgattgcaaagctcttagcggtggtactagaaattgcaaacatcatgattttctggttggttatcatacaaccagtttttcttgtttgtttgtttgttttttcagtttgttcaagccctaaggattctatgataagtctgattcttcacttgaaatgtaatactctgggtgtctaagacactccaacaa

SEQ ID NO: 141683 - DNA, 601 bp, Human
aagtttaaccaaccccatttctattcacctggcagatcatgacttgtctcagctatgccttcctcaggatttaagtaaatatcaaaaacttatatgtatttttgatattttcttaaatcctgagaaaggcatatttgggtactatagaaacagcagtgttttgggagttttcatggagtgatgacctgcacatgatagtgggaagagagaactggaaattcgggctcaagacctggcctctccaagcatgtgactttggacaagtccctcagatttctgggtggtagtttatttatctatraaacaaaacctcattaggtttttctgaagatcaaattagaagatagagatcaaagtgatctcaaatacaaacctgctatgtgagtgaaaatgacctgaggctacataccctaatcgtgcagtaagcctgaaagaaaaattcaaaaacaaaattactagaaatcggtaagcaggtcttatattgaacagttaccagtggacaccacgttgggtccatgtcaatgtgagaatgccctaacactccccagtgagacacacagcatgtaactgagctggcaaagctagcctctgtcagaattct

SEQ ID NO: 141684 - DNA, 601 bp, Human
tgtacatataatcaatttttttttttttttttttttgagacggaatcttgttctgtcacccaggctggagtgcagtggtgcgatctcggctcactgcaagctccgcctcccgggttcacgccattctcctgcctcagccccctgagtagctgggactacaggcgcccaccaccacacccaggtaattttttttttttattttgagtagagacggggtttcaccctgttagccaggatggtctcgatctcctgacctcgtgatccgcctgcctcggcctcccaaagtgctgggattacaggygtgagccaccgtgcccggccctaatcaatgttttttaattcaactcaccatcaaggttctgtcaaacctgtacaaaaatagtccacccaagacaataaaaggtgatgcttcctttgggttcatctgaccaactcacattaaaatgaccacccatccaagtcaactgatgttcattctgtagctgaaaaacctccctttcattttaacactgaaaaatacaagatgcgtactattctagaaatatgcctttaaagctatccagatggaaatatgtcatttcttagatacatattttaaaat

SEQ ID NO: 141685 - DNA, 601 bp, Human
agcattttgatagcaccacattaaaaactaaacttccagcaaagatagtgtgctcaaaagtataatctggtaaactctgaatgactagcaaatcatgctgtacatataatcaatttttttttttttttttttttgagacggaatcttgttctgtcacccaggctggagtgcagtggtgcgatctcggctcactgcaagctccgcctcccgggttcacgccattctcctgcctcagccccctgagtagctgggactacaggcgcccaccaccacacccaggtaattttttttttttattttkagtagagacggggtttcaccctgttagccaggatggtctcgatctcctgacctcgtgatccgcctgcctcggcctcccaaagtgctgggattacaggcgtgagccaccgtgcccggccctaatcaatgttttttaattcaactcaccatcaaggttctgtcaaacctgtacaaaaatagtccacccaagacaataaaaggtgatgcttcctttgggttcatctgaccaactcacattaaaatgaccacccatccaagtcaactgatgttcattctgtagctgaaaaacctccctttcatt

SEQ ID NO: 141686 - DNA, 601 bp, Human
aagggttataagccaagcaaaagatggtaaatacaaatgaacaactggcacatattccttctttcctaatgaattttataatttagagcatctgaatggatccctaagggaagtattctttcatgactaatactctttctaggattagcatctatttctaattcagaaagtttgaatgcgctagcctttaagaacttggaggagtcttctatttaataagatcaatcttttaattcatggatcattttaattttaatatttactatacatacaaatcattcaaattatccctcaaaaaaawttttttaaaaaagcattttgatagcaccacattaaaaactaaacttccagcaaagatagtgtgctcaaaagtataatctggtaaactctgaatgactagcaaatcatgctgtacatataatcaatttttttttttttttttttttgagacggaatcttgttctgtcacccaggctggagtgcagtggtgcgatctcggctcactgcaagctccgcctcccgggttcacgccattctcctgcctcagccccctgagtagctgggactacaggcgcccaccaccacacccaggtaatttttt

SEQ ID NO: 141687 - DNA, 601 bp, Human
ggaactcccaaaattctgaagtgcagcagggagagggaacatttatccatatgtattctttgctctaatgagacactttataaaaatatttatttgaataggtaaatatttatgaaaatagatgaactcccatcttgagaaaattcaatatatgaaaattcagaactacaagatgtttgaataactcattagaaatggagccagtgaagggcttacaaaatgtgtaaaggtgaagtttgccatcttattgctactataattcacaagccagcatgaactttctggtcattgatagatttaygacatttaggctacagactcttaaatatagaagactaagtctcattcattagagaatctcatccattagaatccttatccgcatattacttagggcaagggttataagccaagcaaaagatggtaaatacaaatgaacaactggcacatattccttctttcctaatgaattttataatttagagcatctgaatggatccctaagggaagtattctttcatgactaatactctttctaggattagcatctatttctaattcagaaagtttgaatgcgctagcctttaagaacttggaggag

SEQ ID NO: 141688 - DNA, 601 bp, Human
attaagcatgctaatacatgcaaagcactttgaacaatgctcaataaagctatcatcattatagttcaaaattgctattgcatgtatcatcatagttgacccacagcactctataaaacacaggtaatcattttatctgtgtttcactgatgaggataatgaagctcagttaagtgttttgctaaaaacataaggaatctacggctgagccaagacttgaatcctggttttttgacattaaacctcggattccgtcccatgactttggattatttacatgtaaaccacagtaaactagccrttatcaaatattaattctagacaaattcagtaaggaagaaaacaactgagaacatcatacctattgtagggatttattcctgaaataaacaaaattaaataatcagctgatggcaaattttagctaaagtcattaaagccgatttttagattcagagtagcattttggaactcccaaaattctgaagtgcagcagggagagggaacatttatccatatgtattctttgctctaatgagacactttataaaaatatttatttgaataggtaaatatttatgaaaatagatgaactcccatc

SEQ ID NO: 141689 - DNA, 601 bp, Human
ctcctggggtccatgaggaagcatctttgttctcactgggaacccaacgaataagtctttatgttctttccactttatcatccaattcctctgcagcttttcactgatcctgctatgaagagaacatgccaacactaggggaaatgccacagcagcaaactgaacgcttgacaaaacaacagttgagtacaacagtcagcagaatgactgcagggaaaaaaaggacagagcagaaatgtttcagatgatattctttggacaaattactcccttgacaattctttctcaatacatttacatsagtttggtgccttaacataatctaaagtggtacagtggttaccagcacaagctctggagcaagaccagtttaaatcgtagctgtgtggtcttgtgcatgtttttaacgagttctgtgccttagtgttctaatctgttaaatggggataataagcaagttgttatgaggattaagcatgctaatacatgcaaagcactttgaacaatgctcaataaagctatcatcattatagttcaaaattgctattgcatgtatcatcatagttgacccacagcactctataaaacacaggtaatcatt

SEQ ID NO: 141690 - DNA, 601 bp, Human
agggtggcatcttgttggcagcatatggaccccgatgccaccacaggcaggccaagatggtagcagtgcaggtgccaccccactatggccaagcgttattccacaggacagcgtggaggaaactgatttattctcagaggcttatcaagcctcagtctctgccagggttgtcaaaaattctactctaacaaactgcttatgggacagatttctcttttgagccaaaaagattctaaagactcctggggtccatgaggaagcatctttgttctcactgggaacccaacgaataagtctttaygttctttccactttatcatccaattcctctgcagcttttcactgatcctgctatgaagagaacatgccaacactaggggaaatgccacagcagcaaactgaacgcttgacaaaacaacagttgagtacaacagtcagcagaatgactgcagggaaaaaaaggacagagcagaaatgtttcagatgatattctttggacaaattactcccttgacaattctttctcaatacatttacatcagtttggtgccttaacataatctaaagtggtacagtggttaccagcacaagctctggagca

SEQ ID NO: 141691 - DNA, 601 bp, Human
ccgagaggcaactgagcaaggagtggtggtagaaacaagtgagaacagcatgtggtctgtgccctccggtgtccgtctcctctgggtaagatattaaacagcaggctccggctttcatggttccattgtccaaaatcccagcgtcaacagttttcatgccatggatacatctgtaggctgccccaaggcaatctacaaaaccatcttcctctctacgcatttactcaaagcactcaagcaattcattttttaaacaattctatttcctcaacccaaaaacatgaaattctttactgggcaytggaattcccatattgtttatggagttgatgtgagggttcagttaaactattttttaaaaaggtgggacaagtaatcttagggtggcatcttgttggcagcatatggaccccgatgccaccacaggcaggccaagatggtagcagtgcaggtgccaccccactatggccaagcgttattccacaggacagcgtggaggaaactgatttattctcagaggcttatcaagcctcagtctctgccagggttgtcaaaaattctactctaacaaactgcttatgggacagatttctcttttgag

SEQ ID NO: 141692 - DNA, 601 bp, Human
agggtatctttgtagcaaatctggtaacttttagtcttattttaagcacttaaaaaatagttatactccaaatggcctctgggagtaactgcttggcaggttaagtgaataacccacagcaaagttccaacatccagagcttggacttgggcaagaggaagagactctcagactctaagatcctgcagatcctccccttggacatgggttcaggggacatgattttaactgttagctagaaaatgtccctttttcttctttggaggtctttaaccaaggcccagatttaaaaaaaaaaaaatgcatcactgaaattaaggcatggtaagtgcttccttgaactgccagccatgccagcaaaaggactgatgacctggtgagcagtcaccctgaaagttgcaaggaagaggaggaaggtcggggcaaccatttgctgaagcttcagtgcccctgaataaagaatggagttgaaatcattagaaagggtttgctcacacataggctgcttatgaaccacaacggtcatcttggccaattgcagcttcctgcaaaatcttttctagattgtgcagcatttccaaaacgtttatttccttatctc

SEQ ID NO: 141693 - DNA, 601 bp, Human
gttctactaataaaaaaggaaaaataccactgctgctaatagctacagaaaacctcctttcccattccaaataaatcctatcagattctaaatttcttacattttgtctggaaacctctagtttccacattttctatgcttatcaactcctatagccaaggtcagatgcaataataatttgtaccacttttttaacttgtaagaggaagacatatcttaagcactctaaacccaagagtcgaccaaattatttttacttcagattagaattagatattaaaggccaaaaagaagaaaataragaccattttgtgatatctgattaatagattcctattaatcatcattaccatttcctgtaatcaagtaaactcctatattaaacacctaaaataaatggcggcaattattgactcatttacaagcatcttttgagctttataacaggcaatgaggattcatgatcaaaagatacagagaagatgtaatgatggattaatttatcaacagctactgggatgtcctcaaaatggcagttatgatgctttctcatggcttaccatcgaaatcagtttatggctacccatacttcagctgagta

SEQ ID NO: 141694 - DNA, 601 bp, Human
atgaggatggtttaacatgtgctctgagcttttgtagagaattttaatttgacattttaaagtgtaagctaaattacttgtatcaactgtttttttactccaatcgcaaacaaaactaaaaagtattacattcccttttgctacataggtagtgtagcaaatcaatagtacacattctttataccaagaatgaagggttttaatatgcttgcagaagttaattagaactgtcacagaaaagttctactaataaaaaaggaaaaataccactgctgctaatagctacagaaaacctcctttyccattccaaataaatcctatcagattctaaatttcttacattttgtctggaaacctctagtttccacattttctatgcttatcaactcctatagccaaggtcagatgcaataataatttgtaccacttttttaacttgtaagaggaagacatatcttaagcactctaaacccaagagtcgaccaaattatttttacttcagattagaattagatattaaaggccaaaaagaagaaaataaagaccattttgtgatatctgattaatagattcctattaatcatcattaccatttcctgta

SEQ ID NO: 141695 - DNA, 601 bp, Human
gattcttaaacttctttttctttgaaatcatctatttccatcaattcatagctctaataaatcatgaggatggtttaacatgtgctctgagcttttgtagagaattttaatttgacattttaaagtgtaagctaaattacttgtatcaactgtttttttactccaatcgcaaacaaaactaaaaagtattacattcccttttgctacataggtagtgtagcaaatcaatagtacacattctttataccaagaatgaagggttttaatatgcttgcagaagttaattagaactgtcacagaraagttctactaataaaaaaggaaaaataccactgctgctaatagctacagaaaacctcctttcccattccaaataaatcctatcagattctaaatttcttacattttgtctggaaacctctagtttccacattttctatgcttatcaactcctatagccaaggtcagatgcaataataatttgtaccacttttttaacttgtaagaggaagacatatcttaagcactctaaacccaagagtcgaccaaattatttttacttcagattagaattagatattaaaggccaaaaagaagaaaa

SEQ ID NO: 141696 - DNA, 601 bp, Human
gggtcagggctccagctgtcatagaagcaagagaactcaccaccagaaggcaatcacaaagccagtagacttgtaaacgtcccccaaatgctctcagcacactatggaagggctttagaaaacctatcttcagtacagcagtggaacactaagagaacttagaattcattttacagcgagctagaatgcaatttacagaaaactaacttttgctaaaatgaatctaagccttaaaatatacatcactgcaggtacccataattgatcacatcctcagaggagctcaaagtgaaaaaaaaaaggacttaaatcttcccaatttggaggcactaacatctacataaggacaggtatagctcatgagtcctaaatattgaccaaggatatgtgacctaaaatagtacattctattctgaacactttaattctgtaagtgaagtgtcattacgattcttaaacttctttttctttgaaatcatctatttccatcaattcatagctctaataaatcatgaggatggtttaacatgtgctctgagcttttgtagagaattttaatttgacattttaaagtgtaagctaaattacttgtatcaactgt

SEQ ID NO: 141697 - DNA, 601 bp, Human
tgtctctgcaataattaggccagatgcttttcatgtgcatctcctattggcccaccaccaatttttatatccatgggacatattgatcagttcttctctttattcactggatggctaaggcaatgtcaggaaggtttacagcaattctcctgactcagacggcgagatgtttctaacagaatatctattgttcccccacaaaatgaaagtgctttcaatagcgaaaatgatctaaaattggcagatgcgttctttttattttctatactagagtctttcatgaagaagccctagctagaamcaaccatcatggtgcggtgtgcatggtaatgtagtgtgtggccacgctgcagagggcaccatcatcatttacagctacacatgaccacagcccagggtgaccaaggcagctcctatatggccatgacccgtaaggaccttgctgaatactggagccatatgctaatgccgagtggatagaccacagcaaactggtcaatcatccagctacttagtcattcagtcatttaccaggtcaagctctggagactcaaaggccaatagaacacctttcttagcctcatcctataaaatcgaaagg

SEQ ID NO: 141698 - DNA, 601 bp, Human
gatcacttgaggtcaggagttcgagaccagcctggccaacatggtgaaaccttgtctgtactaaaaatacaaaaattagctgggtgtggtggcacgcgcctgtaatcccagctacttgggaggctgagacaggagaaatcacttgagcctgggaggtggagaggttgtactgagctgagactgcaccactgcattccaacctgggagacagaacaagacacctgtcttaaaaaaaaaaaaaaaaaaagacaaaggaaaaaagaccgaaatatgagcaagggccatcttctcaatgcgactrtgggtaattttaacttatcttaatattttcccatttccttcaaaattctttacattgattatatattaatcttacaaaggacaagaccaattaaaaaataaatctcccatctgtccttttgtttctaaggcatgttgtttacaatatagttcctatttaaaattggatttttaaagttccatttaatttctgaaacagacttctttcatttaatttagtttcaaggatttaaaaactaatcaggaaaatctggtgcaacatattatagtctgccaccacagacacccttgaatactgcag

SEQ ID NO: 141699 - DNA, 601 bp, Human
tgggaggctgaagctggcagatcacttgaggtcaggagttcgagaccagcctggccaacatggtgaaaccttgtctgtactaaaaatacaaaaattagctgggtgtggtggcacgcgcctgtaatcccagctacttgggaggctgagacaggagaaatcacttgagcctgggaggtggagaggttgtactgagctgagactgcaccactgcattccaacctgggagacagaacaagacacctgtcttaaaaaaaaaaaaaaaaaaagacaaaggaaaaaagaccgaaatatgagcaagggycatcttctcaatgcgactgtgggtaattttaacttatcttaatattttcccatttccttcaaaattctttacattgattatatattaatcttacaaaggacaagaccaattaaaaaataaatctcccatctgtccttttgtttctaaggcatgttgtttacaatatagttcctatttaaaattggatttttaaagttccatttaatttctgaaacagacttctttcatttaatttagtttcaaggatttaaaaactaatcaggaaaatctggtgcaacatattatagtctgccaccacag

SEQ ID NO: 141700 - DNA, 601 bp, Human
ggcgcagtggctcacgcctgtaatcccagcgctttgggaggctgaagctggcagatcacttgaggtcaggagttcgagaccagcctggccaacatggtgaaaccttgtctgtactaaaaatacaaaaattagctgggtgtggtggcacgcgcctgtaatcccagctacttgggaggctgagacaggagaaatcacttgagcctgggaggtggagaggttgtactgagctgagactgcaccactgcattccaacctgggagacagaacaagacacctgtcttaaaaaaaaaaaaaaaaaaaracaaaggaaaaaagaccgaaatatgagcaagggccatcttctcaatgcgactgtgggtaattttaacttatcttaatattttcccatttccttcaaaattctttacattgattatatattaatcttacaaaggacaagaccaattaaaaaataaatctcccatctgtccttttgtttctaaggcatgttgtttacaatatagttcctatttaaaattggatttttaaagttccatttaatttctgaaacagacttctttcatttaatttagtttcaaggatttaaaaactaatcaggaaa

SEQ ID NO: 141701 - DNA, 601 bp, Human
ggaaacaaaatacaataagcctgcgctattcctttcacaggagaccaattccagaaatggcctgagaaatatgtcagtaattttactcttcccaggggcactgtatcaaccaacgacagaaacgaaccttttactggttctttgtatacagaccccacttatttctagggcttattattttttccctaatttagagctataacctcagaaatggaattgaccttcccattcaaaaaaggccctgttaatggggtcgctgggcattgtatggctttttgcaaagccctgtctgccctaagtsatgggcagcccctgccagctgccagctgaattaaataggcgacaccccctcagtctcttaacctcccaggctgtgttataagaaaatcactctaattctgatcactaggtggttccttcacaccagtttatcccatccattgttgttttccatagtcaagtctgcagtacgtaagactgttggccactaaatccttgggcatgtctagaaaattattatagctggaaattattttcaaaagttacccctccattcctgcacaccttaaaaacagcccacatctttccgggcatcgtccat

SEQ ID NO: 141702 - DNA, 601 bp, Human
tccaaagtcaagttctcgtgcattttgataatcttgtaaagttttgaaagtaacttccctctcacgttaactgatggtagaaaatgaatgggaactttacacacctgattcccaatacatcttaatgggaaagtgcaggctcataaaactgagggctaggacatttagtatttattttaagggcttctaaaatatgccacaagcttagagtacagggactaattttaatggaaatctgtttattagcatgctggtacacaaaagtaggcttttaatattatttggattttttttttttttwgagagagtttcgctcttgttgcccaggctggagtgcaatggcgcgatcaaagctcactgcaacctccgcctcctgggttcaagcgattctcctgcctcagcctcctgagtagctggtattacaggtgcgtgccaccacacctggctcatttttgtatttttagtagagacggggtttcaccacgttggccaggctggtctcaaactcctgacctcaggcaatcagcctgcctcggcctcccaaagtgctgggattacaggcatgagccaccgcgcccagcattatttggattcttaatgt

SEQ ID NO: 141703 - DNA, 601 bp, Human
ctccaaagtcaagttctcgtgcattttgataatcttgtaaagttttgaaagtaacttccctctcacgttaactgatggtagaaaatgaatgggaactttacacacctgattcccaatacatcttaatgggaaagtgcaggctcataaaactgagggctaggacatttagtatttattttaagggcttctaaaatatgccacaagcttagagtacagggactaattttaatggaaatctgtttattagcatgctggtacacaaaagtaggcttttaatattatttggatttttttttttttktgagagagtttcgctcttgttgcccaggctggagtgcaatggcgcgatcaaagctcactgcaacctccgcctcctgggttcaagcgattctcctgcctcagcctcctgagtagctggtattacaggtgcgtgccaccacacctggctcatttttgtatttttagtagagacggggtttcaccacgttggccaggctggtctcaaactcctgacctcaggcaatcagcctgcctcggcctcccaaagtgctgggattacaggcatgagccaccgcgcccagcattatttggattcttaatg

SEQ ID NO: 141704 - DNA, 601 bp, Human
tctccaaagtcaagttctcgtgcattttgataatcttgtaaagttttgaaagtaacttccctctcacgttaactgatggtagaaaatgaatgggaactttacacacctgattcccaatacatcttaatgggaaagtgcaggctcataaaactgagggctaggacatttagtatttattttaagggcttctaaaatatgccacaagcttagagtacagggactaattttaatggaaatctgtttattagcatgctggtacacaaaagtaggcttttaatattatttggatttttttttttttttgagagagtttcgctcttgttgcccaggctggagtgcaatggcgcgatcaaagctcactgcaacctccgcctcctgggttcaagcgattctcctgcctcagcctcctgagtagctggtattacaggtgcgtgccaccacacctggctcatttttgtatttttagtagagacggggtttcaccacgttggccaggctggtctcaaactcctgacctcaggcaatcagcctgcctcggcctcccaaagtgctgggattacaggcatgagccaccgcgcccagcattatttggattcttaat

SEQ ID NO: 141705 - DNA, 601 bp, Human
aatgtcagatatgacactgtggttaagaatgtcagtctgccttgaccaggtactaatcacttgggccagttactttccccctgattctgcatctgtgaaatggagataacaatagtatctactcccataatactgttaatggggtaaaaaatcgaaattttagttagtgcctggcatacggtaaacattcaagaaacactagctgctattctacatttattgatattatccctgggctggattcaacatacaagatgattttattcttttctacaaagcctcacccccagggacagatccrgtcctttaccttcctggaatgccaattactcagcaatcttcacgtaaactggagaaaatgtttccagctgttgtaacagaaaatgtcttccaacttttgattcattacacaaggtgttatcactcattttctggcacagagctggtgcactatcccagaactgatctgacacactttcttcagctgatgtcaaaccaaattataaggcaaataggacaaacgaaaagtcacatgaacagaatccatttacagtggggtcattcacactggtccttccaggtgagagaagcactgagagag

SEQ ID NO: 141706 - DNA, 601 bp, Human
ataaaacctcaataaaacccagagctagtcaaaccgagctggagaggatggaggctacagttacaggttaaaggcgatgaacttagtgaatccataattacacaaatgacttagaaggtagaaaggagacttttctataaaagcagatagaaaaatgaggtcaacatttaaaagctgatgtgactaataagcagatcagtggctgctgggctaggggtgggagcccagattgactgcaaatgcagatgaaggaactttcttggtcaaagtgtctaacactggaatgtggtgatggttgcacgattctatgcatttattaaaatcattaaataatatacttaaaatgggtgctttttgtagtacgaaaattatagcttaataaagctgtaatcattttttattttaaagttgacatgtttttaaattttgcgatattcacactctataaaatagttgtactgtatatctctgtgatgtgttagttacattaaaaatgttctttttccactattgggaatataaatttttataataatctaaagtaagattcttaagtttttaaaattgctctaaatggattattttcataatcattaacaat

SEQ ID NO: 141707 - DNA, 601 bp, Human
attaaatgctacctcatctgagaagcataactttcttgaggatatggccatagcagtcataagattctcaaaggggaatgcaagccccaaaatttaagagccattgttgtagataaaataagaaaaactaaattaaagatagaggattttgtcttaaattcctggaattaaaagaatttttccatttcattgatattattttctgttgtcagctttagctaaaggaaattacaataaaccatataataaacaaactaaatcactattttatttaatttcaatttaataataagacctatawaataaagcccccaaaagagagggttaaaaactataaacaagttccattggttttgaaagggttttttgtatgtaattttctttaatgtagctaaccaccaccaaaacccctttggttctttggagagacagattaccaagaaggaggtcagaaagggagaaaaatctgggaagcaatctcagttcctcactaacctcagaactatgcctagatataagcccaaggcctttgaatctcagccagagaccagcttttctttcccatcttgtaagaggcttcacaggggagaccggtccttgt

SEQ ID NO: 141708 - DNA, 601 bp, Human
aaggctcaagtgatggggaaaagttaagatggaaaagaaaaatgaggagcaaaaaggaagcaggagtgaggaagcaggtgtgaggaaggaccacatgtctatgtcttcccttatgcacaagcactagactttttgttccagtaaagaatttccagcaagtgacagaaagcaaacccatgcccagttgaactgaacaatttctctatgaacagaaaatgttttgtcaagaaccagaaatttcttttgataatcagtcatgaatgaacacaggtggcagaatgtatcctctgatatctctctmtctctctctctttgttttttttttttgttttttttgttttgttttgttttgttttgtattttttgagacagaatctcactctgtcgcccaggctagagtgccgtgatgtgatcttggctcactgcaacttccgcttcccaggttcaagtgattctcatgtctcagcctcctgagtagctgggactataggcatgtgttaccacatccagctaatattttgcatttttagtagagacgggtttcactgtggtggtcaggctggtctcgaactcctgagctcaggcaatccgcccgcctcaa

SEQ ID NO: 141709 - DNA, 601 bp, Human
ccttgttcacctcctatatttaaccaatggttatgaatacaaaattaacaacagatagttagaataaaaccaatttaaagcaatttaatggtcaaaaccaggagctatcagctgttggtgttctgttgcgttattaaaccaactcagaaatgcggactcttacttgatccccactaactgccagtcatgggtagttgctatacaccctgtggctgtaaaatcaattcctttttaaggaaaaagtttctaagcaataattatactttacttacagtttttaaagggtattaagacaaatgtygttactgcaccacattcctaaaccccctagtggctccagagctatcagccgggaagcactttacattttgaaaatgtattgctcaggacaaaatgatgaagagccctggagagcatctgctgtgaaagaagaaacaatttcgggccaggaatatgatttcctgtaagtgaaataatcacatgagaagaaaagtgaaattatctcacacttactgaaggctcaagtgatggggaaaagttaagatggaaaagaaaaatgaggagcaaaaaggaagcaggagtgaggaagcaggtgtgagga

SEQ ID NO: 141710 - DNA, 601 bp, Human
aacaataacaatacttcaaaactattaacagactgcagcttgaaatccttacttctatgccaagcatcagactgttcttgaaatccttacttctacatcaaaccttcattatgtaactggtcctataattggaggaaggactgctcacatagctaactttgaaaattggcagtgtaccatatttgcaacagattggcaaattatttaagaagtcggtaggaataagaaagtgggtatatttttcattttgattgacataagtcatcatgtgggtaaaaccatcacttcattcagtactacyaggtcttggatctgtgaaaggatatttgctacagtgaatctcccagccaagggctcccatggtggctacaaatcacctacttaagtttccatatagtagaccatgacttccatgtttttaaatgaaaacagcaccgtgtgattaaagtaccatatattatatacataaattcttttaatgaacaaacatttaccaagcacctggtcaaagcaaagtaccatgctagagacccctgaggacctcgatattcccaaagtcattgctagcacattatcattcaatcacctgactacaatccat

SEQ ID NO: 141711 - DNA, 601 bp, Human
gttaacatcactgataattaggccttcccgaataagagacaaaaacaataacaatacttcaaaactattaacagactgcagcttgaaatccttacttctatgccaagcatcagactgttcttgaaatccttacttctacatcaaaccttcattatgtaactggtcctataattggaggaaggactgctcacatagctaactttgaaaattggcagtgtaccatatttgcaacagattggcaaattatttaagaagtcggtaggaataagaaagtgggtatatttttcattttgattgacakaagtcatcatgtgggtaaaaccatcacttcattcagtactactaggtcttggatctgtgaaaggatatttgctacagtgaatctcccagccaagggctcccatggtggctacaaatcacctacttaagtttccatatagtagaccatgacttccatgtttttaaatgaaaacagcaccgtgtgattaaagtaccatatattatatacataaattcttttaatgaacaaacatttaccaagcacctggtcaaagcaaagtaccatgctagagacccctgaggacctcgatattcccaaagt

SEQ ID NO: 141712 - DNA, 601 bp, Human
tgctgggattacaggcgtgagccaccgcgcccggccgcgagaggcgttttctttccttttccttttcttcacgtcttcctgttccttcccatatccaatcagttactaaattctatgaattctaccgtctaaatatcctttgcatgttaggcaagagcccaggctgcacaaaataggtataatctgaattttagaagcttgaaaataagacaagtcaaaaaaaaagaaaaaaatggctttggagaggaaagtattgttaacatcactgataattaggccttcccgaataagagacaaaaayaataacaatacttcaaaactattaacagactgcagcttgaaatccttacttctatgccaagcatcagactgttcttgaaatccttacttctacatcaaaccttcattatgtaactggtcctataattggaggaaggactgctcacatagctaactttgaaaattggcagtgtaccatatttgcaacagattggcaaattatttaagaagtcggtaggaataagaaagtgggtatatttttcattttgattgacataagtcatcatgtgggtaaaaccatcacttcattcagtactactag

SEQ ID NO: 141713 - DNA, 601 bp, Human
tgacctcgtgatccgcccgcctcggcctcccaaagtgctgggattacaggcgtgagccaccgcgcccggccgcgagaggcgttttctttccttttccttttcttcacgtcttcctgttccttcccatatccaatcagttactaaattctatgaattctaccgtctaaatatcctttgcatgttaggcaagagcccaggctgcacaaaataggtataatctgaattttagaagcttgaaaataagacaagtcaaaaaaaaagaaaaaaatggctttggagaggaaagtattgttaacatcaytgataattaggccttcccgaataagagacaaaaacaataacaatacttcaaaactattaacagactgcagcttgaaatccttacttctatgccaagcatcagactgttcttgaaatccttacttctacatcaaaccttcattatgtaactggtcctataattggaggaaggactgctcacatagctaactttgaaaattggcagtgtaccatatttgcaacagattggcaaattatttaagaagtcggtaggaataagaaagtgggtatatttttcattttgattgacataagtcatcat

SEQ ID NO: 141714 - DNA, 601 bp, Human
gacagggtttcaccgttttagctgggatggtctcgatctcctgacctcgtgatccgcccgcctcggcctcccaaagtgctgggattacaggcgtgagccaccgcgcccggccgcgagaggcgttttctttccttttccttttcttcacgtcttcctgttccttcccatatccaatcagttactaaattctatgaattctaccgtctaaatatcctttgcatgttaggcaagagcccaggctgcacaaaataggtataatctgaattttagaagcttgaaaataagacaagtcaaaaaaaaagaaaaaaatggctttggagaggaaagtattgttaacatcactgataattaggccttcccgaataagagacaaaaacaataacaatacttcaaaactattaacagactgcagcttgaaatccttacttctatgccaagcatcagactgttcttgaaatccttacttctacatcaaaccttcattatgtaactggtcctataattggaggaaggactgctcacatagctaactttgaaaattggcagtgtaccatatttgcaacagattggcaaattatttaagaagtcggtaggaataaga

SEQ ID NO: 141715 - DNA, 601 bp, Human
gcccgccaccacgcccggctaattttttgtatttttagtagagacagggtttcaccgttttagctgggatggtctcgatctcctgacctcgtgatccgcccgcctcggcctcccaaagtgctgggattacaggcgtgagccaccgcgcccggccgcgagaggcgttttctttccttttccttttcttcacgtcttcctgttccttcccatatccaatcagttactaaattctatgaattctaccgtctaaatatcctttgcatgttaggcaagagcccaggctgcacaaaataggtataawctgaattttagaagcttgaaaataagacaagtcaaaaaaaaagaaaaaaatggctttggagaggaaagtattgttaacatcactgataattaggccttcccgaataagagacaaaaacaataacaatacttcaaaactattaacagactgcagcttgaaatccttacttctatgccaagcatcagactgttcttgaaatccttacttctacatcaaaccttcattatgtaactggtcctataattggaggaaggactgctcacatagctaactttgaaaattggcagtgtaccatatttg

SEQ ID NO: 141716 - DNA, 601 bp, Human
tgcaagggtccaggcccaccgtgagagcttgaacgcatgcgtggagaagggtaactggattcccaaaacatttctgggcagatcggaggagccactgaatgactcactggatacgggggcgaatgctctcgtgaggtcagtgaaagctcagagaaacagcaggggagcacaatgaggatctcatgatcatgagcttggtcttgtgtcccagcccccaccctaccccactccaccccatgcaacagccagtccctctcctgcactgttgtcacatggctcagtacaatctccttgggcacakagcccatggcattataaaccactggttaaaatgctggctgcataaacatcttcttttgagaagtgtctgttcatgtccttcacccgctttttgatggggttgttcttttcctgtaaatttgtttaagttccttgtagattctggatattagacctttgtcagatgggtagattgtaaaaattttctcccattctgttggttgcgggttcactctgatgctagtttcttttgctgtgcagaagctctttagtttcattagatcccatttgtcaattctggcttttgttgcaattgcttttg

SEQ ID NO: 141717 - DNA, 601 bp, Human
ctctggcaaaagcatcttcttttttctttgcaccaagaaatatacaacaggcagttctggtcatttactttctccaacttccttttatgtttctgagtcactgaatcttgcctcacaccaataacatctagctctaatttgatttttttcctccaatatttcaaatacaaaacaagacaaaatcttgtttcctttggtacaagagtggctccaacaatagctaatgcgaagtgttgatggcactttgatctccatttggcagcatgagggaaccaaagctttttactctcctggtgactartcattatttcacatcaattggagaggattaacaaatcttagtaatccagatgtgcgtttgcaattcctatggtccccaagtgtgccacatgcattgtgggaataagcattaggttaataacctagcactatttaaaaaatttaatgcactttgccttcataaactacgacatgccctccaatacattataaagcaagccttactttagagtggggtgacataacagttgtaggcttatcgatgtggaaaggaaagttatttgacatttattgttctggcaaagtataaagacaaaaagaa

SEQ ID NO: 141718 - DNA, 601 bp, Human
gagaaacaggccagatggcctagagacctgctggcctgctaggcctgaacagaagcacaggctttcctcaatctatgtgctttgtgcagttaatataactctatttttggaaacataaccttggttccaagttcagcccatgtttctttcctgtgcagcactcaactattccactctctcatgacacttctctgcaggaccaccctcgaacaggaactccgggttgtccattgcaaagtgttcccatttatttaaagtttcccatcactctcttctttccacctccattctctggcaaaakcatcttcttttttctttgcaccaagaaatatacaacaggcagttctggtcatttactttctccaacttccttttatgtttctgagtcactgaatcttgcctcacaccaataacatctagctctaatttgatttttttcctccaatatttcaaatacaaaacaagacaaaatcttgtttcctttggtacaagagtggctccaacaatagctaatgcgaagtgttgatggcactttgatctccatttggcagcatgagggaaccaaagctttttactctcctggtgactaatcattatttca

SEQ ID NO: 141719 - DNA, 601 bp, Human
tctatcattgatgggaatttgggttggttccaagtctttgctattgcgaatagtgctgcaataaacatacgtgtgcatgcatctttatagtagaatgatttataatcctttgggtatacacccagtaatgggattgctgagtcaaatggtatttctggttctagacccttgaggaatcgccacactgtcttccacaatggttgaagtaatttacactcccattaacagtgtaaaagctatttctccacatcctctccagcatctgttgtttcctgactttttaatgatcgatcgccattcyaactggcatgggatggtatctcattgtggttttgatctgcatttctctaatgaccagtgatgatgagctttttttcatgtttgctggctgcatgaatgtcttcttttgagaagtgcccggacagctgtttaaacactctacatgatagagactgtttacatgtctacacaggtggactgcaaagtacacaacaaaacagggcatttatcttcaagcacaggtattgctaaaaggaaaaataaacccttgcaaaggagtctgtgatcttttcgcttatgttgtaattaacaaagagttagg

SEQ ID NO: 141720 - DNA, 601 bp, Human
aagcatagcgagctccctgggagggaaggctggagaggatttgaaaagggcaaaaagagagacacatgggcagaccaagagaccccctgactcctgaagctctcccttcacctatccttggattcccctttcttggcattctggcaactttgaataaacagtcaggaacccccagacaaatatttcattgcatattgcttattttcaattagttacccaataataaaatagattacttctgtgaagaaatctttaaagaaaagtctctccacaaaccaaatcttgtggcactcaccacagsgttagacacttttaataaaaattattattaatctgcatgagatataaaaggctcatccttccttggctacatttagaccctctctctcattttcttccttcccccatccaactcagcagccagggtcactgtttacccatctgacatcactgtttgccagctattagcattatttaattagctccttcgacaaaccaagtcaatgtcaggagctgtttctgtgacttaaaacacaacctacaccagccctctggagtctgctctgtaccaccaggggtcccctgggctccagaacacctc

SEQ ID NO: 141721 - DNA, 601 bp, Human
ttttttttccagacctttgtctaaatgtatataatccaaaggttgggtttttttagaattatgaaaaaagctatactgcacatattctgcaaattgctttagtagagataaaaattactaacctgaatacagtttggaagccagctctgtgccactgtccccaaagacaaaaatgaccatcaataactagctttaaagcttcaaccatgaggttcccatgactgctcatgtttgcagtaattttccctaattttttctatcagaaatcaagcttctaaattaccacacactattctttgtractgaggaaatagctaccaacaccctgaatgttatcaagcaaaattatagttggggtagaccgagagaataccagtctgccattaagcatagcgagctccctgggagggaaggctggagaggatttgaaaagggcaaaaagagagacacatgggcagaccaagagaccccctgactcctgaagctctcccttcacctatccttggattcccctttcttggcattctggcaactttgaataaacagtcaggaacccccagacaaatatttcattgcatattgcttattttcaattagttac

SEQ ID NO: 141722 - DNA, 601 bp, Human
caattcaaataatataaagcaaatggaccctttgtagattccaatcccactttctttctcagaggtaacatctcctatcagtttattgtgttttttttccagacctttgtctaaatgtatataatccaaaggttgggtttttttagaattatgaaaaaagctatactgcacatattctgcaaattgctttagtagagataaaaattactaacctgaatacagtttggaagccagctctgtgccactgtccccaaagacaaaaatgaccatcaataactagctttaaagcttcaaccatgakgttcccatgactgctcatgtttgcagtaattttccctaattttttctatcagaaatcaagcttctaaattaccacacactattctttgtgactgaggaaatagctaccaacaccctgaatgttatcaagcaaaattatagttggggtagaccgagagaataccagtctgccattaagcatagcgagctccctgggagggaaggctggagaggatttgaaaagggcaaaaagagagacacatgggcagaccaagagaccccctgactcctgaagctctcccttcacctatccttggattcc

SEQ ID NO: 141723 - DNA, 601 bp, Human
attttttctccccagagaagtttgaaacaaatgcctatatgctctgaaagttgtctctggattcttttaactttaatgtttatatttaaaatacatttatgctgtaaacaattcaaataatataaagcaaatggaccctttgtagattccaatcccactttctttctcagaggtaacatctcctatcagtttattgtgttttttttccagacctttgtctaaatgtatataatccaaaggttgggtttttttagaattatgaaaaaagctatactgcacatattctgcaaattgctttagyagagataaaaattactaacctgaatacagtttggaagccagctctgtgccactgtccccaaagacaaaaatgaccatcaataactagctttaaagcttcaaccatgaggttcccatgactgctcatgtttgcagtaattttccctaattttttctatcagaaatcaagcttctaaattaccacacactattctttgtgactgaggaaatagctaccaacaccctgaatgttatcaagcaaaattatagttggggtagaccgagagaataccagtctgccattaagcatagcgagctccct

SEQ ID NO: 141724 - DNA, 601 bp, Human
actttgaaaacaaaagtactccataaatatgtatacattgtctctcaaggaaaacaaatttctcattaccaccatgtggccaaagatagattactaataacagatgttttaagtatccactttagaaaatttaggtactataaatatgcccaaggaaactcaaagttagtatattattaaaataattatttttatctccaaattatgtaaatcaaatacactaattttttctccccagagaagtttgaaacaaatgcctatatgctctgaaagttgtctctggattcttttaactttaatstttatatttaaaatacatttatgctgtaaacaattcaaataatataaagcaaatggaccctttgtagattccaatcccactttctttctcagaggtaacatctcctatcagtttattgtgttttttttccagacctttgtctaaatgtatataatccaaaggttgggtttttttagaattatgaaaaaagctatactgcacatattctgcaaattgctttagtagagataaaaattactaacctgaatacagtttggaagccagctctgtgccactgtccccaaagacaaaaatgaccat

SEQ ID NO: 141725 - DNA, 601 bp, Human
tataagaaagcaccatattaaagtagaaaaagaccaggttatcttgacagatcaagatggtggcctgtagcaaactctggcctttgcctctgatcacagcctttatgttctagtgacctcataggaagttctctaaaatacactaaaaatgtctagtttgtttttaactgtattacgtgttcacgtctctgaaacttctctttcatctcgattactctgttaggtccctcctcagttcaactccagttcccactttggtagatcagcctgtcgaacaaatgggatggcattcactacacartgataattaaaatttaaatggctataagaaaacaagtcctctactgtttattggtgcccatacaatcatcaaaacataggtactgtaaatcttacaaatgtgactcaaaaagattgaaagtggaatagattctaagaaacaagcaattgtattattcacattccagctgatccatatcgccaaataacaaataaatcatccaaggaattcctccaggaacaatctttttccttgagttttcccattcattttttaaaaatttcaacaaatatttatggaagacccactttgtgacatcca

SEQ ID NO: 141726 - DNA, 601 bp, Human
ggctataagaaagcaccatattaaagtagaaaaagaccaggttatcttgacagatcaagatggtggcctgtagcaaactctggcctttgcctctgatcacagcctttatgttctagtgacctcataggaagttctctaaaatacactaaaaatgtctagtttgtttttaactgtattacgtgttcacgtctctgaaacttctctttcatctcgattactctgttaggtccctcctcagttcaactccagttcccactttggtagatcagcctgtcgaacaaatgggatggcattcactacmcaatgataattaaaatttaaatggctataagaaaacaagtcctctactgtttattggtgcccatacaatcatcaaaacataggtactgtaaatcttacaaatgtgactcaaaaagattgaaagtggaatagattctaagaaacaagcaattgtattattcacattccagctgatccatatcgccaaataacaaataaatcatccaaggaattcctccaggaacaatctttttccttgagttttcccattcattttttaaaaatttcaacaaatatttatggaagacccactttgtgacat

SEQ ID NO: 141727 - DNA, 601 bp, Human
attaagttttggaagtgtctaaagttatacatatatttttaactgtgtgggaggttgattcctctaatcccatgttgttcaagggtgaactgtacttgatatgtcatttgtcatttaaattctcaacaaagagttggatggatgagtcatttcccccagactgacggcatcatgaaggcctgaaggtgtcaccaactcctctcctccaacatcagctgaaaagatacagtcctcacttagaccaccctcagagagcacagtttgtaaaacttatgaaaatggaagttgtagaaagcactaraagttgctaaaatactttcatatgaaaaagactcaaatccacccactggattagacaaaaacctgagctgaatgagccccagctatctacctagaactttatcttcattcctcatttgtcttccttgctcccggtggagagaaggggatatacaaagagatggctgcagttagaaaaaggcaatagttgcctcagaaacccagctcctggtgagtcaaagttatggttacagggaatgggctctgtccacaaaagttgcttctttaaatatcttctgtgcataagaatctgaaatctcat

SEQ ID NO: 141728 - DNA, 601 bp, Human
ttcaatatgtagcctgcctttgattttgagttttacttaacctaggacaatgatctacaatataatgtttccagtcagatttccacagttatttttgcaacacacacggcttctgctttcactctctgtgatgaggaatccctttctgttattgggaagaaagagtttagactttacatcagtggttctcaaccaggggttgaggggtaattttgcctcccagaggacatttggcaatgcctaagaaacattttaattgtcacaactgggggaagggagtagggcattctgtcatctagtrggtggtgctagatgctgctaaacattctgccttgcacaggacaggccccaacagtacagacttatctgtcctaaaatgtcaatagtgcaggttcagaaactccgctttcaataattacagacttcggtgtttggtagaagttttgcattattcatatcacaaaataagcatttcaatgcatataaaaattcagcataacattaattaaatggttaaaatgaaagcaacttttaaaagaaaaaaattagaattaaataattattaacataatgaagctaagaattcaatttgactcaagta

SEQ ID NO: 141729 - DNA, 601 bp, Human
acacatgttcacattaggtgggatcaatgatgactataaaagcttcatattatttgggtcaggttttgccaacaaaggagttatggaaaaaaaaatgtctgtttctacagcttttggagattgggaatagcactgagctggtatttgaggtaactgagagttaatgaagaaggaaggtgagaaaggagagcaaggcctagcttgtgcggataaccagtgttcgggtggagggcataagaaaggaaagccgaaaggtgagacaaagaggcagcaagaaaaccaagagaacacgatatcatgsaggatcaaaggagagagaaaagcaagctggaaatacctgtgaaatcaaaacatcaaaatataggaattagggactcaataaagcttctggtccatgtcgggttatcttacataggtcaaggatattacacatattcaagggaaatattcgtcaaggtcaacagcattttgaatctgatctgtcagtttccttcagtgggctgaaattgaattactaccttgctccaggtagtgctccatattgtacttcagtctacttccaccttggtcccgaaatattctatgtaaaaataatttattg

SEQ ID NO: 141730 - DNA, 601 bp, Human
aaaaatggtgcagcacatacatcacacattacttatccttaccaatgacatctgggcagtggcctttgatcagcatattaacaattctgcagtgacatacacacatgttcacattaggtgggatcaatgatgactataaaagcttcatattatttgggtcaggttttgccaacaaaggagttatggaaaaaaaaatgtctgtttctacagcttttggagattgggaatagcactgagctggtatttgaggtaactgagagttaatgaagaaggaaggtgagaaaggagagcaaggcctagyttgtgcggataaccagtgttcgggtggagggcataagaaaggaaagccgaaaggtgagacaaagaggcagcaagaaaaccaagagaacacgatatcatgcaggatcaaaggagagagaaaagcaagctggaaatacctgtgaaatcaaaacatcaaaatataggaattagggactcaataaagcttctggtccatgtcgggttatcttacataggtcaaggatattacacatattcaagggaaatattcgtcaaggtcaacagcattttgaatctgatctgtcagtttccttcagtgggc

SEQ ID NO: 141731 - DNA, 601 bp, Human
gccgggcatggtggcgggcacatgtaatcccagctacttgggaggctgaggcaggagaattgcttaaacccgggagacggagggtgcagtgagccaagttcgcgccattgcactccagcctgggggacaaaagcgagactccatcttaaaaagaaaaagataacctcaagttctgaagactagagtacttagtaccaacagcattatcaggaatattctgtttcttagagcaaggaaaacgaattgctacaatttaaaaaaaaattgtttcaagcattgaaagaatgctccatcaatagckgaagatatccaaaaggcaagcaatgaagggatcattaagagctattgacttgtgatgctgcacatagaagtagtagctgtaccttacccaatgcttggggagccaaatatgttagattctgaatttttcagactttagaaaaatggtgcagcacatacatcacacattacttatccttaccaatgacatctgggcagtggcctttgatcagcatattaacaattctgcagtgacatacacacatgttcacattaggtgggatcaatgatgactataaaagcttcatattatttgggtcag

SEQ ID NO: 141732 - DNA, 601 bp, Human
aaagatgaaaagaaacttgtgcatgaggatatagaagccttgagaatttaatgagctgggcaagtagagaaaaggaacattaagaaaacctctgctggacacggtagctcatgcctataatcccaaaactttgggaggctgaggcgggaggatcgcctcaggtcaggagtttgagaccagcctggccaacatggtgaaaccctgtctctatttaaaatacaaaaaaattagccgggcatggtggcgggcacatgtaatcccagctacttgggaggctgaggcaggagaattgcttaaaccygggagacggagggtgcagtgagccaagttcgcgccattgcactccagcctgggggacaaaagcgagactccatcttaaaaagaaaaagataacctcaagttctgaagactagagtacttagtaccaacagcattatcaggaatattctgtttcttagagcaaggaaaacgaattgctacaatttaaaaaaaaattgtttcaagcattgaaagaatgctccatcaatagcggaagatatccaaaaggcaagcaatgaagggatcattaagagctattgacttgtgatgctgcacatagaag

SEQ ID NO: 141733 - DNA, 601 bp, Human
caacacacagactaaaatgtggctctagataatgctcatggagtcaaagtctggggtgtgctactgaagcccctccaagcccttgatgatctgttatctgtagcagttgggtagagttcttcaactgagtagaaatctcccacaattctttcatttcagctaccagaaagccataatattgtaatgcattattatttaaagtggtttacaaattgtagatactgaaacattttcagggtgtccagagggatgagctatctccaaatgaagatgaagtatctgagcactggagcaagtggawggtgaaacaccaccagttgcagtctaagtgcagatgaaaagacaaagtcagattagctcttggtagacagactttcaaatggtcttattttatgtgaatttgaaatagtgacataaaacattaaaaggttgtcactttacacttccaattttacgtaatgtgaatcatttcctacaaaaaaaataggtctgatttttgtgaattttgcatttttactaggctttggaaggcaactccccctctaaaatgtgactcgctgcaccgagggaaggttgtatggagaagagaaaaccgaggggg

SEQ ID NO: 141734 - DNA, 601 bp, Human
accaagaagagggtcctgaataagaactgaatctgccagcaccttgatcttgaacttcccagccttgagaactatgagaaacatatgtttgctgtttaagccacccagtctatactattctagaacagcacctcaaacagactaagacaataagcataccacttacatcttcttccaacacacagactaaaatgtggctctagataatgctcatggagtcaaagtctggggtgtgctactgaagcccctccaagcccttgatgatctgttatctgtagcagttgggtagagttcttcaacygagtagaaatctcccacaattctttcatttcagctaccagaaagccataatattgtaatgcattattatttaaagtggtttacaaattgtagatactgaaacattttcagggtgtccagagggatgagctatctccaaatgaagatgaagtatctgagcactggagcaagtggatggtgaaacaccaccagttgcagtctaagtgcagatgaaaagacaaagtcagattagctcttggtagacagactttcaaatggtcttattttatgtgaatttgaaatagtgacataaaacattaaa

SEQ ID NO: 141735 - DNA, 601 bp, Human
tacgccatgtgaggacagagcaaaccaagaagagggtcctgaataagaactgaatctgccagcaccttgatcttgaacttcccagccttgagaactatgagaaacatatgtttgctgtttaagccacccagtctatactattctagaacagcacctcaaacagactaagacaataagcataccacttacatcttcttccaacacacagactaaaatgtggctctagataatgctcatggagtcaaagtctggggtgtgctactgaagcccctccaagcccttgatgatctgttatctgtascagttgggtagagttcttcaactgagtagaaatctcccacaattctttcatttcagctaccagaaagccataatattgtaatgcattattatttaaagtggtttacaaattgtagatactgaaacattttcagggtgtccagagggatgagctatctccaaatgaagatgaagtatctgagcactggagcaagtggatggtgaaacaccaccagttgcagtctaagtgcagatgaaaagacaaagtcagattagctcttggtagacagactttcaaatggtcttattttatgtgaatttg

SEQ ID NO: 141736 - DNA, 601 bp, Human
aaatgggtcacagaggcagtttggcaatttttgttaagagggtattaaataccaagtactctgctagagctggagacaggaaagatgaatagacagtccttgttctcaggcagccagaagtctattagcactaaagacttgcaagcagaaaatatatatataaagaaaatttctataataaagcacaaagaagatgtgatggtaggaacatgaaaggagagccagatgcagtcaacacagcaaacagattgatgacttgggggaatgcagtaagaacaccacctcccaagggccatacacstttctacacatgtccctgttctgtggttgctttaacaaatcataacacatggctagcttattctgtatcaaaacctgcattattttccatgaattcagaatataaactattgccctggccaatgctgatgtcggggacatacatggagaatgtgcaatgtcatgaacattaatatgactttgtgagctctgatccttaactttggtgtgtcataatcattggattttctcactaaccagtaatttagtaagatagtcctctggactgaatatctgtgtctttccaaaatttgtatgttaa

SEQ ID NO: 141737 - DNA, 601 bp, Human
acctggtttgccagcatccccctggaaatgggtcacagaggcagtttggcaatttttgttaagagggtattaaataccaagtactctgctagagctggagacaggaaagatgaatagacagtccttgttctcaggcagccagaagtctattagcactaaagacttgcaagcagaaaatatatatataaagaaaatttctataataaagcacaaagaagatgtgatggtaggaacatgaaaggagagccagatgcagtcaacacagcaaacagattgatgacttgggggaatgcagtaagamcaccacctcccaagggccatacacctttctacacatgtccctgttctgtggttgctttaacaaatcataacacatggctagcttattctgtatcaaaacctgcattattttccatgaattcagaatataaactattgccctggccaatgctgatgtcggggacatacatggagaatgtgcaatgtcatgaacattaatatgactttgtgagctctgatccttaactttggtgtgtcataatcattggattttctcactaaccagtaatttagtaagatagtcctctggactgaatatctg

SEQ ID NO: 141738 - DNA, 601 bp, Human
aatgatttgtggactccttacgatctgcacagtgccgttcctgatgccagggaagaagagaagttccgattgcacccgccacctagtactgatgtgggtaatatctacccatgggccctggctctgccctctgaagcaatgtagactgagtcacctctgtcttctacataacgctttcccaaatgtttgaagatggacattctgtccaaaaaagaataatgggccaaaacttagattatagtttcttctttcacatattttaaagaaatatcaaatgtatcatgtaacctttctgaccttrccttccttgtctatataatagatatgataatgcccccagtggaaagctggagaggaggagggagaggagaaagagaggaggaggagaaaatataggtagaagaatagagaaagctgtgccacttactgagcacttactatcaatacctccccaagcactaatgcttctcaactacccagtggggtaatcactctgttctgtcccaattttacaaatggatacaccaagacttgcccaaggtgacactgctataaagtcttaaccactattttatctcctttctgtatcccatgctctgta

SEQ ID NO: 141739 - DNA, 601 bp, Human
gtatgaggagaaataccaaatgaggtaaggttacccattcagcatgttaataatgtaaaagatgccctatttctcctgtctccttgactaggtggtccttgcaccaggaatttatgggcactttcacaattatcatggattttatttttaaatatcatcttcattttcccagtcttcctgacagaataaaaactgttcctgaaaactgctgaccactcagttctcaaaaataacttgagaattaatgcaactagtcatttgctgaattcctgaaaaagctctgattgagcttgagttctcyttccatctctgctattgtatgtccttctgatcactcctgagaactctctctctacatattttaacagcagaagaacttttcaaaacttgttttccctggcagaatatagtaagaccctagtccttgtttcagtagtgaaattctattaattcaatgatttgtggactccttacgatctgcacagtgccgttcctgatgccagggaagaagagaagttccgattgcacccgccacctagtactgatgtgggtaatatctacccatgggccctggctctgccctctgaagcaatgtagactg

SEQ ID NO: 141740 - DNA, 601 bp, Human
cagatcacctgaggtcaggagtttgagaccatcctggccaacatggtgaaaccccatctctgctaaaaacacacacacaaaaaaattagccgaacacagtggcacatgcctgtagtcccagctactcgggaggctgaggctggagaatcacttgaacctgggaggccgaggatgcagtgagctgagactgcaccactgcactccagcctgggcaacggaagcaggctccgtctcaaaaaaaatgctaattttgtcttcttgatccttccttcaatatatcttgcatttcttattctcatcrtgctttaaaaaaatctgcaagattatttttcttaagagtcaaaagaatgaatagaaatcactgcacaaaaagtgtttcactgtgagaaaattatgttaaaaaatgtatgaggagaaataccaaatgaggtaaggttacccattcagcatgttaataatgtaaaagatgccctatttctcctgtctccttgactaggtggtccttgcaccaggaatttatgggcactttcacaattatcatggattttatttttaaatatcatcttcattttcccagtcttcctgacagaataaaaactgt

SEQ ID NO: 141741 - DNA, 601 bp, Human
attccatcaccacctgctgtaacacaaatcagccctccagacagccaaggaggatggctctgtctggctcacacctgaactatggaaatggagcttgcacatgtccttaacacttatttgaaaaatgaggaccttgctacctatgatctcaaagatttgcacatcattgacctcctcgtgcagcatacatccacaaaacagacatgtggaccatgaccacagacagatccgcacctgaattactatgcctaaaagcttataaagtcatgttcaaaaatcggtataactcaagttagggatrtatttctataagaactataatatctgttgtatgccaatacagaaaatgtgggttacagttctttgttttttgttttaattggataaccatttagttatggtacatttacatgtactataatctctagttcttcaaaccagtatattagaaaatgtacatcagacacagtctggtatcagtgtcatgctaccacactgatttgcaaggatgaacaattcttagcttctttcattattgctcactgctaaatttaagaaggaagacctcccatcttaaaaacagagaagacggccgggcgtg

SEQ ID NO: 141742 - DNA, 601 bp, Human
atgagtctcaaaagaagagtcacagccatacaccctgcaaccagcagccctaccttgttaaaaagagtcatccaaatccattacaaaaccacagtaattattttactacagtcatgaaagttggaagtttctatagaactggaaattatgtaatataaggtaatcacaaagaataatcattttctgttgtatcataatatataacatcaacaagatctcattataattcatgcgcattactacatggattctgggatatctcacctcaaatcatctaagatattactcgcttatccagaayagcctacgagaagcaaagtttaattctctactgtaccacttacagctactactttttaaaacagctctactgaggtataacttacatgccataaaattcactcattttaatcgtataattcaatgatttttagtaaatacatacaattggcaaccaccaccacaattcagttttagaacactttcatcaccttggaaagagtcctcatgcctgtttgcagtcatgctatcctcctacgtccagccccagacaaccactaatctatctgtctttatggatttgcctttttagaaaacagat

SEQ ID NO: 141743 - DNA, 601 bp, Human
cagacttctttcctgaattccagcgttgtagccaactgcctatgcagtaacttctctggtacaactaacaagagatctcaaacttatcacatctaaaactgagcacatctcttcttctacccccagcctctagaaaatcactaacacatattaagtgatcaataaagctgttggactgaatagatacaatccagccagatgccaatgagtctcaaaagaagagtcacagccatacaccctgcaaccagcagccctaccttgttaaaaagagtcatccaaatccattacaaaaccacagtarttattttactacagtcatgaaagttggaagtttctatagaactggaaattatgtaatataaggtaatcacaaagaataatcattttctgttgtatcataatatataacatcaacaagatctcattataattcatgcgcattactacatggattctgggatatctcacctcaaatcatctaagatattactcgcttatccagaacagcctacgagaagcaaagtttaattctctactgtaccacttacagctactactttttaaaacagctctactgaggtataacttacatgccataaaa

SEQ ID NO: 141744 - DNA, 601 bp, Human
tcttacttgcaaagtttctgcaaggattggctgaccacattctccttcacttttggtttttaccagctgttatgtatcattttttcccatctttatttatttttttaacttaatttttttttcttttgagatggagtgtcgctctttgttgcccaggctggagtgcaatggcgcaatctcggctcactgcaacctccgcctcctgggttcaagcgattctcttgcctcagcctcctgagtagctgggattacaggcaactgccaccacgtccagctaattttttgtatttttagtagaaayggggtttcactatgttggccaggatggtctctctaactcctgacctcaggcaatccacccacctcagcctcccaaagcactgggattacaggcgtgagccaccgcgcccggcccccatctttataaagagacctaggagacatggtgttctggaagaaagagaaaaagatacttgcttggcctccaagctaggtcacttggagcaaaatgagtcagtctacaaggaaatttttttatataattgcataatagaatgcacatttctattcttctgcttgtagcattttaacacttcagaat

SEQ ID NO: 141745 - DNA, 601 bp, Human
tatttttgtgttgctttggaattgcctctaaatgtctcttgtttggatgtccccccattactctctgagcagtgatagtactcaacttgttaggtgtacaccatagtgaaccacaatgcatataatctaaacattttaactgtcagaacttggtgctataccttaaaattaacactagagcaacagcatccatcagcggtaggattgaactagaatgatcacatgtgctccagcaggatgccttgcctttagtgcaatcagccagtcaacaaagaactctttgagggccaactttatgtcyggtgaagagtgaggttagaaatgaattttgatgcaagaggcttgtgttatgaaaaataaaataaaatccttaagtctccaaggaagctcagaatatgaccattcacatttgttgcataatgcctgaaaagttgaaaaaaaatatggttttttaaatccaaaaacatcctaaagtggctgcagtcccagtcctgacccagaggcaataacagcatcttccaaagaaaccatttgtttctttttaacaaggacgtaatacgagtttcaaaacttatctcacgggatggttctgagaattaca

SEQ ID NO: 141746 - DNA, 601 bp, Human
aggcacaaagctttgttggaaaagtacagtccagaaaataatgcttggaaaatattattctgaactctattaaactagagaaaaaggtttcaagggctctggattcttttaaaacacagtcctcttcctgaatccaagcgatattaaattaagtttaaattaagctaagtaactatgccaacatgcaacagaaataaagacaagaagtgaaaaaaccaagaatacaccactattcatggttcttccttcaatgagaacatttcttaatttgttaaaattgattttgtttttcaccctgagkctccacatatcaggccacttgaaagcaacaatgcttgctcataaggcaactttcagtcaccagggtggtgacaggaaatgacctgcttcatctcccctatattcatggtatgtttccttcccatcccctccacccatcaaattagactcctctccagaagtcaggtcatctttcccagagccgccacctcttcccacctggatccttgccttcactcaggttgtgtcacaacatcagccttatttttgtgttgctttggaattgcctctaaatgtctcttgtttggatgtccccccatta

SEQ ID NO: 141747 - DNA, 601 bp, Human
atgcatttgacactgtacatagttttggctagctacactgtcttggtctcaagttaaaaataagaggccatgtaaatcaatcctaaactctttacacaaagccacagtaaaaagaactgcttggtattcagtgaatataatcctctctaaataaatcttaaactcagctttggagaacttctatgtaaaacttgtataatatagcttttacaggccaaaaattaaatccttagatttaacaaattctacttttaaacgttttctttggctgaatcttgatagagaacagtcttttttttttaacaaattctcataattcttttccaaaaattctatatttaataactagttaatctgatcaacaaagacagcttgaaaaatacttctcatgacctaagaaacaatagggcctaagacacacaactcaaattaaatgtgttctccacaataaacttctggattgctttaagaaaatgcagggggaaaatccataattcatctcactagtttcaacacagggcatttcaaatcctctttccaagaccatgatgggtgctccaaagtacgtagtctttcaaaacacactgaactggtttggatg

SEQ ID NO: 141748 - DNA, 601 bp, Human
gcacatgtatacatatgtaactaacctgcacattgtgcacatgtaccctaaaacttaaagtataataataataaaattaaaaaataaaaataaaaataaaagaacctgtgctaacaacaggcctcttttcctttcttttgcatcataattcagaaactaaggccttaagcagccctgggtagagtggatcttggtgccacacctcagctctacctccttgaggacaatcatgctgccactgaaatgccagggttctttccactaggtttccaatctgcttcttggaggtattcccttctcycctaggagctgacacagcaggcagcatttcctgcaacaccctccaaaatcactatgctaaatgagaagagtctgctgccccccacagaacacaaatctgctttgttttcagccagatgttttataggggacatctgtgttagatggaaaacaaaaagttactggtctacatattagggagcaaaaaggaatgatgtaaacgcacatgtataagtgttcaaatttttcaagtacagaaagaaaaaacttaagtattaagaacataaccatggactatgaccacaccgattaatattttaaa

SEQ ID NO: 141749 - DNA, 601 bp, Human
aaccaaccaccacatgttctcactcataggcgggaactgaacaatgagaacacatggacacaggaaggggaacatcacaccctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaattaaaaaataaaaataaaaataaaagaacctgtgctaacaacaggmctcttttcctttcttttgcatcataattcagaaactaaggccttaagcagccctgggtagagtggatcttggtgccacacctcagctctacctccttgaggacaatcatgctgccactgaaatgccagggttctttccactaggtttccaatctgcttcttggaggtattcccttctcccctaggagctgacacagcaggcagcatttcctgcaacaccctccaaaatcactatgctaaatgagaagagtctgctgccccccacagaacacaaatctgctttgttttcagccagatgttt

SEQ ID NO: 141750 - DNA, 601 bp, Human
agaacggccctggaatattagaattcatgggtagagctgccccattggtccttggccacaacacttctttcctgggctgtaaaatgagtctaaatgacagcattttcccaaacagattttgttacagtaagaaacaagatattgtttgaagtaatcactggtacatttctctctatggttttcattcacttagaggtgctgtaatgaacttagcatggcccaagtaaatcaggcacatacatcgtcttccatcatagtggggaggtctggaaagaacctgtgctacagctaaagaaactaycatcagagtgaacaggcaacctacaaaatgggaggaaattttcacaacctactcatctgacgaagggctaatatgcagaatctacaatgaactcaaacaaatttacaagaaaaaaaacaaacaaccccatcaacaagtgggcgaaggacatgaacagacacttctcaaaagaagacatttatgcagccaaaaaacacatgaaaaaatgctcaccatcactggccaccagagaaatgcaaatcaaaaccacaatgagataccatctcacaccagttagaatggcaatcattaaaaagtcag

SEQ ID NO: 141751 - DNA, 601 bp, Human
ttttcttcttcataccaaatgctatattttccaccttctaaaaacacacaataaaaaatacaagtcccagatatcagaataacaacaacttcatcgtgtctaatttaaatagcattttataatatgctaagagctacaatatacttagtgtcatttgcacctcaaataaccctatgaagtctgttgagcacataacgttcctgcaagatcaggcacctgagagaaagggtcaagtcacttcccatgtttaggcagccaggaaggagggaggctagaaatcaacccagggcttctccacctyttctcatgagagtggtctggaacagaacggccctggaatattagaattcatgggtagagctgccccattggtccttggccacaacacttctttcctgggctgtaaaatgagtctaaatgacagcattttcccaaacagattttgttacagtaagaaacaagatattgtttgaagtaatcactggtacatttctctctatggttttcattcacttagaggtgctgtaatgaacttagcatggcccaagtaaatcaggcacatacatcgtcttccatcatagtggggaggtctggaaagaac

SEQ ID NO: 141752 - DNA, 601 bp, Human
ggaattgaacctaaccctgagaatccaaaattctccatgctacctgtcacaccacatcctaaaataaggtcagctagagactaaaggtgactaagcaaaggaaagactcatctggctaatttggcacattgttttaaaattgtccagaaatctaaatagccaacagttaaataatcattaacatgatattgtaaaatggaaaaaatacttatgccattatattacaacaaaagaatagaggatataaaattaaatatatagtagagtatctatgcacattctgagtcatttacacacaacrgcaatggtaacagcaattgtaaagctcttggtgtaaaattatggctgttttttttattttcttcttcataccaaatgctatattttccaccttctaaaaacacacaataaaaaatacaagtcccagatatcagaataacaacaacttcatcgtgtctaatttaaatagcattttataatatgctaagagctacaatatacttagtgtcatttgcacctcaaataaccctatgaagtctgttgagcacataacgttcctgcaagatcaggcacctgagagaaagggtcaagtcacttccca

SEQ ID NO: 141753 - DNA, 601 bp, Human
acaactcttcaaagactgatgtggagatccaaggcctcttagcttttaagaacctatctatattttcatatgatatatttcaatatccatcacaatctccagcatcccaccccaaatgtaagaaatatgtctgacaaaagaattactttgatagagtaaatagtagaggtttaaaccctcttatctctagaactataggaattgaacctaaccctgagaatccaaaattctccatgctacctgtcacaccacatcctaaaataaggtcagctagagactaaaggtgactaagcaaaggaaagactcatctggctaatttggcacattgttttaaaattgtccagaaatctaaatagccaacagttaaataatcattaacatgatattgtaaaatggaaaaaatacttatgccattatattacaacaaaagaatagaggatataaaattaaatatatagtagagtatctatgcacattctgagtcatttacacacaacggcaatggtaacagcaattgtaaagctcttggtgtaaaattatggctgttttttttattttcttcttcataccaaatgctatattttccaccttctaaaaacac

SEQ ID NO: 141754 - DNA, 601 bp, Human
atgttagctggtattccagtgacttggaatttgggtaattcttcctataggatcaaaaggaaaactggaaaggaagaataattcagcaagacaactcttcaaagactgatgtggagatccaaggcctcttagcttttaagaacctatctatattttcatatgatatatttcaatatccatcacaatctccagcatcccaccccaaatgtaagaaatatgtctgacaaaagaattactttgatagagtaaatagtagaggtttaaaccctcttatctctagaactataggaattgaacctamccctgagaatccaaaattctccatgctacctgtcacaccacatcctaaaataaggtcagctagagactaaaggtgactaagcaaaggaaagactcatctggctaatttggcacattgttttaaaattgtccagaaatctaaatagccaacagttaaataatcattaacatgatattgtaaaatggaaaaaatacttatgccattatattacaacaaaagaatagaggatataaaattaaatatatagtagagtatctatgcacattctgagtcatttacacacaacggcaatggtaacag

SEQ ID NO: 141755 - DNA, 601 bp, Human
ggaaatggtcagaataggagaatttgtttctttttacctttctaagaaaacgtgaaaagagctgaacagaattgttcttttattggacaataatatttggtgtatttttcctagtagctagtcaggaattcaacctccttaaaatgctttgaaataacagctttattaattagcatatactcagttcctagtactcagcttggcacagagaatgcaggcaataaatatttattacatgaataaattaatgatgagttgggattgtcataagaaatctccacaatccattaaaacagattamtacatttttaaaacatgacctgaagggtaggttttggcactctgacaactgtaattagcctataataatcaggtaaaatgagaagtaataaaggtatgataaacatctcacactaaaagtaagcgaacactgggaagcgcctcacagtatttgatgaatactattcacacgtgatgttattttcttgctatgcacaagatttttattagaggcattcattgaatttaacacatcaggcaaaatgaagcatccactaatctgagaagtcacaaagctttaggcatcactgaatacactgca

SEQ ID NO: 141756 - DNA, 601 bp, Human
atgctgaagagccagagagaacgtgggaacttcttccctctgaatgtcttctctgcctcacaaggaagctaggccactagatcatggcttcagttagactctgaccattttcaaaatatataagagaaaaaaatatgcacagttactctgcttctcagtaacttcaaggccttgaggctcttatttttggagtaagtctggcatcagttacagaagaaaggagcaaagagacgtaagaagtatacaggtatgcccaatattacagaagtgaccacacctgccagaccactcacctttttgmtagatgggaattagggaaatggtcagaataggagaatttgtttctttttacctttctaagaaaacgtgaaaagagctgaacagaattgttcttttattggacaataatatttggtgtatttttcctagtagctagtcaggaattcaacctccttaaaatgctttgaaataacagctttattaattagcatatactcagttcctagtactcagcttggcacagagaatgcaggcaataaatatttattacatgaataaattaatgatgagttgggattgtcataagaaatctccacaatcc

SEQ ID NO: 141757 - DNA, 601 bp, Human
ccagaatgccgtgtctgcaggaatgatccataggctggaagaaaaagtgatcattatgtcagatgtgatgaatgcaacacctggttaggaacaatgtgtgcaaaactgtacacagccatatgaggatggaagcatatggaactgatcagaacacaatcctggtctcaggtaagggggatggggtcacacagatcttttaaaagactcagaggaagcatgtggtggtggcgatgatgggggagttgagggaggagttgtgaaaccatgagcctggatagaattcttaaaactgcaatcagcmgggcacaaaaacagtgcatttggagcaacagggaatgaagtaaccccactctggctttcttaaactgagaactggcatttcttctcatctatggccaatttcgagttacagccttgaagtaagccccagcacattcgagaagaaaaacataccccattacacatgtatttttatgataagtaaaaataaagtatctaaagacaaatatttactcccttttctaaaattagaagattagataggtagctgctgttcaaagcacataagtggtttcacttctgatggctgagagggcaataa

SEQ ID NO: 141758 - DNA, 601 bp, Human
aacaaaatgcctattaatcaacaattcattcaatcatgtattatctactcagtactacgtcactctttcatagctgattgtctgtctttcaaataccaacttcccattctcagtggtacagtggccagaaagcatactttttccaattatatcagcctcatgatcagaacgattaatggagtcttctgtgagtatgcaaatagatgtacagatgtttatcaaacacagacattccgtattatacttgactgataaatacataatcattaattttgatttacatgctgttgtgtgtcctagygtgtgtgttgactggcagagatttttaaaaatcttgctgcatcatacttcagtatgcactctgcaagtgcatacagcagcaaaataaccaacaaatagttaataatgaattaaatgagttaataaaaaaagatgtctggttaaaaaccagactgcaacaaaactttctctcaaaaaatttagtaacataaactgctaaagataagataccaatcaaagaactgtgcagttgtggccataactcagacaaccaaggatgcagacaggaagacccatagagtatttattctgtgccccaaca

SEQ ID NO: 141759 - DNA, 601 bp, Human
agggaaagaagtagaaaaagtcgtttcaaagatttgaggctcagaagaatgaagacccccactgatatggaaggccactgtgagaactcgattgagcatttgattttgcttatgttgaatttggcatccaggccaacatataatttagtggggagtatatgctcagtagggattaattcagagctggaactccctgaatagatcaggaatgacatccaatatcccttatttttctcaggaataagttagtaatgatcagaatatctactggatttctcaattgacattcgtggccaaagasagtagctaaggtaaataaaattgattctaatacttttcttaaaaaattccacctgcaaaacgctacctttataggaaaaatactgctctgtgggttgagaattgttagaatgacctctccaaatcagatggcaaatcatgctttgcaaagctcatcatcacagtgctccatccatcatagtgctttggccatacagcttcatttacattgagaaacaaacagaattagcgtctgcgcctcaggaaagtgccattgtgtataaaagtattttctttaagtcagatcaggataaaagctttc

SEQ ID NO: 141760 - DNA, 601 bp, Human
tataatttaaaaaaaaaaaaaaaaaagaaagaaattccagagcacacaaaaaaaaaaattaaccatataatgaaaatatatgtatatgttaaatgtatgcataacaataaatatgtatgcatgtgtgtgtatataatatattctccgtggtggcaggtacctgtagtcccagctacttgggaggctgaggcaggagaatggggtgaacccaggaggcagagcttgcagtgagccgagatcgtgccactgcactccagcctgggcgacagagcaagactgtgacaaaaaaaaaaaaaaaaawatatatatatatatatacacacacacacatatatattctccttttttacacaaatggcattatattatacagactttgaagattagaagatactgttttaaaactaccaccaaggactcacccttaggtaggcatgcacatgtgagtttatatacacacacacacatacatatgaaatatagtcaatatttaaaattttattatagtgtaaaagtagttatatctcagcatttgatgatgatgatgatgacgatgaggatgatgactctgtaaaccacatcagtgatatgttctccagat

SEQ ID NO: 141761 - DNA, 601 bp, Human
gttttataaggagcaaagtagagaggatatcatgtgagaaagaaaggcaatattcctgggtcactcagcaagtccaggtagcaaagagcctcaaaatctgagtaataaaaatatagaaatgaccaaccttaggttgataattcattcattctgtgaaaatccaaggagctctaagactctaggacaaacactaggaataggtagttaaataagacacgaattttgctcataaggggttacatagtctcttagaaagacagacttgtaaacaaacactgaaaacatgagaagtaaaggagaygtattcaaattgctgtgaaattgaaaagccaaaagaatcaaagctcaacccaaaaggatgaaaagaaaactgtacctctaggcttagaaagtactgctccatgtcattatgtgatggatgggtaaatgagtgcatatgcacacagaagtcatagaagctagcctgtaggagagacgtctatgaacccctagacaaaccacactccccacccaaacactcattctgtccttgaatctgctgccaaccttctgctaagtagtctctcagcctgagtcctatgactgagcttctttgaggatg

SEQ ID NO: 141762 - DNA, 601 bp, Human
catattttaatttgccagatttagtcattccacaatgtatgcatatattaaaacatcatgttgtatatcataagtataatttctgatttgtcaattaaaaattaaaaagtagtctgtgaatgccaagctggagccaactgatatatttagcattggatatatgctaaaactggaaacctttcactagggacaaagcatttctgataaagttcttgataatattttaaatgttagcccaagaaagaaacaactaaaacagtataaaaatattcttttatattgtttaggaaatcaataactrttatatatattgacaggcacctaaagacaatattatttttctttacacaaagtaatactgtttatattttcctttgcaagtttatggaatgcagattacatttaaactttctgatctcaaaatacaccgctattataaagaatgtatattctcagtcttgggtttccctcagtgtggtaaagtcctgagtccctctgaaccatttggcagactgtctcactcaactgaataatttccaggttatttgtcaccttaaaacaaatgaggctgtacattcaattcagtgatgtccaagaataa

SEQ ID NO: 141763 - DNA, 601 bp, Human
cagttacatgtggaatctatagtagttgaactcatagaaatggagagtagaaaggtggttaccagagattggaagagggaattgggaatatgttggttaaaagatacaaaatttcagttaggacagaagtataaattcaagagatctattgtacatcatagtgactataatgagcaatagtatatcaaatacctgagggctgggtgtggtggctcatgcctgtaatcccagcactgtgggaggctgaggcacgaggatcacttgaccccaggagttcttgaggctgcagtgagctaggatygcaccactgaactccagcgtgggcgacagagtgagaccttgtctctaaaaaaccccaaaccaatatatcgtatacttggaaactgctaggagagtaaactttaagtgttctccccacaaaaatatgatatgggtgtaaagtaatgcatattttaatttgccagatttagtcattccacaatgtatgcatatattaaaacatcatgttgtatatcataagtataatttctgatttgtcaattaaaaattaaaaagtagtctgtgaatgccaagctggagccaactgatatatttagcattg

SEQ ID NO: 141764 - DNA, 601 bp, Human
cattccttaaaatacttccatgacttggtgatactttctagatccataaatcacattctcaagaaagccaaaaaagtaaactggttgtttgaaatttcattaaccctttgctctgaaatctgatggctgtgccagcacagagcacaggaggaataggtaatagcaaagaaactgaagtgggacattccacaaagtggctgcatccaatctcttcacagataaatccaagactcagagccctctgcggagtgtgttatgaccccattcctgtaaagctaatgatttttcatttcccattttyagtaactctcgacttaaaatatatgaaataactaacttcaaggagaaggactgggactaatgagaccagaacaacagaatgaaattgaaatttgaaactccaaagccatagatacagcacataaaggccagcactggtggccaagtgagtgaagtcagaaccaagtttgcataagtgaaaatcagctgtttcctgggcagctgaacttcatgacctacatcacacttcactctttctaaatagtctggcataagaggaactcgagcaactcaattgcaagaaaacacataaaccaattaa

SEQ ID NO: 141765 - DNA, 601 bp, Human
ccatcagagaaactcttccaaaaaatgagatacattccccaaaaactagaaagtagtaaaagccaaaaggaggttccctcttgatatagtctggatatctgtcccctccaaatctcatattgaaatctgatcccccatgttggagaggggcctagtgggcggtgtttgggtgataggggcagatccatcatgaatggcttggtgccctccctgcagtaatgagttcacatgcaatatggttgttaaaaggagtctgcaatttccttcccctctcttgctctctgtctctctccatatgacatgcaggctccccttcaccttctgccaagagtggaaacttcttgtggcctcacctgaagcagatgctgctgccatgcctcttgtacagcctgcaaaatcatgagccaaataaacctcttttccatataaactccccagtctctgatattgctttataacaatgcaaaatggactaacacactcatgaaaatggtaaagggaagtccagtttttattttttcttaaaactgtactgtggagatgatgactgtacagaaagcaaagcattcaaccctacctaatgcataggggaatgtaggct

SEQ ID NO: 141766 - DNA, 601 bp, Human
attgtgagcattttaaatcggttcctgtgtccttttgatgtatctccatcattatgggtttgttttattttgtttttattttagcacttgcttactttttggcactataagattcttcaggctgatcagtatatttccttccctagtcctagaataagtcatttttccaaggacctctgttccctttcattggagaatggtattaaacaccaaaatccaggtattatatgtgttcattgctactaggccctctcagttgatagagcaaagaaatataccaaccaatgtatatatacgtacygaaaaatatttctatatgtaaccatctgtgtctatactaaactaaacctgagttcatactgatgtctccaactctaatctacaacttgcatcattttagtctcctcctttgcttatctgtaacattccactccaacagtgagtacctggcttccaccatcgggcatccatttacttaactgtccaattccagcatacatctatagtagcatcagaactgttaacctgtactcctacgggaaacaactttttaaaatacaggacaataattatgtacagctttttttgccttcatcttaca

SEQ ID NO: 141767 - DNA, 601 bp, Human
cacttccttcagggcaaaatatctacctaaattgtttgaaattcttggagatttatctctcctcccccacttactacctattcaatctatttatatcagtatgaaccatggatatttactttatactttgggttataatccaaggctactttattgaatgtgttggtcaaattgttccagtttggccattgtgagcattttaaatcggttcctgtgtccttttgatgtatctccatcattatgggtttgttttattttgtttttattttagcacttgcttactttttggcactataagatwcttcaggctgatcagtatatttccttccctagtcctagaataagtcatttttccaaggacctctgttccctttcattggagaatggtattaaacaccaaaatccaggtattatatgtgttcattgctactaggccctctcagttgatagagcaaagaaatataccaaccaatgtatatatacgtactgaaaaatatttctatatgtaaccatctgtgtctatactaaactaaacctgagttcatactgatgtctccaactctaatctacaacttgcatcattttagtctcctcctttgct

SEQ ID NO: 141768 - DNA, 601 bp, Human
tgttgaaagtattgcatagacagggttactgtgcacacatgtacacacacacacacatacaaatacactgcccttctatcttccaaaactaagcgacaaggtaaaaaaaaaaatctttgatccagctaaacaaagacctaatttaatcatgaaattctgaaagtatgactaagagacataaatatgttgctgtatttttatgaatttattagcaaaacacttttgaacgcagtgtctaataaagtatattttccctaaatttaaaatgaagatggccttactaagtagcagatatttatawaatacagacaacttttctttttaaatttaaacttaatttttttttttttttagatacaaggtctggctctgtcacccaggtgggagtgcagtggcatgatcatagctcactgcaacctcaaactcctgagttcaagtgacctccacattaaaggcataaaagtgagaccttaaactgtaaaattattagaagaaaacataggagaaatgcttcttgacattggtctgggcaataaatgaaccaatattaatgcatggattattaactgaagtccatatttcattcatattttcttagttt

SEQ ID NO: 141769 - DNA, 601 bp, Human
agctgcaggcaattctggctgaaatgtttcactcttccaaaaggtagcagctggcctctggtataaaaagcaaattggtgaataaaattcacactcttcaaaatgtgcgaacatcggtgattttttttcagcaccactttcttctaaagctaaaccagagaggcaaacactgacttttaaaaattccctttttatttaaatttctgtcaattttcttggtaaaatgttttgttgaaagtattgcatagacagggttactgtgcacacatgtacacacacacacacatacaaatacactgcscttctatcttccaaaactaagcgacaaggtaaaaaaaaaaatctttgatccagctaaacaaagacctaatttaatcatgaaattctgaaagtatgactaagagacataaatatgttgctgtatttttatgaatttattagcaaaacacttttgaacgcagtgtctaataaagtatattttccctaaatttaaaatgaagatggccttactaagtagcagatatttatataatacagacaacttttctttttaaatttaaacttaatttttttttttttttagatacaaggtctggctctg

SEQ ID NO: 141770 - DNA, 601 bp, Human
tctggtaggatttcttctgccattggagctatactgagctgcaggcaattctggctgaaatgtttcactcttccaaaaggtagcagctggcctctggtataaaaagcaaattggtgaataaaattcacactcttcaaaatgtgcgaacatcggtgattttttttcagcaccactttcttctaaagctaaaccagagaggcaaacactgacttttaaaaattccctttttatttaaatttctgtcaattttcttggtaaaatgttttgttgaaagtattgcatagacagggttactgtgcamacatgtacacacacacacacatacaaatacactgcccttctatcttccaaaactaagcgacaaggtaaaaaaaaaaatctttgatccagctaaacaaagacctaatttaatcatgaaattctgaaagtatgactaagagacataaatatgttgctgtatttttatgaatttattagcaaaacacttttgaacgcagtgtctaataaagtatattttccctaaatttaaaatgaagatggccttactaagtagcagatatttatataatacagacaacttttctttttaaatttaaactta

SEQ ID NO: 141771 - DNA, 601 bp, Human
aatgagccagttataaaagcggaaaggcttaggtaggcggaaaggtcacacgtgcagcatattactagctgggcatcaaaccactgtggcttcctcctttgctgcaaccccctctcctctatgaccatgaaaacaccagccaaatatcaagggggtagcacaagaccctcccacctccagtcagtcctgcccaccaaatcacatcgctgcccatggctgcccctttgtctgctattgtgtctctccctctgcgaatcagctaattctctccctttcacttgctccctgtccatcttctctytttctctctttgcctctccctggctcattcactccttttctttctatagcatctgtttcataatgttttgcagtgatatttggaataatctttttatgtctgccttgaccctcctaagattgaaaacttaatttggaaccaaaacctatgtcttactacccacactgaaaccacaaatgaagcactggataactcattttttaattatcttgttctttggctcccatcattttttaaagtttatattgctattaagtagtattggggggaaagggtccaaataatttaaagcttgaatct

SEQ ID NO: 141772 - DNA, 601 bp, Human
caatttccccagctctccctgtgatgatctcctagaagtgacgtgcattcctttaatgttaaatattaaatggacatgtttgtcccttggatttacaaactgctttaaattaaaaaattagcccaacagtcaattctattcctgaaattttgaaggacttaagtcatgatatcaatcacaaatatgaataagtaggaaaaccatatgaatttcaggaaatttttacccaggcaagtcctctcttagtggtgagcaggtaaactgactcttgaggggaaaataaaaagctctcactcatcartttccaaggtgtcaatattcccaccaggactgatttcaggctaccaacagtttaaccaccagctcacgaaatttctatatatttaacaagaatcagggaaaatggtttccagcacacgccgcctcttcccatttgaaagaaagggtgttggtaaggagaaagttcaggaagggagctcagggaatgagccagttataaaagcggaaaggcttaggtaggcggaaaggtcacacgtgcagcatattactagctgggcatcaaaccactgtggcttcctcctttgctgcaaccccctctcct

SEQ ID NO: 141773 - DNA, 601 bp, Human
taccaccatgattaagtacttcagatgttatgaagcaaaactgaattaaaatataaaaaaaaatttagacgtgatttaatctgtttccaaaagatcactgttacagcaacacagaggtaaattgcaaagtgctctaactgcaacaatttacgtatctaagtcagagataattaggacttgatctaggatggtcatggtggggggagaggaaagacatgcactgtgttttcactaaacttccatcaattcagtttgagaggtaaatttgcccaaagttaagcacattaaatgaaacaaactstcatgttagctatacatttattcatattacatatatgattacaaataaaaatgaagcctatgattgtgcctgtgaaccaggtattttgagagctttgcttcaatgattttaacattgggcaggaaatgtgttgatctggcattattaaagttagaaataacctgacacttgtcagcttttttaaagaatatgctagagcagtgaatattgaaagatggccatgcaaaaatgtcttcaactatattaagaattttacacttgcaaagactttcttcatagataatgcaaaaacaaactaca

SEQ ID NO: 141774 - DNA, 601 bp, Human
ctcactgcaacctccgccttctggtttcaagtggttctcctgcctcagcctcccgagtagctgggattacaggcacccactatcacgcctggctaatttttgtatttttagtagaggcggggtttcaccatgttggcaaggctggtctcaaactcctgacctcgtgatccacccgcctctgcctcccaaagtgctgggattacaggcatgagccaccgtgcctggcctgctctcctcatttctattcagtgttggattgcaggttctagccaggtcaattaggcaagaaaagatagaaagrgcatccagattggaaaagaagaaataaaactctctattttcacatgacatgatcttgtatctggaaaatcctaaggaattcacaaaaagtctgttagaataaacgagttcctttataaagttccaggattcaaaatcaatatacaaaaatcaactgtatttctataaactaacgagaaatctaaaaataaatttaaggaacaattccattcacaatagcatcaaaaagaattaaagagttagaaataaatttaactaaagaaggataagacttgcacaatgaaaactataaaacattgtt

SEQ ID NO: 141775 - DNA, 601 bp, Human
gcagatgaactacactaagggaaccggaagatattctatattgtaagaatattgaatatattctattccctaaaataatatttcctttaggatcttttccaaatccatactatttgtgagtagaaaaactcgtaaggagagaaagagcaaaagaagaacataaacattgaaacataaatctataagccattgctgtcttcaaataactaacgaaactgatttgttctaaagagcatatccatctgatcacttttggcatacaataaaacttaatgaaatatttaattatgttatatttagkatatcttggatgatctttgacttctaagaagttagggatcattattttgtgtgtcgtatacaaaccgtgaatcatccagactataaaggcaatcctaaggagtaattaatacaatttttagtctataaaactccacatatatatttaggtttcttcttatgaacaaaatatatttccaattatacctaattgcaatgcctatcatttccaatcacttaactactaacaggatgctatttttaacactgaccttctctctaaaatttttttttttttttttttggtctctaccatcttttt

SEQ ID NO: 141776 - DNA, 601 bp, Human
atttttaatatttcacagtcagaagcttcagccaagacatgcaatttgagtgttctagaatagtgttagtaggctacaaggctgtattaacacaaatgtgaatatagaatcatacagtcttgaatttgcaaaatctttgtccaagtcctctctgttcccagcaaaatctccgccaaattcccttggagaatcctcaaaatatcttggggttgtgagtagagatgaatattgcatgctggaaagctctaaatagtcttaaagaagagcaacaaacaggaaggcagatgaactacactaaggraaccggaagatattctatattgtaagaatattgaatatattctattccctaaaataatatttcctttaggatcttttccaaatccatactatttgtgagtagaaaaactcgtaaggagagaaagagcaaaagaagaacataaacattgaaacataaatctataagccattgctgtcttcaaataactaacgaaactgatttgttctaaagagcatatccatctgatcacttttggcatacaataaaacttaatgaaatatttaattatgttatatttaggatatcttggatgatctttga

SEQ ID NO: 141777 - DNA, 601 bp, Human
cttcccaggagaggggaaaggagggggcgcagccctgaaaggagaggccacgggggagaaaaaattacttcattttgttgtctgagaaactgattcgcaagctcttgggcaaagagccttctatttggggtggcctagatccagaagcaactgtggaggacagagtatgaagtttggatctagaggactcaggtttagggcaaaagctagctgaccccagtcaagtaacttacaggttcttagcttaagtttccccatctgtaaggtggactatgatattactatgagaatcagataagaragtatgtatttggaagaccgtcttgatacctttaagtatttggaaatatgaaaatgtctgaattgctgtttcctgtgctcagattcataacataatgctttcaagttccataaagatttatatcttgatgaaaagtttacacaaagaaatcaagatcttaccacttagggaaagtaaatgtgcatgggaggagagtgtgcccagaggccagcaaggctcattggtcaactcagcagcatgcataagcccaactatgtcatagattgactgctcaccactcctgctgagcctcaaagcaat

SEQ ID NO: 141778 - DNA, 601 bp, Human
aggctacaaaacaacacaaaacaacttgtacactgtgactttattttcctaagagatatacggccatcctgaaaagattggaaggactgaaaagatattttatggaagtagttatgatttttaaaatttaattacctgcattttctgttgccaatttttctaataatgagcacatattgcttttgcaattaaaaatttaagttttcttattaaagaaagagcaatgagtaaataaaattttatatctttatgttaactttactgtagagtgttttgtttgttctaaaataataatagtcaytctgaaaagaagcaaaataaaacacaaagattaaatataaaaagtcatggaattgataacaacaaaataatacatttatctgatattttgccttaatataggcctttccttgattatcagaagggaatcagcgtcagcttcctttttggaaagccacatcattttctgaactgtctctaataattcagtatgtgatcacaaaatgattccactgtgtctgcatttccagagactatctaaaaatggagctcctagcacattttacaaacaaactttaaaaattacaaaaacaaaaaagta

SEQ ID NO: 141779 - DNA, 601 bp, Human
gctgagactaggattcatggcaagatttgcttataaaggctgaaaataaactggaaacaacataaataggcaacaatagggtactgcaacataagttagagctatacaaaatatacagcctatcaaaattatattaaagaatattgattgaaaaactacacaatatatggataagtcaaaggttacaaaaggctacaaaacaacacaaaacaacttgtacactgtgactttattttcctaagagatatacggccatcctgaaaagattggaaggactgaaaagatattttatggaagtagytatgatttttaaaatttaattacctgcattttctgttgccaatttttctaataatgagcacatattgcttttgcaattaaaaatttaagttttcttattaaagaaagagcaatgagtaaataaaattttatatctttatgttaactttactgtagagtgttttgtttgttctaaaataataatagtcactctgaaaagaagcaaaataaaacacaaagattaaatataaaaagtcatggaattgataacaacaaaataatacatttatctgatattttgccttaatataggcctttcctt

SEQ ID NO: 141780 - DNA, 601 bp, Human
cataaggatatatttgaagatacaagaaatatttgctgagactaggattcatggcaagatttgcttataaaggctgaaaataaactggaaacaacataaataggcaacaatagggtactgcaacataagttagagctatacaaaatatacagcctatcaaaattatattaaagaatattgattgaaaaactacacaatatatggataagtcaaaggttacaaaaggctacaaaacaacacaaaacaacttgtacactgtgactttattttcctaagagatatacggccatcctgaaaagaytggaaggactgaaaagatattttatggaagtagttatgatttttaaaatttaattacctgcattttctgttgccaatttttctaataatgagcacatattgcttttgcaattaaaaatttaagttttcttattaaagaaagagcaatgagtaaataaaattttatatctttatgttaactttactgtagagtgttttgtttgttctaaaataataatagtcactctgaaaagaagcaaaataaaacacaaagattaaatataaaaagtcatggaattgataacaacaaaataatacattt

SEQ ID NO: 141781 - DNA, 601 bp, Human
acatataaccagaaccataatagcctattcaatttaacttcttataggttatcataaggatatatttgaagatacaagaaatatttgctgagactaggattcatggcaagatttgcttataaaggctgaaaataaactggaaacaacataaataggcaacaatagggtactgcaacataagttagagctatacaaaatatacagcctatcaaaattatattaaagaatattgattgaaaaactacacaatatatggataagtcaaaggttacaaaaggctacaaaacaacacaaaacaacwtgtacactgtgactttattttcctaagagatatacggccatcctgaaaagattggaaggactgaaaagatattttatggaagtagttatgatttttaaaatttaattacctgcattttctgttgccaatttttctaataatgagcacatattgcttttgcaattaaaaatttaagttttcttattaaagaaagagcaatgagtaaataaaattttatatctttatgttaactttactgtagagtgttttgtttgttctaaaataataatagtcactctgaaaagaagcaaaataaaacac

SEQ ID NO: 141782 - DNA, 601 bp, Human
ggatatgacattcactcagcacagctgccagcctgcctgttccagagctggggtgagctgaatggaatcctcctaagtttccaaaagtttggcacactgtgtttcttgagattatagtcaatggtatgggtggcctcactcttttttccttctctctttttgtctctcttccttcaaggacaatttggaatagaaaatccctgcttcttcctctcaggaccagcacaaaaaccccttctacctggctgagcaaggccctccctgccatcagggagacagactctttctcctgaggcctccracttccattcttcctaattttgttttcttgacacaaagagagctattatgaggctggaatttaaaaatagcaatattaaactaaattctattctcctcattactgctacctgatgtcttattatgccctagtaccaaactcttcttggaggaaattggtaggagatctgttgggagatggtctggaaggatgatgcttgcggtctgctgacctgcagctagagctaatcctagactgttgcttacaaaactactgacttttatacacaaatagcagcaatcattgctgaaatctcccaat

SEQ ID NO: 141783 - DNA, 601 bp, Human
gccgagatcatgccactgcactccagcctgggcaacagagcaagaatctgtctcaaacaaaaaaaaaaaattcccaaataagtttctgctcccacaattacactttttctgaatagtcaatggatatgacattcactcagcacagctgccagcctgcctgttccagagctggggtgagctgaatggaatcctcctaagtttccaaaagtttggcacactgtgtttcttgagattatagtcaatggtatgggtggcctcactcttttttccttctctctttttgtctctcttccttcaaggwcaatttggaatagaaaatccctgcttcttcctctcaggaccagcacaaaaaccccttctacctggctgagcaaggccctccctgccatcagggagacagactctttctcctgaggcctccgacttccattcttcctaattttgttttcttgacacaaagagagctattatgaggctggaatttaaaaatagcaatattaaactaaattctattctcctcattactgctacctgatgtcttattatgccctagtaccaaactcttcttggaggaaattggtaggagatctgttgggagatg

SEQ ID NO: 141784 - DNA, 601 bp, Human
ggagaatcacttgaacccaggaggcagaggttgcagtgagccgagatcatgccactgcactccagcctgggcaacagagcaagaatctgtctcaaacaaaaaaaaaaaattcccaaataagtttctgctcccacaattacactttttctgaatagtcaatggatatgacattcactcagcacagctgccagcctgcctgttccagagctggggtgagctgaatggaatcctcctaagtttccaaaagtttggcacactgtgtttcttgagattatagtcaatggtatgggtggcctcactyttttttccttctctctttttgtctctcttccttcaaggacaatttggaatagaaaatccctgcttcttcctctcaggaccagcacaaaaaccccttctacctggctgagcaaggccctccctgccatcagggagacagactctttctcctgaggcctccgacttccattcttcctaattttgttttcttgacacaaagagagctattatgaggctggaatttaaaaatagcaatattaaactaaattctattctcctcattactgctacctgatgtcttattatgccctagtaccaaact

SEQ ID NO: 141785 - DNA, 601 bp, Human
ataggccaggcatggtggctcacgcctgtaatcccagcactttgggaggccactgaaggcagatcacctgaagtcaggagttcgagaccagcctggccgacacggtgaaaccccttctctactaaaaatacaaaaattaactgaatgcagtagcatgcacctgtagtcccagctactcaggaggctgaggctggagaatcacttgaacccaggaggcagaggttgcagtgagccgagatcatgccactgcactccagcctgggcaacagagcaagaatctgtctcaaacaaaaaaaaaaaattcccaaataagtttctgctcccacaattacactttttctgaatagtcaatggatatgacattcactcagcacagctgccagcctgcctgttccagagctggggtgagctgaatggaatcctcctaagtttccaaaagtttggcacactgtgtttcttgagattatagtcaatggtatgggtggcctcactcttttttccttctctctttttgtctctcttccttcaaggacaatttggaatagaaaatccctgcttcttcctctcaggaccagcacaaaaaccccttctacctggctga

SEQ ID NO: 141786 - DNA, 601 bp, Human
aaaatttcccaaataggccaggcatggtggctcacgcctgtaatcccagcactttgggaggccactgaaggcagatcacctgaagtcaggagttcgagaccagcctggccgacacggtgaaaccccttctctactaaaaatacaaaaattaactgaatgcagtagcatgcacctgtagtcccagctactcaggaggctgaggctggagaatcacttgaacccaggaggcagaggttgcagtgagccgagatcatgccactgcactccagcctgggcaacagagcaagaatctgtctcaaacaaaaaaaaaaaattcccaaataagtttctgctcccacaattacactttttctgaatagtcaatggatatgacattcactcagcacagctgccagcctgcctgttccagagctggggtgagctgaatggaatcctcctaagtttccaaaagtttggcacactgtgtttcttgagattatagtcaatggtatgggtggcctcactcttttttccttctctctttttgtctctcttccttcaaggacaatttggaatagaaaatccctgcttcttcctctcaggaccagcacaaaaacccctt

SEQ ID NO: 141787 - DNA, 601 bp, Human
gaaagagtttcagttaaagctgcaattattacagatttcgctacaacagatactgaacatttactgctttttatcactgggcagtgaatccaaaatatatgagaataagataatcactaatttcaatggtgataaaggattttgatttttaggtacaattaaaaaatttcccaaataggccaggcatggtggctcacgcctgtaatcccagcactttgggaggccactgaaggcagatcacctgaagtcaggagttcgagaccagcctggccgacacggtgaaaccccttctctactaaaratacaaaaattaactgaatgcagtagcatgcacctgtagtcccagctactcaggaggctgaggctggagaatcacttgaacccaggaggcagaggttgcagtgagccgagatcatgccactgcactccagcctgggcaacagagcaagaatctgtctcaaacaaaaaaaaaaaattcccaaataagtttctgctcccacaattacactttttctgaatagtcaatggatatgacattcactcagcacagctgccagcctgcctgttccagagctggggtgagctgaatggaatcctccta

SEQ ID NO: 141788 - DNA, 601 bp, Human
aaaaaagtgccctaacctttttagagctacaccctaaaatatttccaggtgagatgagaacgtacaatgcagaaagagtttcagttaaagctgcaattattacagatttcgctacaacagatactgaacatttactgctttttatcactgggcagtgaatccaaaatatatgagaataagataatcactaatttcaatggtgataaaggattttgatttttaggtacaattaaaaaatttcccaaataggccaggcatggtggctcacgcctgtaatcccagcactttgggaggccactgmaggcagatcacctgaagtcaggagttcgagaccagcctggccgacacggtgaaaccccttctctactaaaaatacaaaaattaactgaatgcagtagcatgcacctgtagtcccagctactcaggaggctgaggctggagaatcacttgaacccaggaggcagaggttgcagtgagccgagatcatgccactgcactccagcctgggcaacagagcaagaatctgtctcaaacaaaaaaaaaaaattcccaaataagtttctgctcccacaattacactttttctgaatagtcaatggat

SEQ ID NO: 141789 - DNA, 601 bp, Human
aatgactgattgctaatgaaaacattctttctcatacagaacattccaactatggttgtaagtcatgaaacttgcaatgtaatagtctttaaatcagatataaaagaacttccccccaaaccaaaactaagcaaaaaaccaaccaaacagcaaagtatgcttctcatggattaactactggcaattgctttgttccattatacagaaatgttttgactaaccagaatgcataggtcctggggtgttttgggtagcttggtgtagcaatctgaagtttagcatttttgattccagcttattrctgatatttaatataaagcacaaccagtctactttcccactaagtgtggtcagcagtttcccatgttctgattgctgatccagaccattgttggagtggcatcatcactcgatcaattcttcttttgacatgctgagctccactcccaccttcctcagtggctttagttactgacccccttttgagtattttagtgtcccttcaactgccctaaaattttaacataattttttaaattctgaataaaattaagaagtataagaaagtgtaggagtcttagaagaaaaattgactcacaac

SEQ ID NO: 141790 - DNA, 601 bp, Human
aagccaattagtttccagaatggctcctttctcttggggctacaccttgtggtttgaaattaaatccaatatcagcctcatccatacacaaatgcaaagccaaggctagcccattttggataatctcgtgatcttctccactgaacatgagcatgtattgtctggatcaagttctttttaatgatgaggaaatatgagatttattactaatgaagataggccccaatccaactaaaacctaggcagatatgattatctttaatttcttttctcatctctcattttaaggggaaaatcatcrtagagcagaaatctcaaaaacttgctttggaggcaaagaacattttccctctcttggctttttccagtgtgaatggaacacgcatggctctaatttcacaggttaatttcattctgacaatggaaaacagttaaacagccaatcacatgtttacatctatcaatagtttttaataccgatgatcatgaggtggtgttggcctgattagttcagtcctaacctaaaaatgactgattgctaatgaaaacattctttctcatacagaacattccaactatggttgtaagtcatgaaacttgc

SEQ ID NO: 141791 - DNA, 601 bp, Human
cctgattaatacaccacttatctgaagggtattatccactctgtgcatcatcttttatacatgctttgctttcatccatatggacagcataactttatttttgcccatttaatactgagagtgagcattcgacctgttggccacaaagctatagctatttactcagagcttctatttttaacactctgattcctgtgttatttattttacatgcagtgaagccctttaaagccccttaaccacttccctacatctgcatgcaggaacagtctcctcctgctagaaacagagtttaatgatctttgagttgaaggtaggatggaaaaagccaattagtttccagaatggctcctttctcttggggctacaccttgtggtttgaaattaaatccaatatcagcctcatccatacacaaatgcaaagccaaggctagcccattttggataatctcgtgatcttctccactgaacatgagcatgtattgtctggatcaagttctttttaatgatgaggaaatatgagatttattactaatgaagataggccccaatccaactaaaacctaggcagatatgattatctttaatttcttttctcatc

SEQ ID NO: 141792 - DNA, 601 bp, Human
cctgtctcgatgttcacgtgagttccttaaaacaaatctctttccatatatatatatacacacaacctattggttctgtttctatggagaaccctgattaatacaccacttatctgaagggtattatccactctgtgcatcatcttttatacatgctttgctttcatccatatggacagcataactttatttttgcccatttaatactgagagtgagcattcgacctgttggccacaaagctatagctatttactcagagcttctatttttaacactctgattcctgtgttatttattttrcatgcagtgaagccctttaaagccccttaaccacttccctacatctgcatgcaggaacagtctcctcctgctagaaacagagtttaatgatgtttgagttgaaggtaggatggaaaaagccaattagtttccagaatggctcctttctcttggggctacaccttgtggtttgaaattaaatccaatatcagcctcatccatacacaaatgcaaagccaaggctagcccattttggataatctcgtgatcttctccactgaacatgagcatgtattgtctggatcaagttctttttaatga

SEQ ID NO: 141793 - DNA, 601 bp, Human
caagcactattctgcacatttctttgagggtgtttttagatgagattaacatttaaattgctaaatttgagcaaagcagactgccctctgtaatgcaggtgggcctcatctattggttgacagcttgaatagaacaaaaggctgacctccacaagcaggaggccattctagcagatttgaactgcaacatcagctcttcctgagtctccagcttgccagccctccctgagtattttgaacttgcctgtctcgatgttcacgtgagttccttaaaacaaatctctttccatatatatatatacacacaacctattggttctgtttctatggagaaccctgattaatacaccacttatctgaagggtattatccactctgtgcatcatcttttatacatgctttgctttcatccatatggacagcataactttatttttgcccatttaatactgagagtgagcattcgacctgttggccacaaagctatagctatttactcagagcttctatttttaacactctgattcctgtgttatttattttacatgcagtgaagccctttaaagccccttaaccacttccctacatctgcatgcaggaa

SEQ ID NO: 141794 - DNA, 601 bp, Human
tcaagtgattctcctgcctcagcctcccaagcatctgggattacaggtgcccaccaccacgcccagttaatttttgtatttttagtagagacggggcttcaccatgttggtcatgctggttgcaaactcctgacctcaggggatctacccgcctcggcctcccaaaatgctaagattctaggcgtaagccactgcaccctgccaacctattttagttgtaaataaaatcatcagtgctttaagaaggagagatagattaaggcctcccgtcttcatcattcgcttcagtgtgctggtattrcaaacagcaccatgtgcaatgcccattcccacttgaggtggtcaattttatgtgtcaacttggctgggccacggggcccaggtatgtagtcaagcactattctgcacatttctttgagggtgtttttagatgagattaacatttaaattgctaaatttgagcaaagcagactgccctctgtaatgcaggtgggcctcatctattggttgacagcttgaatagaacaaaaggctgacctccacaagcaggaggccattctagcagatttgaactgcaacatcagctcttcctgagtctcca

SEQ ID NO: 141795 - DNA, 601 bp, Human
tagaatacactggcttttctgactaaatcacaggtgagcaaataatagaagactgcttatttttagcagcaggctgtgagagacaacctcaaaaaagataaactaacccacgtacgtgagatcacacgtttttaccataaatctttgtttcctggctgttcttataaatgcaaatctagcagaaatgttacaaacataagcaataagattacaacagttttcctaaaatatcttctatattaggctttacttaaggccaacaatattttcatctattttaattttattatttcttttttttaattttttgagatggagtttcattcactcttgttgcccaggctggagttaaatattatgcaatctccgcctcccaggttcaagtgattctcctgcctcagcctcccaagcatctgggattacaggtgcccaccaccacgcccagttaatttttgtatttttagtagagacggggcttcaccatgttggtcatgctggttgcaaactcctgacctcaggggatctacccgcctcggcctcccaaaatgctaagattctaggcgtaagccactgcaccctgccaacctattttagttgtaaa

SEQ ID NO: 141796 - DNA, 601 bp, Human
cttcattatcagtgattggcttggatgaatgggcggcttccaacagcttttacccaaggccaggcttgacaaatgtggcatgattttggcagtgctcgggctctgattcagtcttcaaatgtctggcatggaacatgaacttctgaacctgacctaaagctattatgggctttaaattttcaagcaattgcatcattaagcaaccagcatgcgatggcattactatcttatccactgcctaaataccacaatgcatttaaaggaagttgacataaatcagcaatgaaaggcacagatgacrgcaataagaaatggcccatcattaaggttcattcaaaagcatacaggttggaactgcagcacattcaattttaaaatgcagatatgacacaaattcagaaagctatgaagagcaatttgtgaattttcaccaaatagcatatgctctgagaaatttttgtctaagtgttctccaaggtagctttgtagtggtggagtttcttccttttctttcttaaacctctgctccaagaagagacaaagcatccacattcaattataagagttttctttttcacctcaaattaccaatattccctca

SEQ ID NO: 141797 - DNA, 601 bp, Human
cctgccttcgatcaatcacctctcctacatgacgctccagcaacaagtaacctcaaaactactgactgaacacttagcacagcctaccttgcattcttctttgtctctttcatgcctcagttctgtctctccaggtagaccttaaactcatcaagagcaaggatcttttcttataatttttcttataattttctttcctccaacagccaccaaaatctgctgacagaaggcaggaggcagcataaaatacaggaaaagcactggacgtagcatgatttgtcttagacttgccacttactakctgtgaaacttggggaaaggtttacctctcatcctcagtttccgcatctacacattgggggatgaggatgaaaccagtacctgccgtgccttcattaccaagtggttgtgagaatcaggtaaagtgagtgtgttctgaattacaaagatttacatacatgaggaattagttaacatttttttgatgatggtaataacatcatcaaagacatctagccacaacttaatcagaactacctatcatatggtgcttcagagaattcaaattcaattcctttctctgaacactcatgagaaaaaa

SEQ ID NO: 141798 - DNA, 601 bp, Human
atgtaatatgtgggtccagcacaattgcttgctcagcctcctacgcactgtcatatgcatctgcttctgtgatacagttgctcaagctgctctgctctcttttatctaagacctactctcctttcaagaccaactcaactctcacttcctcccgaaagctttctctgctgtccctgccttcgatcaatcacctctcctacatgacgctccagcaacaagtaacctcaaaactactgactgaacacttagcacagcctaccttgcattcttctttgtctctttcatgcctcagttctgtctytccaggtagaccttaaactcatcaagagcaaggatcttttcttataatttttcttataattttctttcctccaacagccaccaaaatctgctgacagaaggcaggaggcagcataaaatacaggaaaagcactggacgtagcatgatttgtcttagacttgccacttactatctgtgaaacttggggaaaggtttacctctcatcctcagtttccgcatctacacattgggggatgaggatgaaaccagtacctgccgtgccttcattaccaagtggttgtgagaatcaggtaaagtgag

SEQ ID NO: 141799 - DNA, 601 bp, Human
cgcacttcttccttctgaaaatctcaatttttaacaggttgacagacgttcaattctgttttgaaacgcaaagtagtctgaatccacttcagagacaaatgatcccctcggatgtgggaaaacatgcaaggatttgcttttgcaagccatagtctcacaaagatgaggagttcctgacagtacatccaggctcacgtttcaaaatggagaattacaatgcaacatgttgacagtactaggatgtggctgccattccttactttgtttgcttccttcaaaagaaagtgctttttttttttttaatgttgggggcttaaaagaggagtgaaaggtgaaacaaagggttatacagacaagttttgtgcatttctaactttgcactggaaatctactcctgacttactgcagtcatcttgaagcttaaaatccaagatcactggccttgctgattttccttctatcaatgaccacaaatgccccagtctcaaaaccccagcatcattgttgaccagtatgatcatatgttcaatttgcctaggaaagtcccagtttgtgcctgttttcccactgtcctgaccagtgtagcatttgtcttggaaaa

SEQ ID NO: 141800 - DNA, 601 bp, Human
ataatgaaatcatagattataggggttcccacactcatgccttctagttcgcacttcttccttctgaaaatctcaatttttaacaggttgacagacgttcaattctgttttgaaacgcaaagtagtctgaatccacttcagagacaaatgatcccctcggatgtgggaaaacatgcaaggatttgcttttgcaagccatagtctcacaaagatgaggagttcctgacagtacatccaggctcacgtttcaaaatggagaattacaatgcaacatgttgacagtactaggatgtggctgccrttccttactttgtttgcttccttcaaaagaaagtgctttttttttttttaatgttgggggcttaaaagaggagtgaaaggtgaaacaaagggttatacagacaagttttgtgcatttctaactttgcactggaaatctactcctgacttactgcagtcatcttgaagcttaaaatccaagatcactggccttgctgattttccttctatcaatgaccacaaatgccccagtctcaaaaccccagcatcattgttgaccagtatgatcatatgttcaatttgcctaggaaagtcccagttt

SEQ ID NO: 141801 - DNA, 601 bp, Human
ggtaatgctaggaagatcttatacacggcattgatcaagctttttctaatgcctggaaagtgccacataaatcacctaaaatgtcaaataaaagcctaaatgacatatttaattataaaaattatgttttatgattaccctggctcagtagattttggtttaattgcctctctgaaaagtcccaagctaactgataattaatgaacaaattctttttgatctataatgaaatcatagattataggggttcccacactcatgccttctagttcgcacttcttccttctgaaaatctcaattkttaacaggttgacagacgttcaattctgttttgaaacgcaaagtagtctgaatccacttcagagacaaatgatcccctcggatgtgggaaaacatgcaaggatttgcttttgcaagccatagtctcacaaagatgaggagttcctgacagtacatccaggctcacgtttcaaaatggagaattacaatgcaacatgttgacagtactaggatgtggctgccattccttactttgtttgcttccttcaaaagaaagtgctttttttttttttaatgttgggggcttaaaagaggagtgaaa

SEQ ID NO: 141802 - DNA, 601 bp, Human
gattcttctcttccccccattagcaaatccaggtctgattccagatcattttgtgagcttgaaactgcctaccctgttctaacctcatatgacaagttactcatctatttgggggtaatgctaggaagatcttatacacggcattgatcaagctttttctaatgcctggaaagtgccacataaatcacctaaaatgtcaaataaaagcctaaatgacatatttaattataaaaattatgttttatgattaccctggctcagtagattttggtttaattgcctctctgaaaagtcccaagcyaactgataattaatgaacaaattctttttgatctataatgaaatcatagattataggggttcccacactcatgccttctagttcgcacttcttccttctgaaaatctcaatttttaacaggttgacagacgttcaattctgttttgaaacgcaaagtagtctgaatccacttcagagacaaatgatcccctcggatgtgggaaaacatgcaaggatttgcttttgcaagccatagtctcacaaagatgaggagttcctgacagtacatccaggctcacgtttcaaaatggagaattacaa

SEQ ID NO: 141803 - DNA, 601 bp, Human
gtttaactatttttttaggtcttcatttccttatgaagactcctgtgtcatttagattaaaggccagatgtggtggctcacatctgtaatcccagcactttgggaggctgaggctgaggatcacttgagcccaggagttcgagaccagcctgagcaacataatgagacctcacctttatgaaaaatttaaaaaattagccaggtgtggtggtgcatggctgtgcatgcccagttacttgagaggctgagctgggaggatcacttgagcctaagaggtcgaggctgcagtgagctgtgatcrtaccactgcactagaacctgggcaacagacagaccttatctcaaacaaacaacaacaacaacttgtattaagtaaatttgcatgcttttctctcattaaactatctcttgttataggggcctcagctgtgaacctaggatggaagaggaaaagattcttctcttccccccattagcaaatccaggtctgattccagatcattttgtgagcttgaaactgcctaccctgttctaacctcatatgacaagttactcatctatttgggggtaatgctaggaagatcttatacacggcattgat

SEQ ID NO: 141804 - DNA, 601 bp, Human
aaaatatggcaccttgtcatttgagaaaaagcagaaatgggatggtcactctcatttcacccacctccccttctcccatgaagcaggtcataagaccctcatgggagaggtaccctctctttacctaaagaaaagtgcctaagacacagatgccaagaagaacctgaacaaacaggccttgctaagttccccccacttattaccattagatcagacctttatccaatcatacgtctccatgactgttcactcttcaacagacttagcatagaaacacagaagtttaactatttttttaggycttcatttccttatgaagactcctgtgtcatttagattaaaggccagatgtggtggctcacatctgtaatcccagcactttgggaggctgaggctgaggatcacttgagcccaggagttcgagaccagcctgagcaacataatgagacctcacctttatgaaaaatttaaaaaattagccaggtgtggtggtgcatggctgtgcatgcccagttacttgagaggctgagctgggaggatcacttgagcctaagaggtcgaggctgcagtgagctgtgatcataccactgcactagaacct

SEQ ID NO: 141805 - DNA, 601 bp, Human
ccaggtcatgcctggccaatcccagccttctctgaacttgctctgcagtagagacagtggctgttggtgtaataaacacctgttctccacttggttcatagatacagagtgtaggacttccagctgggcttagaaatctctggatccctcacagcacctatgtagagttgtctacactcagtgaacgctctagattaagtcagggcagatggtttccaagctcattttgaactccaagcaagacttaaaatgttactatttttgttggtttttaaacagccaacgtggggaatttttttttaagtgagatatttctgaatattcccaccaagttattttgaatctgataaattctcttgtacataatgtctacaaagtaggactggagaatacaaaactgaccatggagagtcagtgtttcaaattcctgctctgggtgatgactgcctcaggcttcctggtggaccaggttccttacaaggcaagaggacataccctctccttggtgatggagttcaaaacatgctaccccaaaatatggcaccttgtcatttgagaaaaagcagaaatgggatggtcactctcatttcacccacctccc

SEQ ID NO: 141806 - DNA, 601 bp, Human
tgagtatctgggattacaggtgctcaccaccacacccggctaatttttgtatttttagtagagatggggtttcaccatgttggccaggctgatcttgaactcctgacctcaggtgatccacccgcctcggcttcccaaagtgctgggattacaggtgtataatcccattactgcacctgaccattattattttttaagaggcagggtcttgcttatagctcactgtagcctcgaactcctagagtcaggcaatctttctgccttggcctcctgagtagctaggactacagtgcaccatcaygcctggctaattggcttttttttttttttttcctttaagagacaggggtctgattatgtcacccaggctggtcttgaactcctggtttcaagagatgctcctgcttcagcctcctgaattgctgggattacaggcataagccaccacatccagcaaaacatcacctttataaagacttttcttcacatttttcaccttagaagaaaatatttaattttaaaaaataactgatatgtgataaactaagagttggtaggtgccagatatacctttttgcttttttaaagaaagcacagctgc

SEQ ID NO: 141807 - DNA, 601 bp, Human
tgaattgactatctcccctttgacagactcccttaagatacatgtgtagtggaacagcttgtaaatttgctttttgcaaaatatctatactttggaatttcaaaacatgactttcttcttcttattattattttttcgagacagagttttgctcttgttgcccaggctggagtgcagtgacacgatgtcgactcactgcaacatccgcctcctgggttcaagtgattctcctgcctcagcctcctgagtatctgggattacaggtgctcaccaccacacccggctaatttttgtatttttagtagagatggggtttcaccatgttggccaggctgatcttgaactcctgacctcaggtgatccacccgcctcggcttcccaaagtgctgggattacaggtgtataatcccattactgcacctgaccattattattttttaagaggcagggtcttgcttatagctcactgtagcctcgaactcctagagtcaggcaatctttctgccttggcctcctgagtagctaggactacagtgcaccatcacgcctggctaattggcttttttttttttttttcctttaagagacaggggtctgatta

SEQ ID NO: 141808 - DNA, 601 bp, Human
acacctaccgcatgctctgcttttctgaattgactatctcccctttgacagactcccttaagatacatgtgtagtggaacagcttgtaaatttgctttttgcaaaatatctatactttggaatttcaaaacatgactttcttcttcttattattattttttcgagacagagttttgctcttgttgcccaggctggagtgcagtgacacgatgtcgactcactgcaacatccgcctcctgggttcaagtgattctcctgcctcagcctcctgagtatctgggattacaggtgctcaccaccmcacccggctaatttttgtatttttagtagagatggggtttcaccatgttggccaggctgatcttgaactcctgacctcaggtgatccacccgcctcggcttcccaaagtgctgggattacaggtgtataatcccattactgcacctgaccattattattttttaagaggcagggtcttgcttatagctcactgtagcctcgaactcctagagtcaggcaatctttctgccttggcctcctgagtagctaggactacagtgcaccatcacgcctggctaattggctttttttttttttttt

SEQ ID NO: 141809 - DNA, 601 bp, Human
ctctccaacacctaccgcatgctctgcttttctgaattgactatctcccctttgacagactcccttaagatacatgtgtagtggaacagcttgtaaatttgctttttgcaaaatatctatactttggaatttcaaaacatgactttcttcttcttattattattttttcgagacagagttttgctcttgttgcccaggctggagtgcagtgacacgatgtcgactcactgcaacatccgcctcctgggttcaagtgattctcctgcctcagcctcctgagtatctgggattacaggtgctmaccaccacacccggctaatttttgtatttttagtagagatggggtttcaccatgttggccaggctgatcttgaactcctgacctcaggtgatccacccgcctcggcttcccaaagtgctgggattacaggtgtataatcccattactgcacctgaccattattattttttaagaggcagggtcttgcttatagctcactgtagcctcgaactcctagagtcaggcaatctttctgccttggcctcctgagtagctaggactacagtgcaccatcacgcctggctaattggcttttttttt

SEQ ID NO: 141810 - DNA, 601 bp, Human
taatcccagcactttgggaggtcgaggcaggcagatcacaaggtcaggagttcgagaccagcctgaccaacatggtaaaatcccgtctctactaaaaatacaaaaagtagctggatgtggtggtgcatgcctgtaatcccagctactcaggtggctgaggcaggagaatcgcttgaacctgggagtcggaggttgcagtaagccgagatcatgccattgcactccagtctgggtgacagagtggactccgtctcaaaaaaaaaaaaaaaaaaaaaaaaaaaggccaatgaagcagcattakccctggttcacagaggaggcaggggagaaccaggaggttgaggatctggtctcaaacccaccctagcaagcgaactcccagtatagtttgtttccattaaatcttctcatgggtctgtgtttgactttcattgctataccttggctcgtacacatgcttttaatcagatctgagtagccagctaaataatgtgggaaatcaaaagcacatactgaggggtatagaagtgatcacctctttcacacacaaaaaccacagcacttttcacaatctgcctgacattagctccttgagagggtt

SEQ ID NO: 141811 - DNA, 601 bp, Human
aactctctaggcactagtaaagggtaacctgatgtcatctcatttttgatgttactgaaaggagaggtccttggcagccttggcccttgggactgagggatttggcagcctacaggctcaggagagactggctggggatgggctgcccctccaggccctttttcctttgctttccagaatcttcctcccctttggccaggtagtaatgccaactagcagaacatgaaggatctattctaagattgatgcttgttcccaaattaaagtgtattccaatggaagaaatagatattttatcagraagaaagccacatcctcagcacagcagtattgatccccagatttaaggaaaagtaaaaagtccaaacaatcgtaatcagagagtggagaagatattaagagttcgtgaggtgcagtcctcacttaaaaggccgatgaaggtcgggcacggtgggtcatgcctgtaatcccagcactttgggaggtcgaggcaggcagatcacaaggtcaggagttcgagaccagcctgaccaacatggtaaaatcccgtctctactaaaaatacaaaaagtagctggatgtggtggtgcatgcctgtaat

SEQ ID NO: 141812 - DNA, 601 bp, Human
tcctgctgtcacctcttgctgtgcagcccagtacttcttctttttttttaatgtaattttttgtttaaagaaggggtcttgccatgttacccagactggtcttaaactcctgggctcaagtgatctgcccacaatggcctcccaaggtgctgggattacaggtgtgagccaccatgcccagccctagtcctgaatatgaagacacaaataggttaaaagtaaatggatgggggaaaaaaatcccattccaacactaatcaaaagagagccaaagaggtaataataatattagacaaagtasatttcagagaaaagaatattgctaggaacaaagagagccatttcataatgctataaggtttcattaatcaaaagagtgcagcccagttcttaaccaggggttggggacccctgctctaggtatctcatagaagtggaataaaaagtgttttgttttttttttgtgacaggcttatatcgcttagcataatggcctcaaagttcattcattttgtagcatgtgtcagaatttccttgcttttaaaaaatatatactttttttaagggaaattttagtatcatagcaaaactgagaggaagg

SEQ ID NO: 141813 - DNA, 601 bp, Human
tctgctaaaaatacagaaattagccaggtgcagtagtacgcacctgtggtcccagccactcgggaggctgaggtgggaggatggcttgagcccaggaggtgggggttgcagtgagcagagatcgaccactgcactccagcctgacagagggagaccctgtgtcaaacaaaacaaaacacggactccgtgttccccccggcaactactttctgtctttgtaattttgaatactgtagatcatggtagcaaaagtagaagtagccccttctactttctgtctttttaattttgaatactatasatcatggtccccagcctttttggcaccagagaccagtttcttggaagaaaatttttccatggacgtgggctgggtgcggggatggtttcgtgatgaaatcattccacctcagatcatcaggcattagattctcctaaggagtatgcaacctaaatccctggcatgctcaagcagtaatgctcactcatcctgctgtcacctcttgctgtgcagcccagtacttcttctttttttttaatgtaattttttgtttaaagaaggggtcttgccatgttacccagactggtcttaaactcctgg

SEQ ID NO: 141814 - DNA, 601 bp, Human
tattgtcccagagctatcctttcccgtcagatcccaaaggcccactcgtttctcactgctttccactcccagtgccaaagtactgactcatagcatttttggctaaaagggaaggaactgaattttcttttttacttttaaaaagatgctgagctggctcctcagtcaagtgctgatgattcactgcgaacaaatcccagtggcgaaaggccaatcacggtcatttaccttattcaaatcttaacagctggagagcagtgagtttttgcaatgtggtaccctgcaataagggctgaaaatgacctttgtctccgcaaaggcaaccacatgcaggcggcctggttcctcttcaactggacatgaaggattctctgagcagctctggcactaagtcagctggacctgagcacactggctcttctgtgattctgggaaaaacatattacaactcaaagtgtgctgttgaaaatataacaaaatcccatctacttgggaccaataggagatacacttttattttttgtttccatagtaaaatacacataacataaagatctcctgccttaaaccatttttgagtgtacagtttagcagtgctacg

SEQ ID NO: 141815 - DNA, 601 bp, Human
tcaaacaaccaacatgtaatatcacaattcgccacttggtgtcactagacctccaggaaactcaaatttacacttaccctgacaagagattacgttagatttccacacctttttttctgtaaggccccatttcacacaaagatattacaaaatgacaacggcatgaattatcggaatgatggaactatcttctaaaagggtagtaaactcaggttaactcccaaacagaatacacacctattaccttactagtaagagtaataaccaccaattattgagcaccagccacagtgctaagtgytctacctatattgtcttatctaatcctgaaaacacgatcttcctttaatggtagttgtctttatttttaaaatgagaaacctgagctctgcagaggttaataacttgccaagctgttcccagtacccaatctcacatacagatctctgctaagccatgaggccacaaaacagaagctatgtttttggtctggagaaatattctccacctggaagacaacccttacccacaaaaaggcagtagcccaagggctgtcaacgaagtgccaagcgactttccaatgactattaaaagtaaaaga

SEQ ID NO: 141816 - DNA, 601 bp, Human
tcaaaagatggctagagtggaaaaacaaaggacctttgaacctaatttgatgtaagaaatgaggaaaagggaggccccatcccatagaccatcatggctcaagcacaccctgtatcctgtatcctgatgacacgcagcctcctggtgcagtcctgacctttctctctcatctcctctgtccactgcatctcaccagtcacaaaactcccagtcctcatgctgtacaaatgcattattattattcccacatccccatgcctgctcttcctcctgtcctttgctgacatcactaataacccamttgcctgagtcagcacccagtacattctggggcccacagcagaggagcttccacgaagacagagaaagaaagatggagaaaggaatgaggatggcaggtgagggtggggctaagggaggagaggcagaaggaggggaggtggtccattagataaagaacacactgcgttctccaggtcacttagtgggggtccagtggaacccccatgaaatcctttcaatggcgaggcacatgcagaggtcagtgagctgaggagcaaaggggaggaaagaaaataccacccacttggaggatcccagg

SEQ ID NO: 141817 - DNA, 601 bp, Human
tgccatttggaacaacacatgcatgctagttcccattttaggttgaaggacatgacaccgaagctaagacttagagcttgatgacactcccctgagaaatgatgagatacaagaagacaggaagatgcgtgctttcatcaaaagtccacagtaggccaggtgcagtggctcacgcttgtaatcccagcactttgggaggctgaggcgagtggatcacctgaggtcgggagttcgagaccagcctggccaacatggtgaaaacctgtctctactgaaaatacaaaaattagccaggcatggygatggatgcctgtaatctcagcaatgtgggagactgaagcagaagaatctcttgaacctgggaggcagatgttgcagtgagccaagattgtgccactgcactccagcctgggcaacaagagtgaaactccatctcaaaaaaaaaaaaaaaattccatagtaaaggcactctccctgttaatgctgggccctggagctgctaacgcacctctgggatgaaatcccatccctggacctcggttgtttttattgttgttgttgtttgcacaaggacagggagcaagttacaaataattcctgt

SEQ ID NO: 141818 - DNA, 601 bp, Human
tggttgcacaacattgtggacatacttaatgccgcaaaactcaacacagcatgagcaacagcggtgaccagtgagggtcacctgtttgggctttgggctctctacagagcaccttcatctgacacttcctccagcagaattccccttagcttccttttcctgaacatcagatgaagttgctcctacttgcaattactactgtctacaagtctacggcagaaagtcaaattagcactaacagcttgcacactgacaatacaacaatagcattatattatagcccacctgactgttgatctaytggaatttctctgaaattcaattacaaggggcagctgcaattattctctcacaaaggagggctgcgagattgggtactgacacaccaagtttctgatttacaagtaattctctcagcagatcatagattctcaggcttactttctaagagaaaaaaaaaatgaaagaacaaaacaagaagaaaaaaccttacccagtcccagcatagaggacatttctacaaacaatggcctttgagcacaaactgaagaaagagtttttctcaggactgtaccgacctcccaacccatggcattctccc

SEQ ID NO: 141819 - DNA, 601 bp, Human
tatatgaggtacctagaatagtgaaattcatagagacaagaggtggaattacggttgccaggggctggagtgaggaggaatagagagatagtgtttaatgagtctgcagcttcagttgaagaagatgaaaaagttctggagatggatgatggtggtggttgcacaacattgtggacatacttaatgccgcaaaactcaacacagcatgagcaacagcggtgaccagtgagggtcacctgtttgggctttgggctctctacagagcaccttcatctgacacttcctccagcagaattccccytagcttccttttcctgaacatcagatgaagttgctcctacttgcaattactactgtctacaagtctacggcagaaagtcaaattagcactaacagcttgcacactgacaatacaacaatagcattatattatagcccacctgactgttgatctattggaatttctctgaaattcaattacaaggggcagctgcaattattctctcacaaaggagggctgcgagattgggtactgacacaccaagtttctgatttacaagtaattctctcagcagatcatagattctcaggcttactttct

SEQ ID NO: 141820 - DNA, 601 bp, Human
aaacatccaagaatgatcaataaatactaaaaaaaatttaaaaaaaaaagtaaaaaataaaaatacaaaagttagctgggcggtggtacattgctgtggtcccagctactcaggaggctgaggcaggagaatcacttgaatctgggagacggaggctgcagtgaccaggatcacgccactgcattccagcctggatgacagagcaagactccgtctcaaaaataaataaagtaaaaataaaatttaaaaaaaaaaatgaatgaaaattctgacacatgctacaagatggatgaatcctgakgtcattatgctaagtgaaatgagtccatcacaaaagacaaatattgtatgatttcacttatatgaggtacctagaatagtgaaattcatagagacaagaggtggaattacggttgccaggggctggagtgaggaggaatagagagatagtgtttaatgagtctgcagcttcagttgaagaagatgaaaaagttctggagatggatgatggtggtggttgcacaacattgtggacatacttaatgccgcaaaactcaacacagcatgagcaacagcggtgaccagtgagggtcacctgttt

SEQ ID NO: 141821 - DNA, 601 bp, Human
gttaatctataaccttaccctcaaccccgtgctctctgaaacatgtgctgtgtccactaagggttaaatggattaagggtggtgcaagatgtgctttgttaaacagatgcttgaaggcagcatactcgttaagagtcatcaccactccctaatctcaagtacccagggacacaaacactgcggaaggcggcagggccctctgcctaggaaaaaccagagacctttgttcacatgtttatctgctgaccttccctccattattgtcctatgaccctgccaaatccccctctccgagaaacayccaagaatgatcaataaatactaaaaaaaatttaaaaaaaaaagtaaaaaataaaaatacaaaagttagctgggcggtggtacattgctgtggtcccagctactcaggaggctgaggcaggagaatcacttgaatctgggagacggaggctgcagtgaccaggatcacgccactgcattccagcctggatgacagagcaagactccgtctcaaaaataaataaagtaaaaataaaatttaaaaaaaaaaatgaatgaaaattctgacacatgctacaagatggatgaatcctgaggtcat

SEQ ID NO: 141822 - DNA, 601 bp, Human
gttattcacttggttgtaagcgatgtttccacatttaaaaatatttacttttttaaggatctcagtttaccagttgctgtgcaaaggacagaaagagaaaattcttgctcagggaaaccttgaaatgtcctcccacaaagaaaagatcattagaaagcagctaaagaatggttaagaaaccacattgctcctctcctcttttaggaagactgactggaagccactgagaatcaactatgcttaatccctctgcatccagaccccttccactcttaggggtggagtagagcacttgtattcyctcactctctctctctctctcagccgttttgttttgtgctgtgcccaatcttagaaatactgttcagagccatatacaaataaaaacaagaacaataagagactgtaagggatctgaacttctcattccaaagagaggagggccacagggagagttcctagacatttgaaacaagatgtcaggagatcaggaaatgctgaggaaaaacagaaagctcaaggtaaagagacaaacaaaacaaacacatgaaacaagaaacatgaaaaaacttttttgaaaatacaattcatttgaaaatgg

SEQ ID NO: 141823 - DNA, 601 bp, Human
ctgaggcatgtggccggaaatatttgttttcatctcataaattcaaatctttgtaaaccatttgctagaacatactttttattttgcttgcatccaagttttcctacacatacaaaaatctgagcatcaaaaagaaacattcttggaagctatgacttccacgggttccgtaaattgaaatctatgggccaaatctttttgtacagcccttgagctaagaatggtttttacattttaaaatggttggaaaaaaaaaaaaaaaaactcaagcgaagaatcacattttgtgtcaggtaaaaayggtaggaaattcaaatttcagtgcccatgaataaagtcttaggaacacagccatgctcgcttgtttacataacgtctatggcagctttccagatacaaagacagagttgagtagttgcaacagagatcatatggttcacaaagcctaaaatatttactctctgacccttttcagaaaacgtttgctgaccgctgacttaagccataacttaagttgctctaacatgaaatctgcaagttcctttacatcatgccctagaagacactgttctgagatcaccagtgcagttctttactcctt

SEQ ID NO: 141824 - DNA, 601 bp, Human
taatataggattgtgaaggggaaaaaaagaaacaattttcactaacaatgaaaccataagaattccaggagcattttgtaaaagaggaaatgaacatgcaaattgcatgaatgcaggatttaagatttcataggcagtgctagagtttttaaacttccgtcttcctttcctacttggcaggctcactttgctacctaaaattctgccttcaggaagacattaaatcagcaaacctaattacactgaggcatgtggccggaaatatttgttttcatctcataaattcaaatctttgtaaacsatttgctagaacatactttttattttgcttgcatccaagttttcctacacatacaaaaatctgagcatcaaaaagaaacattcttggaagctatgacttccacgggttccgtaaattgaaatctatgggccaaatctttttgtacagcccttgagctaagaatggtttttacattttaaaatggttggaaaaaaaaaaaaaaaaactcaagcgaagaatcacattttgtgtcaggtaaaaatggtaggaaattcaaatttcagtgcccatgaataaagtcttaggaacacagccatgctc

SEQ ID NO: 141825 - DNA, 601 bp, Human
gaaaagcaatttctttttagatagaaaaatacttctagaaccaggaaatagtagttaaattattactactgcatgaagttaaacttggagaggactatctttttcagattaaaactactttaaaaatgcaataaaatcctcttgtatcaaattataagaagataagtggcaataatcaagaattattatggcccattttctctgcagaacttctggaaactaattaaatttgtaagataagggggtgtataaaattgcagaattaaagacattcaaaaggaatatgccgtgaagtgccagrtttggagaatttgtaatataggattgtgaaggggaaaaaaagaaacaattttcactaacaatgaaaccataagaattccaggagcattttgtaaaagaggaaatgaacatgcaaattgcatgaatgcaggatttaagatttcataggcagtgctagagtttttaaacttccgtcttcctttcctacttggcaggctcactttgctacctaaaattctgccttcaggaagacattaaatcagcaaacctaattacactgaggcatgtggccggaaatatttgttttcatctcataaattca

SEQ ID NO: 141826 - DNA, 601 bp, Human
tttgagaaaagcaatttctttttagatagaaaaatacttctagaaccaggaaatagtagttaaattattactactgcatgaagttaaacttggagaggactatctttttcagattaaaactactttaaaaatgcaataaaatcctcttgtatcaaattataagaagataagtggcaataatcaagaattattatggcccattttctctgcagaacttctggaaactaattaaatttgtaagataagggggtgtataaaattgcagaattaaagacattcaaaaggaatatgccgtgaagtrccaggtttggagaatttgtaatataggattgtgaaggggaaaaaaagaaacaattttcactaacaatgaaaccataagaattccaggagcattttgtaaaagaggaaatgaacatgcaaattgcatgaatgcaggatttaagatttcataggcagtgctagagtttttaaacttccgtcttcctttcctacttggcaggctcactttgctacctaaaattctgccttcaggaagacattaaatcagcaaacctaattacactgaggcatgtggccggaaatatttgttttcatctcataa

SEQ ID NO: 141827 - DNA, 601 bp, Human
tagatggtagtttttcctgcattctcacacatttctctctaatctgcagccatgtaagacatgcctctttcccttctgccacaattgtaagtttcctgaggcctccccagcaatgcagaactctgagtcaactaaacctctttataaattacccaattttgagtatgtctttacagcagtgtgaaaacagactaatacaatggtagtacaataatttgagaaaagcaatttctttttagatagaaaaatacttctagaaccaggaaatagtagttaaattattactactgcatgaagttaracttggagaggactatctttttcagattaaaactactttaaaaatgcaataaaatcctcttgtatcaaattataagaagataagtggcaataatcaagaattattatggcccattttctctgcagaacttctggaaactaattaaatttgtaagataagggggtgtataaaattgcagaattaaagacattcaaaaggaatatgccgtgaagtgccaggtttggagaatttgtaatataggattgtgaaggggaaaaaaagaaacaattttcactaacaatgaaaccataagaattccag

SEQ ID NO: 141828 - DNA, 601 bp, Human
tttgtttcatgacttacaaaggaaacctgcaaagggtgaactggggaggtgaattttcttatgagcctactacgcttgagacactaaaaaccaaatgcatcaggagcttgtacaggtagtatagtggggaacaatggaaatattttaattctacaatttactagacactcttattgaatgttttggtagggtaggagacataataggaagctttgcttggccatattttgtgaatgtgaagaccgggattatcaagaattggcttatgctgagaggttaaagggtatgaaatttttctggyattgttctggtcaatgataactcagaacttcaatgttctaggtgtttccagaaccacgaagtagttaaattattatcacggataacatggttagactttgtatccccacccaaatctcatcttgaatggtaatcttcaggtgtttaggaaagaccttgtgggaaatgattggattatgggggtggtttcccccatgctgttctcgtgatagtgagtgaattctcatgagatctgatggttttatagatggtagtttttcctgcattctcacacatttctctctaatctgcagccatgtaa

SEQ ID NO: 141829 - DNA, 601 bp, Human
gagtgaactaagaataggaaagcttttataggacacctccttgacttctaagatagaaacaaggaatcacgacaatgccccaagaacaagtgaatcatgggcaggaccttgcactgcagcgaatcagcagaactggattctcctcatcttgactctgtaaatcactcacagtgtgagcctagcatctctgagtgccggttttgtcttctttaaaatgataaattatactaaatgaacaatgtctcttctagctcttttgtttcatgacttacaaaggaaacctgcaaagggtgaactgggraggtgaattttcttatgagcctactacgcttgagacactaaaaaccaaatgcatcaggagcttgtacaggtagtatagtggggaacaatggaaatattttaattctacaatttactagacactcttattgaatgttttggtagggtaggagacataataggaagctttgcttggccatattttgtgaatgtgaagaccgggattatcaagaattggcttatgctgagaggttaaagggtatgaaatttttctggcattgttctggtcaatgataactcagaacttcaatgttctaggtgt

SEQ ID NO: 141830 - DNA, 601 bp, Human
aagaagggcaaacatatggtctttattcattttacatttatgccagttattacttatgccaccatgaccagttcctgattgtatgaaagagttgtttgtacagaccctggattacctggactctcttatgttctctttgtcttttctgctttgttcattgttagttgtttacattatatattcagaagagtgaactaagaataggaaagcttttataggacacctccttgacttctaagatagaaacaaggaatcacgacaatgccccaagaacaagtgaatcatgggcaggaccttgcaytgcagcgaatcagcagaactggattctcctcatcttgactctgtaaatcactcacagtgtgagcctagcatctctgagtgccggttttgtcttctttaaaatgataaattatactaaatgaacaatgtctcttctagctcttttgtttcatgacttacaaaggaaacctgcaaagggtgaactggggaggtgaattttcttatgagcctactacgcttgagacactaaaaaccaaatgcatcaggagcttgtacaggtagtatagtggggaacaatggaaatattttaattctacaattt

SEQ ID NO: 141831 - DNA, 601 bp, Human
acagcatataatagaggttttgagtataggctctggagtcagagaaacttaagtttaaaactcaattccatgaatgggagacttgagtcacctactcaacacattccttcacagagagaaggaggataatattgcatctacctcccaggatgattgaaagaatttgatgagataatgcatggacatgtcaggcccaatgcaagtgttcagagaaaagcaaataatagcagtatagcccttaagttaatgttggtgaaacataaacttccaagattactctcagagtcaactaccatggaasagagagcaaaataaatcagtggtttccagtttgtcctttccttgtactggttttacattgaaaattattctggtctaacagctgttagattcagacaaccataaggcattcaaactgcaatcaacattgaccaaagtgcatgaaaattgtattttctttccttctgtatattatccatttttcttttacatgtgaagaatacagtgcaataactaaattaagatgaactttccccttgcatcccctgaaataatattcttttcaagtacctgacaagtagatgattgaaaattccctcaa

SEQ ID NO: 141832 - DNA, 601 bp, Human
aaataatttctaatggttgatttttatttattgggtttctcacaaatcaggaatgagttgacatgattctttttttcttctacaaacttgtctcatattactgatggccttctcttacgatgtcatgattggctctgaatgtccctagtggtccagtccatttatgtacagaacatctacctagcacaggaagatgcttttgttgtttggatgagaacgtgctcatgtttacatatttttctattccaattcactttaaacaatgcagcaatatagaacagcatataatagaggttttgartataggctctggagtcagagaaacttaagtttaaaactcaattccatgaatgggagacttgagtcacctactcaacacattccttcacagagagaaggaggataatattgcatctacctcccaggatgattgaaagaatttgatgagataatgcatggacatgtcaggcccaatgcaagtgttcagagaaaagcaaataatagcagtatagcccttaagttaatgttggtgaaacataaacttccaagattactctcagagtcaactaccatggaagagagagcaaaataaatcagtggt

SEQ ID NO: 141833 - DNA, 601 bp, Human
ccaaaaaaaaatcagagctttccacaaataatttctaatggttgatttttatttattgggtttctcacaaatcaggaatgagttgacatgattctttttttcttctacaaacttgtctcatattactgatggccttctcttacgatgtcatgattggctctgaatgtccctagtggtccagtccatttatgtacagaacatctacctagcacaggaagatgcttttgttgtttggatgagaacgtgctcatgtttacatatttttctattccaattcactttaaacaatgcagcaatatakaacagcatataatagaggttttgagtataggctctggagtcagagaaacttaagtttaaaactcaattccatgaatgggagacttgagtcacctactcaacacattccttcacagagagaaggaggataatattgcatctacctcccaggatgattgaaagaatttgatgagataatgcatggacatgtcaggcccaatgcaagtgttcagagaaaagcaaataatagcagtatagcccttaagttaatgttggtgaaacataaacttccaagattactctcagagtcaactaccatgga

SEQ ID NO: 141834 - DNA, 601 bp, Human
attcatttgtttgtttactttattttaaagatggggtctctgttgcccaggctggactgcctcaacctcctgggttcaagtgatcctctgcctcagcctccccaggagctgggactacaggcattcaccactacagctggctaatttttaaaatttgtagacatggggtctcactatgttgcccaggctggtcttgaacccctagactcaagccagtcctcctgcctcagcctctcaaagtgctgggattacaggcataagccaccatgcctggccaaaaaaaaatcagagctttccacamataatttctaatggttgatttttatttattgggtttctcacaaatcaggaatgagttgacatgattctttttttcttctacaaacttgtctcatattactgatggccttctcttacgatgtcatgattggctctgaatgtccctagtggtccagtccatttatgtacagaacatctacctagcacaggaagatgcttttgttgtttggatgagaacgtgctcatgtttacatatttttctattccaattcactttaaacaatgcagcaatatagaacagcatataatagaggttttgagt

SEQ ID NO: 141835 - DNA, 601 bp, Human
gagtgaaaggataaaaatcagattatttattgttttatttattcatttgtttgtttactttattttaaagatggggtctctgttgcccaggctggactgcctcaacctcctgggttcaagtgatcctctgcctcagcctccccaggagctgggactacaggcattcaccactacagctggctaatttttaaaatttgtagacatggggtctcactatgttgcccaggctggtcttgaacccctagactcaagccagtcctcctgcctcagcctctcaaagtgctgggattacaggcataarccaccatgcctggccaaaaaaaaatcagagctttccacaaataatttctaatggttgatttttatttattgggtttctcacaaatcaggaatgagttgacatgattctttttttcttctacaaacttgtctcatattactgatggccttctcttacgatgtcatgattggctctgaatgtccctagtggtccagtccatttatgtacagaacatctacctagcacaggaagatgcttttgttgtttggatgagaacgtgctcatgtttacatatttttctattccaattcactttaaaca

SEQ ID NO: 141836 - DNA, 601 bp, Human
ggccacatcttctctgcccaaatgttaaaaaaccaccagggccatttaaaactattagaaatgttagctttagttggaaggaagcagagtaaataaaactcagcaatctggggaaaaggggtttaggacatcagagtgaaaggataaaaatcagattatttattgttttatttattcatttgtttgtttactttattttaaagatggggtctctgttgcccaggctggactgcctcaacctcctgggttcaagtgatcctctgcctcagcctccccaggagctgggactacaggcattcaycactacagctggctaatttttaaaatttgtagacatggggtctcactatgttgcccaggctggtcttgaacccctagactcaagccagtcctcctgcctcagcctctcaaagtgctgggattacaggcataagccaccatgcctggccaaaaaaaaatcagagctttccacaaataatttctaatggttgatttttatttattgggtttctcacaaatcaggaatgagttgacatgattctttttttcttctacaaacttgtctcatattactgatggccttctcttacgatgtcatgat

SEQ ID NO: 141837 - DNA, 601 bp, Human
gaatactctctctctaaaaataaaaatccaccatgtgcagtaattttccttctggccacatcttctctgcccaaatgttaaaaaaccaccagggccatttaaaactattagaaatgttagctttagttggaaggaagcagagtaaataaaactcagcaatctggggaaaaggggtttaggacatcagagtgaaaggataaaaatcagattatttattgttttatttattcatttgtttgtttactttattttaaagatggggtctctgttgcccaggctggactgcctcaacctcctgggytcaagtgatcctctgcctcagcctccccaggagctgggactacaggcattcaccactacagctggctaatttttaaaatttgtagacatggggtctcactatgttgcccaggctggtcttgaacccctagactcaagccagtcctcctgcctcagcctctcaaagtgctgggattacaggcataagccaccatgcctggccaaaaaaaaatcagagctttccacaaataatttctaatggttgatttttatttattgggtttctcacaaatcaggaatgagttgacatgattcttttttt

SEQ ID NO: 141838 - DNA, 601 bp, Human
gtaaggtgctttacaggaatcttggcatgcagataaagttacaaaagtcaggcttcaaacccagagaaccaaacccaacccataaaatctgtgtcaggcaacatcctcagatagagtcaggatttaaaaatgtgtttaaagcaactcattgttctcttataattttgttgactcttactcaacatgcacacaaatgcattctggtgctatgactttccctcttgatgttttttagaaggagcctgggatgagtgctgagacctatgatgtgtgaggccctaagagagacttgacacatgaygttacatcaatttctcacaaggactctttggtaaaatcagattattaaaaagttttgcaagaaaattataagtatcaaaagtattggcatatatttgagagctaaaaacataaagataaatcactttgcctggtatgttcttgtgcactggcttgctgcctgagattgtgtaaaataatattcccaaagccatggaagtatgcttttgccaggaacatttgtaaaggtcacttaacgttaaagtattgagtctgttgctttaaatatttttatttcttgtttgaatctacttctctgcat

SEQ ID NO: 141839 - DNA, 601 bp, Human
caaaacaccattaatagaataggtttggggcaaaataaacttggagcaaagggaaagagtcactaatcagctagtgtaaggtgctttacaggaatcttggcatgcagataaagttacaaaagtcaggcttcaaacccagagaaccaaacccaacccataaaatctgtgtcaggcaacatcctcagatagagtcaggatttaaaaatgtgtttaaagcaactcattgttctcttataattttgttgactcttactcaacatgcacacaaatgcattctggtgctatgactttccctcttgaygttttttagaaggagcctgggatgagtgctgagacctatgatgtgtgaggccctaagagagacttgacacatgacgttacatcaatttctcacaaggactctttggtaaaatcagattattaaaaagttttgcaagaaaattataagtatcaaaagtattggcatatatttgagagctaaaaacataaagataaatcactttgcctggtatgttcttgtgcactggcttgctgcctgagattgtgtaaaataatattcccaaagccatggaagtatgcttttgccaggaacatttgtaaa

SEQ ID NO: 141840 - DNA, 601 bp, Human
gtaacaaatattgaccaggtgccttggcttggccacctaatagatgtgtgactttggacaactatttaacatcttcaagcctcagtttcctcatatgtaaaatggacctaccaatgcttaccctgtagggtttcatgcaggttcgatgagataatgtatgtagagtaatcagttccatgcctggcttacagagaacaccagggatgagcagctactgctgtcagtgctgatactagtaaggcatagtaggtaggtctctgagtgaccatctgtctgagtgatttggggctattatttaagratagaatactaaacttaaatatctgggaaagagaggtatgaagaatagagtttacttagaaggtttccaatcctggtcttttgccaagttaataccacatcagtcctattcctctggtttctctcattaagacatcctttactgttgtctacctcctttttagaatagctcacctacttgcccctctttcacttaaggaattaaaggatagtccaagaaaataaaaactgtgacacagtagtttctctggagaggatacaaataaactctggtctgaacccagaagctaacctaaatcaa

SEQ ID NO: 141841 - DNA, 601 bp, Human
ggtgttttccattgtatcagagacaccaaaatattttgctgtcatccatttaaataatatattttaagcaagagaataaaccatcacagaagtaaaaacgaataaattcattccatctattgcaattatcgagtatggcacattatttctgttttaactttctttttctttaaaatacttcatttgtaatttcttaaacttcttaataccagttaaagatggcaggcttaaacgttctgtagctaacagtttaatgagatgctctttaccaaaaaggaatgcttacactgctttttttttwaaaaaaaatctagttacctatgtatctaaggtgccaagtcaacaaccttcctctttctgcacaattcgtaatgtgaccattataattagctttcagttaaaacttggcacatatggggctcctcgtcctgccaaaactaaattgagaggaggttcctcttccaatttcattccatacttggcttcttctctccattcttagcaatgaacatttttatgccacatgatattataagtcaaccactgtgaatttttctgtcctataatcatgtaattccatatgtttctggttctaaaatat

SEQ ID NO: 141842 - DNA, 601 bp, Human
aggtgttttccattgtatcagagacaccaaaatattttgctgtcatccatttaaataatatattttaagcaagagaataaaccatcacagaagtaaaaacgaataaattcattccatctattgcaattatcgagtatggcacattatttctgttttaactttctttttctttaaaatacttcatttgtaatttcttaaacttcttaataccagttaaagatggcaggcttaaacgttctgtagctaacagtttaatgagatgctctttaccaaaaaggaatgcttacactgcttttttttwaaaaaaaaatctagttacctatgtatctaaggtgccaagtcaacaaccttcctctttctgcacaattcgtaatgtgaccattataattagctttcagttaaaacttggcacatatggggctcctcgtcctgccaaaactaaattgagaggaggttcctcttccaatttcattccatacttggcttcttctctccattcttagcaatgaacatttttatgccacatgatattataagtcaaccactgtgaatttttctgtcctataatcatgtaattccatatgtttctggttctaaaata

SEQ ID NO: 141843 - DNA, 601 bp, Human
attctccaagtctgagacttaaagaacagaacaaacaatgatccatcttgggcagtttttttttttttttggcaagcgggaaatgaaacgtgatgaaattttgatgttctttccaacactgagactccaagaatataaaaggaatgcaatgattgttagagaaaagtaactgtcatcacccagcacaaaaaggcaggggcaagtcacctcagtgccaagcaacatgcattcatttacctctcacttttcagtgattgaaatgagagaatttgttgaactaacagaaactctgatgttttcygtgctttctgttcgaaatcatgtaaccactttcctgctcacaacttcccattggaaaaggtaggtatggtcagtagatcacattcaactttataaaaccgctccttgctagaagtcttcttaaagagttgatagcaaaggagacttaaacacaaggttataataaagatgaatttaggataatctgtgcacttcaatgcacttcaattatccacgcgctcatgcattatcattgatacagaggtagctgtaatgtattccaactaacaagaaagaataacagagggagatttataaccct

SEQ ID NO: 141844 - DNA, 601 bp, Human
caaacattctgatgatgtatctccgatagatgaaaaatattgatttttaaaggaaacacattcccactcccaccatttgcatttgagaacatctgattgctaaccacatcctactcatcggtgtgtgcatatttcacgccacttctatgtggaaaaataaccatcatcaaaactacaacaggttttaagcaggttgctagccaatgctcttccatcagtttactgatgaccattctccaagtctgagacttaaagaacagaacaaacaatgatccatcttgggcagtttttttttttttttggcaagcgggaaatgaaacgtgatgaaattttgatgttctttccaacactgagactccaagaatataaaaggaatgcaatgattgttagagaaaagtaactgtcatcacccagcacaaaaaggcaggggcaagtcacctcagtgccaagcaacatgcattcatttacctctcacttttcagtgattgaaatgagagaatttgttgaactaacagaaactctgatgttttccgtgctttctgttcgaaatcatgtaaccactttcctgctcacaacttcccattggaaaaggtaggtatgg

SEQ ID NO: 141845 - DNA, 601 bp, Human
gcccatgaaagcttaaaaacacaggggatttaagagggaggctgtaatcactgaggaagataaactgaagggcttcaagagagatgtcagaagctctgatattctacttggtttaaaagcagaccatttgaattcagaacccaccctccatttcactcctctctctgactccaacccaatcctgttcatctttaccttcatgacaccatagcttcttctagcatcatctcaatcaaccccctatggccattttcattttacatttcatttacagaaagtatttactgaatgcctaccacgytccaatcagcatctggcagaaatgaagaagtcatgatctccacccaaatgtgaacaattaacccaaaagaggagtatctcctaaagtgtggatgattaatacgttttgtgcaaaagagagttctaaagccaaacagatttggaaaatatttgtttccaaattctcaaaacccttaatgttctaatgtacaccatgatgtcaaagaagagatagaaaaatccagtatttcccaaacttatttgattccagaacttttttctcacacagcatcatgcagacagatactgttcctcagagtgc

SEQ ID NO: 141846 - DNA, 601 bp, Human
cccacctaatggaatcaacagggcagcttccacagaggaatttcaaaagaggggttcgagcatctgttactagtaagaaacatgttccatttcagttctgcaggaaaacaggataaggaaaatagaaccagtaactgtcacatttattacttgatatatcaacaggctctgaggtaagagccctttgtttccataatagaggaggtgcagtgcccctttcctcttcggaatgtaatactctttgatagcaacacaagtcagcatatggttttaacaacaaatatgtttagtaattgatgcygtcatatacacacgataatcaccaaagaaaaatacttctctcatgatatgaacatcacctcctttaaacccattctacctctagttgaaagaaaaatgaaactcttttaaaaataataataaataaattaagctattgcttaggcttagagagattatggtaagtgtatgcccaccacccaagctctgccaaactctaaaactcccaggccacccaacttcttcttgccatgcaaaaggcaagttttaaggcaaccttttgatatttactcgacttactctccaatgagaactttaagaa

SEQ ID NO: 141847 - DNA, 601 bp, Human
acatcacctacaagagaaaagcatggcactcagcaagggtggtagaacagcaattacaacaatgcaaccccacgagcagacatctgcataaagccccttcccacctaatggaatcaacagggcagcttccacagaggaatttcaaaagaggggttcgagcatctgttactagtaagaaacatgttccatttcagttctgcaggaaaacaggataaggaaaatagaaccagtaactgtcacatttattacttgatatatcaacaggctctgaggtaagagccctttgtttccataatagagkaggtgcagtgcccctttcctcttcggaatgtaatactctttgatagcaacacaagtcagcatatggttttaacaacaaatatgtttagtaattgatgctgtcatatacacacgataatcaccaaagaaaaatacttctctcatgatatgaacatcacctcctttaaacccattctacctctagttgaaagaaaaatgaaactcttttaaaaataataataaataaattaagctattgcttaggcttagagagattatggtaagtgtatgcccaccacccaagctctgccaaactctaaaa

SEQ ID NO: 141848 - DNA, 601 bp, Human
acaaatccctcagctaaaaaccgtgaaaaaaaaattaaaaatgtagaattccacaccatcattttctacataacatcaatttaattattaagtggttataaattagacattagttacttattcttctaaatgatttaacttttccaattctcatttcatctgttttccatatttaaaaaaaaaatcaaagaaatccaagatatggaaaagacacgctgggtgaggatctgaaactgatttggtagctttggagttgacataatcttggcctggtgcagctcattttcgaaagctgcctcaratttcccctggttttgaactttttttttccttaccactttcatctagcaagaaatcatcctggtaacggaacttctccggtccacatgcaataaaaatgtcatcatcaccaaaaaagtcctgaaggcacatcacctacaagagaaaagcatggcactcagcaagggtggtagaacagcaattacaacaatgcaaccccacgagcagacatctgcataaagccccttcccacctaatggaatcaacagggcagcttccacagaggaatttcaaaagaggggttcgagcatctgttactagt

SEQ ID NO: 141849 - DNA, 601 bp, Human
agaaacatcctaaattattttatgatgacaaatccctcagctaaaaaccgtgaaaaaaaaattaaaaatgtagaattccacaccatcattttctacataacatcaatttaattattaagtggttataaattagacattagttacttattcttctaaatgatttaacttttccaattctcatttcatctgttttccatatttaaaaaaaaaatcaaagaaatccaagatatggaaaagacacgctgggtgaggatctgaaactgatttggtagctttggagttgacataatcttggcctggkgcagctcattttcgaaagctgcctcaaatttcccctggttttgaactttttttttccttaccactttcatctagcaagaaatcatcctggtaacggaacttctccggtccacatgcaataaaaatgtcatcatcaccaaaaaagtcctgaaggcacatcacctacaagagaaaagcatggcactcagcaagggtggtagaacagcaattacaacaatgcaaccccacgagcagacatctgcataaagccccttcccacctaatggaatcaacagggcagcttccacagaggaatttcaaa

SEQ ID NO: 141850 - DNA, 601 bp, Human
ccatcctctaagtcatttttaaatgaaagaattgtagttcctaaatgcatacaactgataatatgtatatatgtgtataatatagatgctatgcattaacacacatctgcagtgttggagtgagaccactcctgtgtagaacaggtgaaagtcaagtcaagtcaagtgaccacatcacttttcccattattgttaatgctcaagtgttgctcagccactatttcaaaagctcactgatttgtttttctgcattcatctaagcaaaaaattcattatcatttcaaaaagcatttccaactaygcagaatttgggttgtcagtaaatatgcaatactcccataattaaattagagtaacattatcaaagaagggctacaataatctttgtttggtagaataatcttacctgtgatagtgctaagattctcagatgattaatagtatcaaaaatatcattcttaaagccacaacatttcacattcatttcctaagacatgtatttccctctttataaccatcccctctttatctattacagagtagcacatttagtttgttaatggaaggaagctaacttctcttttctgatacctcacagatg

SEQ ID NO: 141851 - DNA, 601 bp, Human
aatggtgcgatctcggttcaccgcaacctccgcctcccaggctcaaccattctcctgcctaagcctcctgagtagctgggattacaggcatgcaccaccatgcctggctaattttgtatttttagtagagacggggtttctccatgttggtcaggctggtctcgaactcccaacctcaggtgatctgcccgccttggcctcccaaagtcctgggtttacaggcgtgagccactgcacccagcctgtgggcattgagaaataattctaagggggaaatagcaagaggaaaggggcagtgcamctactctattatggaatttctggcattttcctgttgtacttctcagaaagtctacctgctggtcatagcaggtgcacaggagtagctgcggcatcctgggtggagagcgcattggctgttgcggaggggaagcccagctgtgtgagctcacccagcctggccagcagggagaaggggccccaagtccatctggggcctagatagagaccccagagtttggaagctgtggccaactctgcttgctggtttgaaaaagacatgtattccaggtcgagtttgacaggctgttttctatatcaa

SEQ ID NO: 141852 - DNA, 601 bp, Human
atatccatgtgtttcttttggaatgggggaggacatcgttactcagcaaatgtatttcacaccaagaaagggttagggtattattcatccagggaagggatgtgaagttctcagctaagtagtttgaagtggtccttcagaaggccaaaccacaaaagatggagaaggtgtcctggggtgtgtgtgtgtgtgtttgcatgtgagcccttgtgtgcatatctccgtatataatctgtgtgcattcttttttattcttttatttatttatttatttgagacagagttttgctcttgttacccmggctggagtgcaatggtgcgatctcggttcaccgcaacctccgcctcccaggctcaaccattctcctgcctaagcctcctgagtagctgggattacaggcatgcaccaccatgcctggctaattttgtatttttagtagagacggggtttctccatgttggtcaggctggtctcgaactcccaacctcaggtgatctgcccgccttggcctcccaaagtcctgggtttacaggcgtgagccactgcacccagcctgtgggcattgagaaataattctaagggggaaatagcaagaggaaa

SEQ ID NO: 141853 - DNA, 601 bp, Human
ttagtcttggggtaagttcatccaaggaagtaaaatctcaatttagatcgtttttctatttgagcccctttccttccatatccatgtgtttcttttggaatgggggaggacatcgttactcagcaaatgtatttcacaccaagaaagggttagggtattattcatccagggaagggatgtgaagttctcagctaagtagtttgaagtggtccttcagaaggccaaaccacaaaagatggagaaggtgtcctggggtgtgtgtgtgtgtgtttgcatgtgagcccttgtgtgcatatctccrtatataatctgtgtgcattcttttttattcttttatttatttatttatttgagacagagttttgctcttgttacccaggctggagtgcaatggtgcgatctcggttcaccgcaacctccgcctcccaggctcaaccattctcctgcctaagcctcctgagtagctgggattacaggcatgcaccaccatgcctggctaattttgtatttttagtagagacggggtttctccatgttggtcaggctggtctcgaactcccaacctcaggtgatctgcccgccttggcctcccaaagtcctg

SEQ ID NO: 141854 - DNA, 601 bp, Human
aggcttggagatgtagagaccacacagaaagtaggacatagagcctggatgagactgtgtcttctcaacacaatcccactattccaatactgttcctactattccattaggttggtgcaaaagtaatcacttttttttgccattacttttaatggcagaagccgtgattacttttgcagcaacctaataggttctagccctattttcttatcacccagaattagggaaagtgatcagaaccccatggtgaatggtacctgatacagcttctgtcttatttgggacatgagtcccaggaaaatggttagaatagaatatttctagaaatatttaccaagcagatcttgggtacccaacaccatggtgatccataagagaagctgaggaaatgtccattctagaatcacatacccaggaagaacaacactggactacaggcacgtctgtctggtgcagggagaagcagaactggtatttcctggagatcgggcactacacatgcacacacgtgcacaggcacacatacacgtgcacgggcatacacacacgcacacacacacgcacacgcacgctgcgtctcaaaagtcttcctgcagttttg

SEQ ID NO: 141855 - DNA, 601 bp, Human
ttaagccccacaaatgaagctacatggctgagtccagctgcaatccactaggaggtatatttcagctgaggtgtcattccccagcatcgttcactgggtaataaggaacacagtttcgaatgtgctttgacatttattgtctcatttgaggtccgttacaactcaggaaaaaaatgtgtttcagggaataggaagcaggcttggagatgtagagaccacacagaaagtaggacatagagcctggatgagactgtgtcttctcaacacaatcccactattccaatactgttcctactattcyattaggttggtgcaaaagtaatcacttttttttgccattacttttaatggcagaagccgtgattacttttgcagcaacctaataggttctagccctattttcttatcacccagaattagggaaagtgatcagaaccccatggtgaatggtacctgatacagcttctgtcttatttgggacatgagtcccaggaaaatggttagaatagaatatttctagaaatatttaccaagcagatcttgggtacccaacaccatggtgatccataagagaagctgaggaaatgtccattctagaatc

SEQ ID NO: 141856 - DNA, 601 bp, Human
aaactagccgggcatggtggcatgtgcctgtagtcccagctactcgggaggatgaggcaggagaatcgcttgaacctgggaggtggaggttgcagtgagccgagatcacgccactgcactccagcctgggtgacacagcaagagtctgtctcaaaaaaaaaaaaaaaaagttagtatgaagggtcacatctccagcctgggtgacacagcaagagtccgtctcaaaaaaaaaaaaaaataagttagtatgaagggtcacatctgacctaagtgttactgtctgcaggtacttgagcttagmacactgcctggtacatagtaagttagcttattgaataaatgactgcatgagtgaaagaatggatggattttgttagcagtagctcaaaaactagtttgtgaggaggtgtggtctttgtcctgactgtgagcatcttccagtgtttccattaaccttctggtttcctagcatcaccagcctcaggacaaagcagcagggccatcaggtctctttaacccaaatcaacatgggcacggagagagggaagcatttaccaagggctgggactcctgaacactgtcacttttagaagtctgattg

SEQ ID NO: 141857 - DNA, 601 bp, Human
attaaacgtctgtatggatagcctggccaacagggcaataacccgtctctactaaaaatataaaaactagccgggcatggtggcatgtgcctgtagtcccagctactcgggaggatgaggcaggagaatcgcttgaacctgggaggtggaggttgcagtgagccgagatcacgccactgcactccagcctgggtgacacagcaagagtctgtctcaaaaaaaaaaaaaaaaagttagtatgaagggtcacatctccagcctgggtgacacagcaagagtccgtctcaaaaaaaaaaaaaaataagttagtatgaagggtcacatctgacctaagtgttactgtctgcaggtacttgagcttagcacactgcctggtacatagtaagttagcttattgaataaatgactgcatgagtgaaagaatggatggattttgttagcagtagctcaaaaactagtttgtgaggaggtgtggtctttgtcctgactgtgagcatcttccagtgtttccattaaccttctggtttcctagcatcaccagcctcaggacaaagcagcagggccatcaggtctctttaacccaaatcaacatgggcacgga

SEQ ID NO: 141858 - DNA, 601 bp, Human
tgcaatatttaatattctgggtcaaagttcagcacctaagatcccctgacatctttacacataaacaatattaaacgtctgtatggatagcctggccaacagggcaataacccgtctctactaaaaatataaaaactagccgggcatggtggcatgtgcctgtagtcccagctactcgggaggatgaggcaggagaatcgcttgaacctgggaggtggaggttgcagtgagccgagatcacgccactgcactccagcctgggtgacacagcaagagtctgtctcaaaaaaaaaaaaaaaaagttagtatgaagggtcacatctccagcctgggtgacacagcaagagtccgtctcaaaaaaaaaaaaaaataagttagtatgaagggtcacatctgacctaagtgttactgtctgcaggtacttgagcttagcacactgcctggtacatagtaagttagcttattgaataaatgactgcatgagtgaaagaatggatggattttgttagcagtagctcaaaaactagtttgtgaggaggtgtggtctttgtcctgactgtgagcatcttccagtgtttccattaaccttctggtttcctag

SEQ ID NO: 141859 - DNA, 601 bp, Human
tatgcaatatttaatattctgggtcaaagttcagcacctaagatcccctgacatctttacacataaacaatattaaacgtctgtatggatagcctggccaacagggcaataacccgtctctactaaaaatataaaaactagccgggcatggtggcatgtgcctgtagtcccagctactcgggaggatgaggcaggagaatcgcttgaacctgggaggtggaggttgcagtgagccgagatcacgccactgcactccagcctgggtgacacagcaagagtctgtctcaaaaaaaaaaaaaawaagttagtatgaagggtcacatctccagcctgggtgacacagcaagagtccgtctcaaaaaaaaaaaaaaataagttagtatgaagggtcacatctgacctaagtgttactgtctgcaggtacttgagcttagcacactgcctggtacatagtaagttagcttattgaataaatgactgcatgagtgaaagaatggatggattttgttagcagtagctcaaaaactagtttgtgaggaggtgtggtctttgtcctgactgtgagcatcttccagtgtttccattaaccttctggtttcct

SEQ ID NO: 141860 - DNA, 601 bp, Human
gtaagagataaaagccactagaataatatgcaatatttaatattctgggtcaaagttcagcacctaagatcccctgacatctttacacataaacaatattaaacgtctgtatggatagcctggccaacagggcaataacccgtctctactaaaaatataaaaactagccgggcatggtggcatgtgcctgtagtcccagctactcgggaggatgaggcaggagaatcgcttgaacctgggaggtggaggttgcagtgagccgagatcacgccactgcactccagcctgggtgacacagcargagtctgtctcaaaaaaaaaaaaaaaaagttagtatgaagggtcacatctccagcctgggtgacacagcaagagtccgtctcaaaaaaaaaaaaaaataagttagtatgaagggtcacatctgacctaagtgttactgtctgcaggtacttgagcttagcacactgcctggtacatagtaagttagcttattgaataaatgactgcatgagtgaaagaatggatggattttgttagcagtagctcaaaaactagtttgtgaggaggtgtggtctttgtcctgactgtgagcatcttccag

SEQ ID NO: 141861 - DNA, 601 bp, Human
aagacaagggactatcattgatttttagaaaagaaaggagacttcattttttggaaagttgaggaaaacaggagagaagatgaggaaagatatacgtcattttggtctagaaggaaaagaaataacggagtttacagtgagtgactttgaccatagggaaggggtaggagggaagctccccttagaatgagggcagtgggtggtatttgttactctggagaccagaactaggaggactatgtgcaagctggggagacattaatttgggctcaataacttgtcaaaaatgagcactaggccrggtgcagtggctcacacctgtaatcccagcactttgggaggccaaagcgggtggatcacgaggtcaggagatggagaccatcctggctaacacggtgaaaccccatctctactaaaaattcaaaaaattaaccaggcatgatggcacgtgcctgtagtcccagctactcgggaggctgaggcaggagaatcacttgaacccgggaggcagaggtttcagtgagccaagatcgcgccactgcactccagccttggtgacagagtgagactctgtctcaaaaaaaaaaagccctagcggaca

SEQ ID NO: 141862 - DNA, 601 bp, Human
atttttctaaaaaaactgataaaaccccataattcttgtgtgttccatgtaccagttacccaatggtataacaaatgatcaggttgaagaagtggaggcttcaaggacagtcattatttattattattttttagcaatttggcagagaaagaaaggcaatgtggtttggtgagatgacagagatgactggaggctcttttaggataggaggaacctgggcctggctgtgggctgaaagaagagagactatagatagggtaaaacaaaaaatccacgaaacagtaggaacagaacactgacraggcaaggtcacaaagagaaagagaagacaaagacaagggactatcattgatttttagaaaagaaaggagacttcattttttggaaagttgaggaaaacaggagagaagatgaggaaagatatacgtcattttggtctagaaggaaaagaaataacggagtttacagtgagtgactttgaccatagggaaggggtaggagggaagctccccttagaatgagggcagtgggtggtatttgttactctggagaccagaactaggaggactatgtgcaagctggggagacattaatttgggct

SEQ ID NO: 141863 - DNA, 601 bp, Human
gttactagacagaaagcagatctatgagaaggattctttaagagagagccttgctgtgaattccatcattccaaaagaggggcgatgctccccttcacctcaataggggtttcactggaagattgtaagtgcttgatcagtgtcctctgtggacagaggcaaataacagactggtatttatgtgtttgactttcacccgagagcctctggcagaaaactgaaggaggcttggctgtactggatggcctgttgttggaggtaaaggttgcatgagtgttctgatggatttgagggcacaagktggcgtggaactaatttaaattcttcccaagaggagcatctgaggccaatagggagggctttggaaaacagggactgagagagactcagccaaagctggaagaaactgaatcaaccacattaataaagaagagcagaatgttcccagtgagagtccctgaagaacccattaaaacatccaaaagaaaagttagctttttttttttttttttttttttttgagacggagtctctctctgttgcccaggctggaatgcagtggcgcgatctccactcactgtaagctctgcctcccaggttc

SEQ ID NO: 141864 - DNA, 601 bp, Human
aagccagttgcaaatgcaataggattgaaaatgaacatttcacccagactccaaggagatgtgtatcagataccaaagtgaattgtgagacagatcctattccagaaatgtcaaagcagatataaacagttctagaccttagtcttcttactcactttgaggacataaaaggcttaagttactagacagaaagcagatctatgagaaggattctttaagagagagccttgctgtgaattccatcattccaaaagaggggcgatgctccccttcacctcaataggggtttcactggaagatygtaagtgcttgatcagtgtcctctgtggacagaggcaaataacagactggtatttatgtgtttgactttcacccgagagcctctggcagaaaactgaaggaggcttggctgtactggatggcctgttgttggaggtaaaggttgcatgagtgttctgatggatttgagggcacaaggtggcgtggaactaatttaaattcttcccaagaggagcatctgaggccaatagggagggctttggaaaacagggactgagagagactcagccaaagctggaagaaactgaatcaaccacattaa

SEQ ID NO: 141865 - DNA, 601 bp, Human
agggctaggtaagtcaattcaggaggattaatcgggttcaaacatggtgtggagagatgaaaaactgcaacaaggatggaaagttcaagcatcttcatgagtctaaatgggagatgatgaggaactgacctaagataatggcagtagcattggaaaggagggggacagatgggctatggggagtaaaagtgaggggtgagtaaaagacgactccatgttttgcaaccttggtgttgagaatgctgatgccatgagctcatccaggaaacacagaacaagaaatgaagctgaccaggtagaygatgagttcagttgtgggatgtgttgaatttcaggtggctgtggaatagtcatagggaagttcataagagaaagttggaaatgtggttctggagctcctgagaggagtcagggttagagatgtatacctcaaagggggtacatttaaagattaaggatatattgtcaaacaaagacaaacttggatttgacctctgcctttaatactatctgtgtggccttgaacaaattatttatcatctccaagccttaatttccttaattgtaaatttgggaaaattatacatccttcaaaggcttt

SEQ ID NO: 141866 - DNA, 601 bp, Human
ttacaaggatggtgatgtttgacttgaacctcaaaggacaagatggagtttggtgggtgaggaaggagaagaggaaaaagagcattccacatgaatgaggcaatatgagcaaaagcagatatttcaaaaataaatagcttttgggagaccaacaaataatactgtggttggagggcagaggaggaataaagggtgagaacagctagaaagatataacccagtcagactacaactgccctagaatagcatgccaaggagtctgtaggcagtggagggctaggtaagtcaattcaggaggatyaatcgggttcaaacatggtgtggagagatgaaaaactgcaacaaggatggaaagttcaagcatcttcatgagtctaaatgggagatgatgaggaactgacctaagataatggcagtagcattggaaaggagggggacagatgggctatggggagtaaaagtgaggggtgagtaaaagacgactccatgttttgcaaccttggtgttgagaatgctgatgccatgagctcatccaggaaacacagaacaagaaatgaagctgaccaggtagatgatgagttcagttgtgggatgtgttgaa

SEQ ID NO: 141867 - DNA, 601 bp, Human
ctgcagaggtttcctgataattaaacgtgattattattcacaagctagatgcattttaaaaaaaaatcccagaacacacagcagaatgaacaacaatggtataataaagagcaaagagctggaaaaagaatgagaaatcagtaactgattgaaaccaagtagatggagaaaggctttacaaggatggtgatgtttgacttgaacctcaaaggacaagatggagtttggtgggtgaggaaggagaagaggaaaaagagcattccacatgaatgaggcaatatgagcaaaagcagatatttcraaaataaatagcttttgggagaccaacaaataatactgtggttggagggcagaggaggaataaagggtgagaacagctagaaagatataacccagtcagactacaactgccctagaatagcatgccaaggagtctgtaggcagtggagggctaggtaagtcaattcaggaggattaatcgggttcaaacatggtgtggagagatgaaaaactgcaacaaggatggaaagttcaagcatcttcatgagtctaaatgggagatgatgaggaactgacctaagataatggcagtagcattgga

SEQ ID NO: 141868 - DNA, 601 bp, Human
aagctgcttccacatttttgggtatcttcttagcagcaccccactctactggtaccaatttactgtattagtctgttttcatgtgctgatgaagatatacccgagactgggcaatttacaaaagaaagaggtttaattggacttacagttccacatcgctggggaagcctcacaatcatggcagaaggcaaggaggagcaagtaatgtcttacatggaaggcagcaggcaaagagagagtgaagaagacgcaaaagcagaaacccctggtaaaaccatcagatcttatgagacttattcaytgccatgagagcagtattggggaaactgcacccacgattcaattatctctcactgggtccctcccacaacatgtgggaattatgggagtgcaattcaagatgagatttgggtggggacacagaaccaaaccatatcagtatgtctgtgtgtgtgtctgtgtttgtgtatcctattggttctgtttctgttgagaatcctgattaatacagcgaccttgggcagtttctcaacttctcctaacatcgctttcattattgtaaagcaacactgcagaggtttcctgataattaaacgtgatt

SEQ ID NO: 141869 - DNA, 601 bp, Human
gcaagctgtcggcagatctaccaccattctggggcctggaggacggtggccctcttctcacagctccactaagcagtgccacagtaaggactctgtgtgagggctctgaccccacatttcccttctgcattgccctagcagaggttctccatgagagccctgctcctgcagtaaacttgtgcctgggcatccaggcatttccatacaccctctgacatctcggcagaagttcccaaaccccaattcttgacttatgtgcacccgcaggctcaacaccatgtggaagctgccaagacttggrgcttgcaccatctgaagccacagcctgagctctacattaccccttttagccatggctagagtggctgggacacagggcaccaagtccctaggctgcacacagctcagggaccctgggcccaggccacaaaacccctttttcctcctaggcctccaggcttgtgatgggaggggctgctgtaaagacctctgacatgccctggagacattttccccattgtcttgggaatgaaaatttggctgctcgttacttatgcaaatttctgcagctggcttgaatttctcctcagaaaatgatagt

SEQ ID NO: 141870 - DNA, 601 bp, Human
agactaccctctccaacgtaggtaggcctcatccaatccacgaaagcctgaacagaacaaaaggtagatgaaggagaaatttacctttttccttctgtctcactgcttgagctggaacatctgatttcatcttctcctgaccttggactgggactttcatcattggctcctccaggtctcaggtccttattctcagactgaactgtaacactggctttcctgggtcaccagcttataaaccacaggttgtgggacttctcagcctccataataacacaagccatttccttataagtatatytttcgtctatttctgtgtgtgtatgtgtattagtccatgttcacactgttgataaagatatacgtgagactgggcaatttacaaaagaaagaggtttaattggactttacagttccacatggctggggaagcctcacaatcatggcagaaggcaaggaggagcaagtaacgtcttatatggatggcagcaggcaaagagagagtgaggaagatgcaaaagtggaaatccccaacaaaagcatcagatctcatgcaacttattcactaccatgagaacagtatgtgggaaaactcccccat

SEQ ID NO: 141871 - DNA, 601 bp, Human
atgattgacagatggagtagattccttctgcatctaataattcagctaatatttcctgagctgttactacattcatggtaccctgatatgtactgtgggatatatgttttaatgatacacaggaccaatctcaaggcacttacaataaagtaagataaagtacaaagtgtccaggatcctcagttttaattccaactctgttacccactgggtatgtaactgtgatggttaattttatgtgtcaaattgaatgcgccacagggtgcccagattaaacattattttggggtgtgtctgtgasgatgcttctgggtgaaattagcattagaatcagtggactccataaggtagactaccctctccaacgtaggtaggcctcatccaatccacgaaagcctgaacagaacaaaaggtagatgaaggagaaatttacctttttccttctgtctcactgcttgagctggaacatctgatttcatcttctcctgaccttggactgggactttcatcattggctcctccaggtctcaggtccttattctcagactgaactgtaacactggctttcctgggtcaccagcttataaaccacaggttgtgg

SEQ ID NO: 141872 - DNA, 601 bp, Human
tgcaatataataaattgaattcatgttaattgtctataagcccttgtgggtagtatattgagctatgctaattttcatatttgggaaccccatagcatatggtgacattttatatctcacttgagcaagaagcagctcacttttctatacactttattttttgagacagagtctcactctgtcacccagactggagtgcagtggcatgatctcagctcactgcaagctccgcctcccaggttcatgccattctcctgcctcagcctcccaagtagctgggactacaggcgcccaccaccaygcctggctaatttcttgtatttttagtagagatggggtttcaccatgttaaccaggatggtcttgatctcctgaccccgtgatccacctgcctcggcctcccaaagttctaaacactttttaaaaagcttatactaatcttctaacttctaatggtattctcaggaaaattctgttgaaaggctgtcaagtgtgaaacaaacaaataaaaaaaggtatgaaaacataaatttggctatgttaactttaaagttgaggggcaaatctataaaagcagatttttctttctccagagctaata

SEQ ID NO: 141873 - DNA, 601 bp, Human
aggctcctgcaatataataaattgaattcatgttaattgtctataagcccttgtgggtagtatattgagctatgctaattttcatatttgggaaccccatagcatatggtgacattttatatctcacttgagcaagaagcagctcacttttctatacactttattttttgagacagagtctcactctgtcacccagactggagtgcagtggcatgatctcagctcactgcaagctccgcctcccaggttcatgccattctcctgcctcagcctcccaagtagctgggactacaggcgcccrccaccacgcctggctaatttcttgtatttttagtagagatggggtttcaccatgttaaccaggatggtcttgatctcctgaccccgtgatccacctgcctcggcctcccaaagttctaaacactttttaaaaagcttatactaatcttctaacttctaatggtattctcaggaaaattctgttgaaaggctgtcaagtgtgaaacaaacaaataaaaaaaggtatgaaaacataaatttggctatgttaactttaaagttgaggggcaaatctataaaagcagatttttctttctccaga

SEQ ID NO: 141874 - DNA, 601 bp, Human
ctcttaggcctcccaaagtgctgggattacaggcgtaagccaccgtgcccagctgcaaatgtagtcttattgtcagggacctctcaggagtcttattccactcaacagtgcgccacatgctggaatttctaagctttctgctttggattgtcaagcagcccttgtaccattttccaatctgagtttgctaagcattgctgctgactgtggatggcctcttcctgggagtttcaccacaagctagcatcccccacattcactagcatattgttcagataaatgtttgttaaatagttcacamtaaagatctcaaatttgctccattttaatcaagagatgacagtttcttagaactgaaaaataatatcaccaagtagtaatatttgtccattatattacagccttgcaacatggttttcacctacatcatctcttttgatcctcatgacaatcttttgtgattggtactacttttgtctctcttttactgtggaccttaactcagagaggttaagtaatttgtccagggtcacacaggtgagaagggcaggagttggtgggacccatgacccccatctccagagctggtgctcttccaagg

SEQ ID NO: 141875 - DNA, 601 bp, Human
tgattttagaataaaagtttcctggctctgatacatttgcaaacttatagacatctactacagattggcctgtcgtctttggaaacctattgggcagaggagcggccaaaggagaagctagttagaattcttccaagtctacctgctacgggcatcttgggtcaagactcctttgcaaactgctagagaagaggtagtcaggcaagagaattgtcatcactctaaataattcagagttttgatgctggctacaaaccaaacatgagaaattatataattagcagcagcacatttaaaagamgatataaaatatgctaatgttctcaccacgtgaaggcaaagctgcagaaacgatgccatatattagctagcctaggatcagtcgaaatacagaaaaatctcttaagagcattttaaaaataatgatatcaatcagtttgatagaatgcctttcttgggctacaaaataggttaacaaaaagtcttattccattttaatgtgttttaagttactcatgtccattttcagtgcattttttgataaacagcatattatgttaattttattatctttgagtcaagaactaccttttgtgtgttt

SEQ ID NO: 141876 - DNA, 601 bp, Human
actagacccccttctagcaaaaggagaggtcattaaggaccagaatagttcgagggatcataaggatctgggtatttcagctgtgtttccaattaccacgtcacccaccatttactcaagtatcacagccgaactgcctttgactcccatctctccccagtgctccccaaagtatacttctccctgacctttccaacctgtccatgacttcttccctttaaagccccttgatgtgtgcagctgcctcatctggttcaagacctctatgtctctatgaactgctgagtctgattaaagtccrgagtttctgatgtgagataagtgggggcaaatcttttttttttttaaatggctgtctcagagcatccagcagaccgttacaaaggctttcttgtcaccgtcaagaccaagtcctggatccatggatgagtcttgaaatggaaggcttaggccgggcacagtggatcatgcctgtaatcccagcactttcggaggctgaggcaggcagatcgcctgaagtcaggggtttgagatcagtctgtccaacatggtgaaaccctgtctctactaaaaatacaaaacaattagctgggcatggtgg

SEQ ID NO: 141877 - DNA, 601 bp, Human
gacaataaattcagggaattttgatgctcacaagacagtaagaagcagaacaaatgcacatgctaaactagacccccttctagcaaaaggagaggtcattaaggaccagaatagttcgagggatcataaggatctgggtatttcagctgtgtttccaattaccacgtcacccaccatttactcaagtatcacagccgaactgcctttgactcccatctctccccagtgctccccaaagtatacttctccctgacctttccaacctgtccatgacttcttccctttaaagccccttgatgtrtgcagctgcctcatctggttcaagacctctatgtctctatgaactgctgagtctgattaaagtccagagtttctgatgtgagataagtgggggcaaatcttttttttttttaaatggctgtctcagagcatccagcagaccgttacaaaggctttcttgtcaccgtcaagaccaagtcctggatccatggatgagtcttgaaatggaaggcttaggccgggcacagtggatcatgcctgtaatcccagcactttcggaggctgaggcaggcagatcgcctgaagtcaggggtttgagatc

SEQ ID NO: 141878 - DNA, 601 bp, Human
gaataggacaataaattcagggaattttgatgctcacaagacagtaagaagcagaacaaatgcacatgctaaactagacccccttctagcaaaaggagaggtcattaaggaccagaatagttcgagggatcataaggatctgggtatttcagctgtgtttccaattaccacgtcacccaccatttactcaagtatcacagccgaactgcctttgactcccatctctccccagtgctccccaaagtatacttctccctgacctttccaacctgtccatgacttcttccctttaaagcccctwgatgtgtgcagctgcctcatctggttcaagacctctatgtctctatgaactgctgagtctgattaaagtccagagtttctgatgtgagataagtgggggcaaatcttttttttttttaaatggctgtctcagagcatccagcagaccgttacaaaggctttcttgtcaccgtcaagaccaagtcctggatccatggatgagtcttgaaatggaaggcttaggccgggcacagtggatcatgcctgtaatcccagcactttcggaggctgaggcaggcagatcgcctgaagtcaggggttt

SEQ ID NO: 141879 - DNA, 601 bp, Human
tgagctgttgaagggcatctgagtcactgggaacacggccagggcttggtgggctgccctgggcctagggaacattgttaaggaggagacaaccaattctgtgggtgtcaggaggcttaggagggagcagtggggggtagagaggctatgggacaaatgataatctggtggcactaaacataaaggacacacgctggctcagcccctgattcaccagtgagtcactgtctgtgagcagaaagtatggccctgagttgtatttcagaatacaactcagggaaaaatatttccctgctatctmtttctatatgctgcagttcctgtattactaagcattaacgtgttagacataagccacacacctgtccgagaagggtgacaattttgtgaagaatgcccttgaaggacagaagaaaccctgggggtctgttagcccttgctgtcaagaataggacaataaattcagggaattttgatgctcacaagacagtaagaagcagaacaaatgcacatgctaaactagacccccttctagcaaaaggagaggtcattaaggaccagaatagttcgagggatcataaggatctgggtatttcagctg

SEQ ID NO: 141880 - DNA, 601 bp, Human
gaacggatggagatggagatagaaaggcattgttatgtattgggcataaatcctggttgaagactaagccacacacctggcatgtgttattgttttcaatcctcacaataaacctgtgaagaaatgggctccaagctattggacactttcccaaagtcacacagcttcaagtggcccaagtggtgttaaaacagatgtttgacttctaagccccctgccatccctgggcacctggaagcctgtctcagcgcacccatctgctttagatctgaagaagcagaggcccggagagctgcctcaygggaacgatgcaccagaaatgaagatccaatcctggttacctttccttgttcctgaaagtgacttggcttctctatcagaactttaaagaattggagtaactgctatgaatcaattgggaacttaagtaaagtgaacaggtcgaccagccagtaaactacccaggaaaagaatgcaggaactccagcgggaaagacccctgggtggatctcccagggttgtgcactgaaataaaggattgtgaccagatgaaagcaactgatggggactttagagacgggggtctcaggactcaggtgag

SEQ ID NO: 141881 - DNA, 601 bp, Human
tctatcactccttcaggtttcagcagaaattcgacttcctcagagaagactttcctaaaacccaaaccttagatccacaatgcatggtctcacagccccttgtatgtcctttttcatagtacacatcattcctataattattcctttaaggtcctgtccctatctcacatgagaccttaaggttccatgaggcaaagaccatgtctgtcttatgtaaatggcagcagcacccagaaaggtgtctggccaaagtgaaacaaatgaaaatttgttgactgaatgaagagaggaatgaagagcrctaaagaatctcccacagtaactcagagaatgaaagaaggacctggtgacatttggcaagatatattatggggctgatgactgtgggaaggggcaggtaaggtggggaaaagaccaggtgacagggcagagataaagttgccaccccaggagctgggaggaaatggtgtcaatgacacagctggatgtctggactagaaactgagttttggaatttcatatgttgggtagaagtaaaaataaatagagaaacatagtgcctactaccttaagtgctccatacagcctcattgatgaagat

SEQ ID NO: 141882 - DNA, 601 bp, Human
cactctcacccctacatacccatggagcatcagaccccacctcgggcaccagctaacatctatcactccttcaggtttcagcagaaattcgacttcctcagagaagactttcctaaaacccaaaccttagatccacaatgcatggtctcacagccccttgtatgtcctttttcatagtacacatcattcctataattattcctttaaggtcctgtccctatctcacatgagaccttaaggttccatgaggcaaagaccatgtctgtcttatgtaaatggcagcagcacccagaaaggtgtstggccaaagtgaaacaaatgaaaatttgttgactgaatgaagagaggaatgaagagcgctaaagaatctcccacagtaactcagagaatgaaagaaggacctggtgacatttggcaagatatattatggggctgatgactgtgggaaggggcaggtaaggtggggaaaagaccaggtgacagggcagagataaagttgccaccccaggagctgggaggaaatggtgtcaatgacacagctggatgtctggactagaaactgagttttggaatttcatatgttgggtagaagtaaaaataa

SEQ ID NO: 141883 - DNA, 601 bp, Human
tctataaagggagaagataacgagaaagctcagtagtgtgtttcaagtgtaaaatgaatagcaaaaccaaaagcttgaacaggctagggcagttggtaagtgtattctcaaggagttaggcttgaagcaggaattgaagggaatatgagccaagtgaaggaaaatgcacgggggttgtggaggaaaccaatgagtgttacggatggggccaatgagagacaaggttgagaccatggaggacaagaagggtgttcttggtcctacacacactggttcatcgaaagttttctaaaccggagaytgagggccatgaatctgcaggctgggtgcagaaggaaccggggtgggaggtgccgggaggagggacacctgctctggggtcatctctaagcagcatcccccatacatacacagctgcgtgtatctccttcccaattgcttctccctgtcaccacccgatgtggcccccagcaaggaaattgcccgtggtccctcacctattcctctcctcactccctgcattcagtaagtcaccgtggccactcattcctgccattccatgtttcctaattctgtccactgctccctgccccccacggcc

SEQ ID NO: 141884 - DNA, 601 bp, Human
taagtaaatcagtgaggcagagtctataaagggagaagataacgagaaagctcagtagtgtgtttcaagtgtaaaatgaatagcaaaaccaaaagcttgaacaggctagggcagttggtaagtgtattctcaaggagttaggcttgaagcaggaattgaagggaatatgagccaagtgaaggaaaatgcacgggggttgtggaggaaaccaatgagtgttacggatggggccaatgagagacaaggttgagaccatggaggacaagaagggtgttcttggtcctacacacactggttcatygaaagttttctaaaccggagattgagggccatgaatctgcaggctgggtgcagaaggaaccggggtgggaggtgccgggaggagggacacctgctctggggtcatctctaagcagcatcccccatacatacacagctgcgtgtatctccttcccaattgcttctccctgtcaccacccgatgtggcccccagcaaggaaattgcccgtggtccctcacctattcctctcctcactccctgcattcagtaagtcaccgtggccactcattcctgccattccatgtttcctaattctgtcca

SEQ ID NO: 141885 - DNA, 601 bp, Human
cacacaaacccttgcatccagtggtttcaaacattttaaacaggggattgtttcttaaatcttatgcagagcccaaatgtttacacagatgccagtggggctgctccggctgaaggagagggtttttattttggctgcaaactctgaggatcttcttggaaccccagagaacgctgaacagtttgaccatagccctctcccagactcctctctttttccagaagacactacagcataatggttaggcaggctggatttgcaacctggtttcaacaattaaaagtttaccttggctgggagyggtggctcatgcctataattccagcactttaggaggctgaggcaggaggattgcttgaggccaggagtttgagattagcctgggcaacacagtgagaccccacccctctcaaaaaaaattttttttcattaaaaaaaagaaaaaaatgtttaccttctttagacctcatcttcttcctctgtacaatgaggataatgatagtagcactcttgcgggggggtgggggggttgtgagaattatataaattcacccatgtaaagtgcttacgacacagccggcaaataaaataaatacattaa

SEQ ID NO: 141886 - DNA, 601 bp, Human
ggttacaggcatgcgccaccatgcttggctaacttttgtacttttagtagagacaaggttggccaggctggtctcgaactcctgacctcaagtgatccgcctgcctcagcctcccaaagtgctgggattacagccatcagccaccacactcggcccccaagagttttaaaacaagttttggtactaattaagttttttaaaagtgcatttttttttcattctggagctagcagattcccatctttgggaagaacaaatatctattcctttgcctcaggaagacttcttcaggcttgtagcrtctaaggcagtgtgtggtgtgaattctatagcatcttcaacaaaccaaaccacacaaacccttgcatccagtggtttcaaacattttaaacaggggattgtttcttaaatcttatgcagagcccaaatgtttacacagatgccagtggggctgctccggctgaaggagagggtttttattttggctgcaaactctgaggatcttcttggaaccccagagaacgctgaacagtttgaccatagccctctcccagactcctctctttttccagaagacactacagcataatggttaggcagg

SEQ ID NO: 141887 - DNA, 601 bp, Human
ctggtagggacttaggaggtggaggacaaagcctcaaggaggaagaaaagaaaaagagaaagcatgccaagccttgtgtgatccagttttcttctcggcatgttataaattaaacaacaactgaaaacaaaaagaaaatgaaagcttataaactggatacctactgaattcgaaacccagctgcatgccccccacctaccatgcctcaggtaccatggtaacgtggcattttcaaaatcattagttaccctgggaatattttaggcagagctcagcagagcatttcctgtggcggggggcrgggcgggggggcctccagtggagaggcgttctctagctgggctggagactgcacaattggcctgacacacatttcagaatttggggagaattccagaggttcaggcagccacgggcaagggcagagagccgccagctcatgcccctgaaagccagacagaagagaaaacaaatagagaccatgtccaaaccccaccattaatctgctattctcttctctaaacactgttacagtcaaatggcaatgcttattcttaacaggcatactaagatgtgatcatttcaagtgacaagcaaaaag

SEQ ID NO: 141888 - DNA, 601 bp, Human
ttaaataaatttgtatgtttttctcttgttaatctgtctcttgttataggggcctcagccatgaatctacaattggagaggaagaggtatttttcctcccctataattgcatataactaaaacaataacgctggatggaggcagggttttgttcggttttgtttgctattgtcgggccctcaaatagcatttcctgtggtcagtgatgcttcgggggttgccaggttgtggcacacccggctctccaaaggtgggagctttcaagcaatcccgtcctacctctaaacacagaacacctggyagggacttaggaggtggaggacaaagcctcaaggaggaagaaaagaaaaagagaaagcatgccaagccttgtgtgatccagttttcttctcggcatgttataaattaaacaacaactgaaaacaaaaagaaaatgaaagcttataaactggatacctactgaattcgaaacccagctgcatgccccccacctaccatgcctcaggtaccatggtaacgtggcattttcaaaatcattagttaccctgggaatattttaggcagagctcagcagagcatttcctgtggcggggggcagggc

SEQ ID NO: 141889 - DNA, 601 bp, Human
caaaaacacagagctgaattttcagtctgaataataattttttttaaaaggctaagagctatgcaaaggtaagtaatctaaacattcaaagaaatgttgagttactactttacttatgttttgattgatcactaacctgtgtaggctgccaccaaataaaaagtgaggcagctttctttcaaagctcattcaaatgttcaagcctgacacatccgtttgcaaagaagaataagagtaagtattttaaaacaattaaacaaatcaaggaaatttgattttaaggatgggagtcaaaggtgartctcaggtcaatgcaatccttaccctaaatctaaccttcaggctctgcgtgatgaggcacttaccttctgcaaaaaggatcttcaggtccctgttagcataggcttacactagatttccaagatgccagggagcaaaaccctaagaatcccatgggcaaaagaaaccaaaacacccataacaaataagcaccataaataacgtttgcatttgaacacagaaactgatcagctatattcaggacagaaatagcaaatgagcatttgaaagggatctggtgaccagtaactgcaacccagag

SEQ ID NO: 141890 - DNA, 601 bp, Human
gaagcaatttgttaatccttagaacatatcactattttgcagattgaagaaataaaaaattatgttttttcagagtcacagaaactcaatagttctaggtcaatactatgaaccatgctgaagagaataacttgggtagtaagtgttgtaacacggagggggtccctttaaatcatagcaccctgatgttaccagccgcaaaggctgtgtatccccaaactatattccctacttttgactcctggagttacctattcaaagatgagttttaggctgggtgtggtggcacacacctgtaatmccagcactttgggagaccaaggcaggaggatcgcttgagctcaggagttggagaccagcctgggcaacatagcaagatctcttctctactaaaagaaaaacaaaaaactagctatgtgtagtggtgggttcctgtagtcccagctactaaggaggctgaggtgggagaataacttgagtccagaagttgaggctgcagtgagctgtgatcacaccactgcactccagcctgggtgaccctgagaccccacctcaaaaacaaacaaaccaacaaaaacacagagctgaattttcagtctga

SEQ ID NO: 141891 - DNA, 601 bp, Human
aaaagagaactgaaactaaccaaggccagacacagtggctcatgcctggaatctcagcactttggaaggccaacgtgggtagatcacttgaggccaggagttcaagacaagcctgggcaaaatggcaagaccctgtctctactaaaaatacaaaaattagccaggtatggtggcacagcctatagtcccatctgctcaggaggctgagacacaatgatcccttgagctggagaggtcagggctgcagtgagctgtgatcacaccactgcactccagcctgggtggcagagtgagattctayctcaaaaaaaaaaaaaaagaaactaacctaatattttctgaggctgccaaattctgggctgtttatgaaccatctcacgaaaagacagaagtttttttgaaggcaaagatcatagcttattcatcattctatccctggcaattagttgaaggcctggcaaacagtaaaatctcataattcaatcaaatataaagaggaaggagatgacttgaagatgagtaaaagatcactggagagagccaatgattttaggaattgttttatgaggcaataaggggcaaataaatactgaaaagaaac

SEQ ID NO: 141892 - DNA, 601 bp, Human
ctaagatagcattgtaacacaccctctggggtcttgggggttgcagagagccccacctggtctggctgaggggcctacagagagtctgctcctgctggcgcccagagtagctggccggatcctgcccttgctcactcatatgctccttcctgcaaaaggttgagcatggtgggccaaagaaatggggcacctccgtcgcaagtctgacaaggggtgagaaaattcctgcatcacaaggagcttcaaagatatgtgacttattccagggcagtgtcttgtaccatgcagcttgatgtgaaayggtcctggaatacagccacgtgactttgatgatcgtctgcccaaagggccttgtgttagttcagtttcagctgaaaatattacccaagtgcagtcccaaagcactattaatgcagggtcccatgatactggcctggatacttaaaagataaggaagataatggtatattctttcaccagcacctacctaaaatacattttccccttagcatacaatattcatacccagtgctcttgacttcacttcttaatgaatactttcctgaaaccatgtccaaccacaaatgctcaaatgcaattc

SEQ ID NO: 141893 - DNA, 601 bp, Human
agagttcaggacccactgagtgcaagtacccaaaaaaagctatcacagtggccctttgccctcactggcagagggcagctgtcccacactatgaggcaagtccactgagctgataacacaccactgtccacggacagcagagctaagatagcattgtaacacaccctctggggtcttgggggttgcagagagccccacctggtctggctgaggggcctacagagagtctgctcctgctggcgcccagagtagctggccggatcctgcccttgctcactcatatgctccttcctgcaaaagkttgagcatggtgggccaaagaaatggggcacctccgtcgcaagtctgacaaggggtgagaaaattcctgcatcacaaggagcttcaaagatatgtgacttattccagggcagtgtcttgtaccatgcagcttgatgtgaaacggtcctggaatacagccacgtgactttgatgatcgtctgcccaaagggccttgtgttagttcagtttcagctgaaaatattacccaagtgcagtcccaaagcactattaatgcagggtcccatgatactggcctggatacttaaaagataaggaagat

SEQ ID NO: 141894 - DNA, 601 bp, Human
gaatccttccttgaattctttgcatcctcctcatggtcctcagcatagagtttggcatgcagggggctctcaggcaatgcttggccaactccaagtgatagtggcaggaggcacagaaattgtaggcagacaggggtaggtccgtggcaaaatcccatgtttgagccaaaaagccacagcacaaaatgagaacttctattcctgtttgcccactgtctcccaattagttctttctgaataatgtctttttaccaatcgaatgttgtctttttcaaaactacctatggcccaccccaccccsagtcctgtgcctataaagaccccagactcagctggcagaagagagaagcagcttgactggagaaagatgattcgacttcagtgggacagctagactttggaggacagacggcttaacttcagggaagagccagctagtgacaaccggacttcagggaagattacctgcccaacctgacccctctccagctcccctctctgctgagagcaacttctatcactaagtaaaattttctacctccaccatccttcaagtatctgtgtaactaattcttcttggacaccagacaagagttcagga

SEQ ID NO: 141895 - DNA, 601 bp, Human
tctctccaaccatgcttcccaagtgagcaaataaggaccactgtaccttccttcggggtggctgtgagaattaaatggaatatgtttcatacagcgcctgccccacagtaaagctcaatcaatcaatcacggccctccctttctgaatccttccttgaattctttgcatcctcctcatggtcctcagcatagagtttggcatgcagggggctctcaggcaatgcttggccaactccaagtgatagtggcaggaggcacagaaattgtaggcagacaggggtaggtccgtggcaaaatcccrtgtttgagccaaaaagccacagcacaaaatgagaacttctattcctgtttgcccactgtctcccaattagttctttctgaataatgtctttttaccaatcgaatgttgtctttttcaaaactacctatggcccaccccacccccagtcctgtgcctataaagaccccagactcagctggcagaagagagaagcagcttgactggagaaagatgattcgacttcagtgggacagctagactttggaggacagacggcttaacttcagggaagagccagctagtgacaaccggacttcaggg

SEQ ID NO: 141896 - DNA, 601 bp, Human
accctggagaggtagctcatctctccaaccatgcttcccaagtgagcaaataaggaccactgtaccttccttcggggtggctgtgagaattaaatggaatatgtttcatacagcgcctgccccacagtaaagctcaatcaatcaatcacggccctccctttctgaatccttccttgaattctttgcatcctcctcatggtcctcagcatagagtttggcatgcagggggctctcaggcaatgcttggccaactccaagtgatagtggcaggaggcacagaaattgtaggcagacaggggtrggtccgtggcaaaatcccatgtttgagccaaaaagccacagcacaaaatgagaacttctattcctgtttgcccactgtctcccaattagttctttctgaataatgtctttttaccaatcgaatgttgtctttttcaaaactacctatggcccaccccacccccagtcctgtgcctataaagaccccagactcagctggcagaagagagaagcagcttgactggagaaagatgattcgacttcagtgggacagctagactttggaggacagacggcttaacttcagggaagagccagctag

SEQ ID NO: 141897 - DNA, 601 bp, Human
ggccaggacccttggcccttccatcatagctgtgggaccctggagaggtagctcatctctccaaccatgcttcccaagtgagcaaataaggaccactgtaccttccttcggggtggctgtgagaattaaatggaatatgtttcatacagcgcctgccccacagtaaagctcaatcaatcaatcacggccctccctttctgaatccttccttgaattctttgcatcctcctcatggtcctcagcatagagtttggcatgcagggggctctcaggcaatgcttggccaactccaagtgatagyggcaggaggcacagaaattgtaggcagacaggggtaggtccgtggcaaaatcccatgtttgagccaaaaagccacagcacaaaatgagaacttctattcctgtttgcccactgtctcccaattagttctttctgaataatgtctttttaccaatcgaatgttgtctttttcaaaactacctatggcccaccccacccccagtcctgtgcctataaagaccccagactcagctggcagaagagagaagcagcttgactggagaaagatgattcgacttcagtgggacagctagactttgga

SEQ ID NO: 141898 - DNA, 601 bp, Human
ttgtttagagagcagggtgtcatagtaagggcacatactaggagtcctgtggccaggacccttggcccttccatcatagctgtgggaccctggagaggtagctcatctctccaaccatgcttcccaagtgagcaaataaggaccactgtaccttccttcggggtggctgtgagaattaaatggaatatgtttcatacagcgcctgccccacagtaaagctcaatcaatcaatcacggccctccctttctgaatccttccttgaattctttgcatcctcctcatggtcctcagcatagagtytggcatgcagggggctctcaggcaatgcttggccaactccaagtgatagtggcaggaggcacagaaattgtaggcagacaggggtaggtccgtggcaaaatcccatgtttgagccaaaaagccacagcacaaaatgagaacttctattcctgtttgcccactgtctcccaattagttctttctgaataatgtctttttaccaatcgaatgttgtctttttcaaaactacctatggcccaccccacccccagtcctgtgcctataaagaccccagactcagctggcagaagagagaagcag

SEQ ID NO: 141899 - DNA, 601 bp, Human
atctctactaaaaatacaaaaaaaaaaaaaaaaaactagccaggcatgatggtggatgcctgtagtccaagctacttgggaggttgaggcaggagaatggcgtgaaccccggaggcagagcttgcagtgagcagaggttgcgccactgcactccagcctgggtgacagagcgagattccgtcaaaaaaaaaaaaaaaagaactgttaaattttaccaccaacaacgaccttttcagagataaacacttgtaccattgctgctccaagcaatggccccacctctccagggatatttgtctgyccaccaccacaggacacccacggggccacagtggcagatctcctgttagagagaaggtggtgggatttctgtgaggtttcctttagtgctggagctcagctagacatgtggggccacatcactctggtctagaccctaggatgtctctgctgttgtagtatttatgccttaaataggaggaggcggacctctaggactagtattgcctctgccacccagaacattacaatttctcaatttaagctgccctttgtgttttgaagtacagctgctactaggatgtggatctgaacaatttct

SEQ ID NO: 141900 - DNA, 601 bp, Human
tgaacacactaatgtggtaatgaactgacatccagagaacaggccagaaattgctggaggcaggaagcggggaatttgaggtggcaaaaaagaagagcatccttcacacaaacctgctatctctattctttgtgcaattaatcattttagaaactagcaaaagacaatgatgcataattggccgattgagggatgtgacactagagagattttttcaaatcttacttcgtgaaaagtcatcagtggtttcaaatcttagaacacaggtctaaataactgttaaattttggccaggcatggyggctgatgcctgtaatcccagcactttgggaggcagaggtgggcggatcacaagatcaggagatcgagaccatcctggctaacacggtgaaaccccatctctactaaaaatacaaaaaaaaaaaaaaaaaactagccaggcatgatggtggatgcctgtagtccaagctacttgggaggttgaggcaggagaatggcgtgaaccccggaggcagagcttgcagtgagcagaggttgcgccactgcactccagcctgggtgacagagcgagattccgtcaaaaaaaaaaaaaaaagaactg

SEQ ID NO: 141901 - DNA, 601 bp, Human
gccgctgtggcagcaccttcctggcaacagaacatacaatgaacacactaatgtggtaatgaactgacatccagagaacaggccagaaattgctggaggcaggaagcggggaatttgaggtggcaaaaaagaagagcatccttcacacaaacctgctatctctattctttgtgcaattaatcattttagaaactagcaaaagacaatgatgcataattggccgattgagggatgtgacactagagagattttttcaaatcttacttcgtgaaaagtcatcagtggtttcaaatcttagaamacaggtctaaataactgttaaattttggccaggcatggcggctgatgcctgtaatcccagcactttgggaggcagaggtgggcggatcacaagatcaggagatcgagaccatcctggctaacacggtgaaaccccatctctactaaaaatacaaaaaaaaaaaaaaaaaactagccaggcatgatggtggatgcctgtagtccaagctacttgggaggttgaggcaggagaatggcgtgaaccccggaggcagagcttgcagtgagcagaggttgcgccactgcactccagcctgggtga

SEQ ID NO: 141902 - DNA, 601 bp, Human
ttcctatgctggaaataaaaaggttgatgtcaacatatttcttagaacatagagttccttaaaaccgaacatgtctgggatgaccaaatcccttcccaatcccacaggtttctctttgatagacctacagtgaaaactagcagcatcctgacttcccaggggccgctgtggcagcaccttcctggcaacagaacatacaatgaacacactaatgtggtaatgaactgacatccagagaacaggccagaaattgctggaggcaggaagcggggaatttgaggtggcaaaaaagaagagcatscttcacacaaacctgctatctctattctttgtgcaattaatcattttagaaactagcaaaagacaatgatgcataattggccgattgagggatgtgacactagagagattttttcaaatcttacttcgtgaaaagtcatcagtggtttcaaatcttagaacacaggtctaaataactgttaaattttggccaggcatggcggctgatgcctgtaatcccagcactttgggaggcagaggtgggcggatcacaagatcaggagatcgagaccatcctggctaacacggtgaaaccccatct

SEQ ID NO: 141903 - DNA, 601 bp, Human
cagaccaccctagactttattactccttaaaagaaaccaaaaatctcccctgggcatgagactttgcctctctcaccaaaaacaggcttgcttctacagctccatcttgaaaagcttctagcagccagcacctccgtcctctgttctcgccctgcctcacctgtcattttgctaaagacacccgcatccatccgctttgcttctcctttgtcttcccccaggtgctatatcctgaggttactcaggagggaacaggagagctacaaatccagacacgtgttctccagctcctctaagttgwatttatcaaggagacaaaacaggacccaggatcactacctgcaactcccttaattgtaacctactttccgataaaaattacatgcttttgaaaccagcaataataaactgaaatgcacgaacagtcaacacaatgacaaaatgtactctgcagcgattgaggagacattgttacatcttttaaaatcaatctgtgatctgcctctacaggagatgaatgaaagtgcatagaagacaaaagaatgtgataataacagagataatactcagccccagtacatccaatcttttgttgggtcaa

SEQ ID NO: 141904 - DNA, 601 bp, Human
gaaatggccggaacactgtaaaccctcaataaactctggttattaattgctgtgtgcatatgtgtgtgtgtgtgtgtgtgtgtgtgtgtattttttttttctacaaaggaaaaaaagtgcttaatttatgcattcataggaagtcatgtggcagggtttttaaagtcaagggtgaggacaaaggtggagtattgacagattcaggggacaaggaggcattttcaacgagagctaatcctttttactagaaagggtgaaatgacacagaccaccctagactttattactccttaaaagaaamcaaaaatctcccctgggcatgagactttgcctctctcaccaaaaacaggcttgcttctacagctccatcttgaaaagcttctagcagccagcacctccgtcctctgttctcgccctgcctcacctgtcattttgctaaagacacccgcatccatccgctttgcttctcctttgtcttcccccaggtgctatatcctgaggttactcaggagggaacaggagagctacaaatccagacacgtgttctccagctcctctaagttgtatttatcaaggagacaaaacaggacccaggatcact

SEQ ID NO: 141905 - DNA, 601 bp, Human
tggatactcacatgtgtgagtgctcccatttcaacacttacaacttcctcctctccaccttgtctttctccaaagagggtgtgagaaatgaatatttgcacataaaatggaagacgctgtacatgtgacacacgcaaacattaaaaatatgggtcctggtgccaggcaggcttgctggcaatcctggctctccactgtatgacattaagcaacttactttgcctctctaagacttcctcatctgctaggtgggatgatactcacctcatggtttttgggtgggatttatgagattttgtaygcaatgagaaatggccggaacactgtaaaccctcaataaactctggttattaattgctgtgtgcatatgtgtgtgtgtgtgtgtgtgtgtgtgtgtattttttttttctacaaaggaaaaaaagtgcttaatttatgcattcataggaagtcatgtggcagggtttttaaagtcaagggtgaggacaaaggtggagtattgacagattcaggggacaaggaggcattttcaacgagagctaatcctttttactagaaagggtgaaatgacacagaccaccctagactttattactcctta

SEQ ID NO: 141906 - DNA, 601 bp, Human
tatctcaggaagcagagacaggctcctaattagatctgagcacgctcagtaggtatgtttggactgtgtcagcaccacacaacatgtattttcaatagcacccgggagcggcattttatgttgcagaaaaagaaatgaggtggctgtaggtggggccacatggctgctgagcctcctgggggctcctggatactcacatgtgtgagtgctcccatttcaacacttacaacttcctcctctccaccttgtctttctccaaagagggtgtgagaaatgaatatttgcacataaaatggaagaygctgtacatgtgacacacgcaaacattaaaaatatgggtcctggtgccaggcaggcttgctggcaatcctggctctccactgtatgacattaagcaacttactttgcctctctaagacttcctcatctgctaggtgggatgatactcacctcatggtttttgggtgggatttatgagattttgtatgcaatgagaaatggccggaacactgtaaaccctcaataaactctggttattaattgctgtgtgcatatgtgtgtgtgtgtgtgtgtgtgtgtgtgtattttttttttctacaaa

SEQ ID NO: 141907 - DNA, 601 bp, Human
tgtttctcctttctcctgatgaggtttgaattagttggagatggaaaattcagaacagataaattatagaaggaactaaacttttagtatactaaaatgtattagtataaaagatctatgacattttgaataaggcatagatattaggaaacaagtctcagccaatactattcatcatttctcaatagaagataaaagctttctcatcatccaaagaggcaggccattcagttattcaaattaagtaggagaaaatgctgggttaaggacaaacaaaaagacctgcattatgctaattctkaactagttgatgatagaggctcctccagcctttcttgtgctatcctttgttggggcatgatttagctccgaaaagcttctctagtgccagtgagctttcttccaaaacagtatgtaacatttcttttattcattttactttatttatttgaaacagggtctcagtctatcacccagctcctattatggatttcaggcagaaaggtagtttgtcatacaactttgtcccaatggaactttgctcttgtcgcccaggcttcagtgcaatggcgtgatcttggctcactgcaacctctgactc

SEQ ID NO: 141908 - DNA, 601 bp, Human
ggttggggtacaatttgtttctcctttctcctgatgaggtttgaattagttggagatggaaaattcagaacagataaattatagaaggaactaaacttttagtatactaaaatgtattagtataaaagatctatgacattttgaataaggcatagatattaggaaacaagtctcagccaatactattcatcatttctcaatagaagataaaagctttctcatcatccaaagaggcaggccattcagttattcaaattaagtaggagaaaatgctgggttaaggacaaacaaaaagacctgsattatgctaattctgaactagttgatgatagaggctcctccagcctttcttgtgctatcctttgttggggcatgatttagctccgaaaagcttctctagtgccagtgagctttcttccaaaacagtatgtaacatttcttttattcattttactttatttatttgaaacagggtctcagtctatcacccagctcctattatggatttcaggcagaaaggtagtttgtcatacaactttgtcccaatggaactttgctcttgtcgcccaggcttcagtgcaatggcgtgatcttggctcac

SEQ ID NO: 141909 - DNA, 601 bp, Human
agaaggaacaatggttggggtacaatttgtttctcctttctcctgatgaggtttgaattagttggagatggaaaattcagaacagataaattatagaaggaactaaacttttagtatactaaaatgtattagtataaaagatctatgacattttgaataaggcatagatattaggaaacaagtctcagccaatactattcatcatttctcaatagaagataaaagctttctcatcatccaaagaggcaggccattcagttattcaaattaagtaggagaaaatgctgggttaaggacaaasaaaaagacctgcattatgctaattctgaactagttgatgatagaggctcctccagcctttcttgtgctatcctttgttggggcatgatttagctccgaaaagcttctctagtgccagtgagctttcttccaaaacagtatgtaacatttcttttattcattttactttatttatttgaaacagggtctcagtctatcacccagctcctattatggatttcaggcagaaaggtagtttgtcatacaactttgtcccaatggaactttgctcttgtcgcccaggcttcagtgcaatggcgtg

SEQ ID NO: 141910 - DNA, 601 bp, Human
tttttttcctccttgttctggggtggctttgcgattttagtctagacgtattcatacccttaaaaatgagctttagagtttaggatcttaaaataggactgtgctgacataatacaactcaagaaggaacaatggttggggtacaatttgtttctcctttctcctgatgaggtttgaattagttggagatggaaaattcagaacagataaattatagaaggaactaaacttttagtatactaaaatgtattagtataaaagatctatgacattttgaataaggcatagatattaggaaacragtctcagccaatactattcatcatttctcaatagaagataaaagctttctcatcatccaaagaggcaggccattcagttattcaaattaagtaggagaaaatgctgggttaaggacaaacaaaaagacctgcattatgctaattctgaactagttgatgatagaggctcctccagcctttcttgtgctatcctttgttggggcatgatttagctccgaaaagcttctctagtgccagtgagctttcttccaaaacagtatgtaacatttcttttattcattttactttatttatttgaa

SEQ ID NO: 141911 - DNA, 601 bp, Human
agagttattagcaatacaatgacatggccagggtgagttgtaggacaccttggtttggcagtggcctgaagcatggtccagaagtcacagagacctaaattgggatacagagtgtgaaacttgattatgcaaattgagtcattcttatcatacccaactaagccagagtcgagggcccggagtcaggtggtaagcactcaggacacagcatctgctccaagaattgacttttctgcaagcccagctgctaaaatggcaagctgtaaccttaaaaacagtgtcacctagtagctgctgaaaygacccgccatgactccaagactggtttttcctaccaccatcactgacacccactaatcagaacttgccagctcccagaagtttctctagtgccagtgagctttcttccacaacaatatgtaacatttcttttattcattttcctttatttatttgagacagggtctcagtctatcacccaggctggaatgcagtgctgcaatcatggctcactgctcacttgacctctcggactcaagtgagcctcccacctcagcctctgaagcagctgggacaacaggtgtgctctgccacacctggc

SEQ ID NO: 141912 - DNA, 601 bp, Human
ccaaattactggaataatccagacagcaaaacagatagaaacagcattgcaaccacacagcttccagcttcctgcctcatctttatatgggagactctcaagaacagaaaaaagttttaaaaagtttcctaaatttaggaagtagatgctttctaattttcactttatggttggccaagtattttctttttttttttttttaaataaaggaaaacagaactatagcaaagcctaacaatgtctgttaaatgaatagaaaatagaatgagaacaattaataagaaataaatttaaagagctwtgagatttctgaggagagaatggttacttctggtgtgaagggttagaaagatttcacagaaattgcatttgtgctagattttgatggatggtaaagagcaacaggcaacagagatgaaaggagggaatgaaaccttaaattatgtccaggaaactaggagtggcccagttagacatgaacacaggagatgtgttggttgggggaagaagttacagataaagtctggaaatgcagtttgagagcagacttggagaactctgaaaccctcaagtcaactggctcaggggaaatcactgaaga

SEQ ID NO: 141913 - DNA, 601 bp, Human
ttccaaattactggaataatccagacagcaaaacagatagaaacagcattgcaaccacacagcttccagcttcctgcctcatctttatatgggagactctcaagaacagaaaaaagttttaaaaagtttcctaaatttaggaagtagatgctttctaattttcactttatggttggccaagtattttctttttttttttttttaaataaaggaaaacagaactatagcaaagcctaacaatgtctgttaaatgaatagaaaatagaatgagaacaattaataagaaataaatttaaagagytatgagatttctgaggagagaatggttacttctggtgtgaagggttagaaagatttcacagaaattgcatttgtgctagattttgatggatggtaaagagcaacaggcaacagagatgaaaggagggaatgaaaccttaaattatgtccaggaaactaggagtggcccagttagacatgaacacaggagatgtgttggttgggggaagaagttacagataaagtctggaaatgcagtttgagagcagacttggagaactctgaaaccctcaagtcaactggctcaggggaaatcactgaa

SEQ ID NO: 141914 - DNA, 601 bp, Human
ctgaattttccacttagatgagttaatttgttctcttccttttaagactgccagagccaggccaggtgtggtggctcacgcctgtattcccagcgcattgggaggccaaggcgggtggatcacttgagatcaggagttcgagaccagtctggccaacatggtgaaaccctgcctctactaaaaatccaaaaaaagtagccaggtgtggtggtgtgggactgtgggctccgtctcaaaaaaaaaaagactgccagggcgaggatttcctaattgatactcatcccatctgaagtcccagtcrcccattatatatctcggcaaactttcatttaattaacagaataagcatgatcttaatgagatttatctcttgtggacagtatttttacttaaaaatggaaacaaactgatccgaatttgtgtttcattgttagaatgtttttgaaatggatgtggaatagcattgttcttttcctccctcagccacccacattgctagcttccaggaccactctatcctgttccaaattactggaataatccagacagcaaaacagatagaaacagcattgcaaccacacagcttccagcttcctgcctc

SEQ ID NO: 141915 - DNA, 601 bp, Human
accacactttgaagggtaatgtatgttatttgttctttatcatagtcaacaacaaatctagatttgctttatgcacaggaagtatttaatattagttaggtttaatttgattcaatgcattttaagttaaccaatgagccctattgaactcataaggaaactaaagccgagtaaggttaactgacttgcccacagttaaagggttggaaagttttggagccaagggtgaaacccaggtctccttaattcaaaatccaaggcttcaatcatgacaccagttgccacaaatctgtggcatatrtggtgattctatttctttgccaccacagacattgctaatcgatttcctacgcaagcttggatatggcctcagaatccttccaaacacagggctccagagacccacctcaaatcaacttttctgtatcctggcaggatagcatgctctctctccaagataaaggaaggaaaatggtagaggtgatttgcgggcagaagcattatcacttggcagctgtgggcgtagattgtgagaaagagaaaagggtaggcatcaggaatgatgaaggatgtaagcctgggggatgagggggatggtgac

SEQ ID NO: 141916 - DNA, 601 bp, Human
gtagttaaaagtggggattctcctggcactccctttgcgtgttctcttacaggcctcctctcttagaccctggcccagcctcctccaccaggctgtcctccatccttctcctcaggccccaccagctgctgcttgctacagcattctcttcagggaagtcctgaggatgctgccagaagatactgaacaccaaggaggggactcactcactgccaaccacgacttccacagaaagcttgggaattggggaatggcatgatcaaagccttgctttattatgcagagcaaattttttttttttgagggagcatttgtgtggagaatagtgaggaagggaactaagtgatgagagcctaagtcagagcaatggcagaagaaattgaacataatagaacggtttatgtttggtaccacactttgaagggtaatgtatgttatttgttctttatcatagtcaacaacaaatctagatttgctttatgcacaggaagtatttaatattagttaggtttaatttgattcaatgcattttaagttaaccaatgagccctattgaactcataaggaaactaaagccgagtaaggttaactgacttgccca

SEQ ID NO: 141917 - DNA, 601 bp, Human
acagaggaaataaaattaattcagtaaacagtagattacaaaaatatgcttcagttctatattatgattcaaatagggagataaaaactgaaagataaaacagaggagacataagtagaaaatgacagacttggccaggcatggtggcttacgcctgtaatcccagcactttgggaggccaatgcaggtggatcacttgaggtcaggagttcaagaccagcctggccaacatggtgaaatccaatctctactaaaaatacaaaaaaaattagctgggtatggtggcaggtgcctgtagtcycagttacttgggaggcagagacaggagaattgcttgaacccaggagatggaggttgcagcgagctgggattgtgccactgcactccagcctaggtgacagagtgagagactctgtctcaaaaaaaaaaaaaaaaaaaaaaaaaaagacagactatgaggatgtggaggtggggtggccttgcggggaggaaatagggtagaactttagaagacagagccagaggtttggtagttaaaagtggggattctcctggcactccctttgcgtgttctcttacaggcctcctctcttagaccctg

SEQ ID NO: 141918 - DNA, 601 bp, Human
cagagtctcactatgttgcccaggctggtctcaaactcccgggctcaagtgatctgccctcttcagcctcccaaagtgctggaattacaggcgtgagccaccacccttagcatgtgttttgattccttaagtgataagcagaaaatgatgctctgcttatagggggacagcatgcaatgactgacactgagggatacctctgggttccagtttatgccctatcttttcccaaacaagaacaatgatttcaattccatattatcaaaatgaagataaaaatgtgagatgctagcgtcattgrtcccaatcatctccttattcttaatgttcccaagccccaggataataatatgagagagagagcagcttgcatgtttttcattttaagtatgtgtcaacgagaaatacaagtgtgtgtgtgtgtgtgtgtgtgtgtgtgtgagagagagagagagagagaaagaagacaattaagtgtacataaagtgtacattgtactatacaagggaggctatcagccatgacactgattacaagaactagagaactaactaagcaagcaagaaaaaaagccttataaaaatgtgatttggccatgtgg

SEQ ID NO: 141919 - DNA, 601 bp, Human
cccaagtaactggaactataggcaggtgccaccatgcccagctaactttgtatttcttgtggagacagagtctcactatgttgcccaggctggtctcaaactcccgggctcaagtgatctgccctcttcagcctcccaaagtgctggaattacaggcgtgagccaccacccttagcatgtgttttgattccttaagtgataagcagaaaatgatgctctgcttatagggggacagcatgcaatgactgacactgagggatacctctgggttccagtttatgccctatcttttcccaaacargaacaatgatttcaattccatattatcaaaatgaagataaaaatgtgagatgctagcgtcattgatcccaatcatctccttattcttaatgttcccaagccccaggataataatatgagagagagagcagcttgcatgtttttcattttaagtatgtgtcaacgagaaatacaagtgtgtgtgtgtgtgtgtgtgtgtgtgtgtgagagagagagagagagagaaagaagacaattaagtgtacataaagtgtacattgtactatacaagggaggctatcagccatgacactgattacaa

SEQ ID NO: 141920 - DNA, 601 bp, Human
ttctttttgagacagggtcctgctctgtcgcccaggatggagtgcagtggcacgatctcggctcacagcaacctttgcctcctgggctcaagcgatcctcctacctcagcctcccaagtaactggaactataggcaggtgccaccatgcccagctaactttgtatttcttgtggagacagagtctcactatgttgcccaggctggtctcaaactcccgggctcaagtgatctgccctcttcagcctcccaaagtgctggaattacaggcgtgagccaccacccttagcatgtgttttgatyccttaagtgataagcagaaaatgatgctctgcttatagggggacagcatgcaatgactgacactgagggatacctctgggttccagtttatgccctatcttttcccaaacaagaacaatgatttcaattccatattatcaaaatgaagataaaaatgtgagatgctagcgtcattgatcccaatcatctccttattcttaatgttcccaagccccaggataataatatgagagagagagcagcttgcatgtttttcattttaagtatgtgtcaacgagaaatacaagtgtgtgtgtgtgt

SEQ ID NO: 141921 - DNA, 601 bp, Human
ggaattcttggacaacgttgcttgggctatggcaagtggagtcatgataagccatattcttggagaacttttcccattaaaggctgtttatcaaaccataggaagaaaaatgagaaacagacatatttctaaagtagcacatcatttgacttttatgattagttgggggattttgttggtagtgatggttgggtagaggtcaagtctaccttctcatgtaagcaaagcataaacattttaaatcatccacttataaaaacaaaagcaactgaaaacaacagcaaacttgattcaggtaatmcaatggaagcaaacacacctgataaaggagagtgtcactgataaaactgtacttgatagtcgtacttagagggttgctgtatcttaaacattttaatttttcatcttaaactctgcgtttataaaaattaaatttcacttggaattaagaggccatctccatcagcaacaggataaattattaatattgtaggtcttcaaacatatatgaaaacattaaattatctggatttaaaatatatgatctaaaatagcagagggcatatgtggctgattaggttaatccctttcttttgagttt

SEQ ID NO: 141922 - DNA, 601 bp, Human
atatactatagcaaaaaaaaacaaaacaaaacagtaattgcctatactctatacagttgagagtaaacgctcttttagtataatgaatatatttttcagtgaaagtaaaatgaataaatttttaatagaaaaaactattacatctactaccaacaatatcaaatttttaaaaaattctacaaacgccagattgatttttttatgattttttttttgtagttcacataaacctaaaactctctctaacaaaaattgctatttttctcctccaaacattcttagaataatacaagtaaggcgytttgttttgacatcattattcaggaaaacttcaaggatgagatgttaaacgtatatatgccccaaaaggaaagtaatattttgaatatttattttcaaacaaggaagaaaattggtaagatttgctgttagaacacacaattttcagagagactttgcttagacagtatatagaacaacaaagaaaagtaaaagtaagtgaggtctctaaaatatgctgttaggccaggcgtagtggctcacacttgtaatcttagcactttgggaggccaaggagggtggatcacctgaggtcaggagt

SEQ ID NO: 141923 - DNA, 601 bp, Human
tttaaattacatgtaggtatatttttctacattgtatctattttaaagtgcaatatgacatgatgcacacgctaatcttattcccacttcttggactgagtaaattgtcttctgtaagtgatatcagaagtggctaattatgtctttgcatttatggcatgtgggtagctatctctataaattattttatgacaagattttagagaggaacacaaataaagcacctattttataaaaaaactaaccattttacagtcatcttctttataactcagtgttcatatactatagcaaaaaaaaacaaaacaaaacagtaattgcctatactctatacagttgagagtaaacgctcttttagtataatgaatatatttttcagtgaaagtaaaatgaataaatttttaatagaaaaaactattacatctactaccaacaatatcaaatttttaaaaaattctacaaacgccagattgatttttttatgattttttttttgtagttcacataaacctaaaactctctctaacaaaaattgctatttttctcctccaaacattcttagaataatacaagtaaggcgctttgttttgacatcattatt

SEQ ID NO: 141924 - DNA, 601 bp, Human
ggaaaatgattgcttattggtagcctataaattcagagtcagtaatgatggtgatgccaaatcaccacagatcatccactggggtggctgagatagtgacacctttgctttctgatggtacaacatacatgaactttgtatcatgcatacaattactataaaaataatataaaatcaccttcaagcttatatgtataaagcgtacatgaaacataaatgaatttaatatttagacttgggtcccatcgctaagatatctcatgtatatgcaaatattccaaaatcaaacaaacaaacaaamaaaaaacaaccaaaccctggtatctgaaatacttctggccccaagcattttggacagggatactcaacgtgtacttccccaacatgcatgaccttactatttaatgctaagagctaagcgcaaatgcagccccattttaaagatgaacttaaggcttagcacggcaaggaatttatccaggggcacacagctacacggcatctgcgccagaacttgaacttggtgcagtctgacgccagagcccaagcgtgtattcccagggtgtaactggcaccctacctaggaagggctctcgcagtg

SEQ ID NO: 141925 - DNA, 601 bp, Human
gcctggacacataggcggagccctgtagtaattgttcaatgaacggtgaatgaagaaatgagacaaaaccaaagacatctaccctatctgagtagtttcctttaaggttctgaagtactgggttcggggcaaggagtccagcagaggtgaaggggcaagcagctttcccagaaagatttgaaatattcctgctgttggctcacaacaccattctaagtttattcattaacttatccccttggcaaatattttttgaacatccactgtgtgacatacaaaaaagaataaaacgccgtttctrtccttaaagaagaaaggcaagccatattaacaactttgacaaagtcatcaatagctaccatttattgagcacttcctgtgtgccagtcacttactactggttgagcatccctgacctgaaaatccaaaatctgaaatgcttcaaaatccaaaactttttgagtgctgacatgatgccacaagtgaaagattctgcacctgacctcctgtgacaggtcacagtcaaaatgcaggtacattgcacaggttattcagcgtctccaagagagtcactgcacagtgtcctaccttttaatcaaaa

SEQ ID NO: 141926 - DNA, 601 bp, Human
ggaaaacttttcttggctgcaagcataaatggaaagcccttggtatcccagaggaagaaagaggcatcgctgaaatataccaaaagatgggctctgctctccacatgacagcacacaaacacaaatcgatttgttttcagcagtgttttttacactttggcaccttgctttcagatagtcagtggtgcctggacacataggcggagccctgtagtaattgttcaatgaacggtgaatgaagaaatgagacaaaaccaaagacatctaccctatctgagtagtttcctttaaggttctgaastactgggttcggggcaaggagtccagcagaggtgaaggggcaagcagctttcccagaaagatttgaaatattcctgctgttggctcacaacaccattctaagtttattcattaacttatccccttggcaaatattttttgaacatccactgtgtgacatacaaaaaagaataaaacgccgtttctatccttaaagaagaaaggcaagccatattaacaactttgacaaagtcatcaatagctaccatttattgagcacttcctgtgtgccagtcacttactactggttgagcatccctga

SEQ ID NO: 141927 - DNA, 601 bp, Human
atatagtttaatccctcaagaagttcacagtcagcaaaggattttagtccacgccttgcactctcccatgataaagggacagtcacctaacacaggctgtttccccttcaaccaggtctcacttccctgttccctatatgtaacattgtctggtagcccctcctgttaaacacctctggatctttacctgttcacttgtatatttcagcataaggtaaatagccttggatgattctggaaaacttttcttggctgcaagcataaatggaaagcccttggtatcccagaggaagaaagaggyatcgctgaaatataccaaaagatgggctctgctctccacatgacagcacacaaacacaaatcgatttgttttcagcagtgttttttacactttggcaccttgctttcagatagtcagtggtgcctggacacataggcggagccctgtagtaattgttcaatgaacggtgaatgaagaaatgagacaaaaccaaagacatctaccctatctgagtagtttcctttaaggttctgaagtactgggttcggggcaaggagtccagcagaggtgaaggggcaagcagctttcccagaaagattt

SEQ ID NO: 141928 - DNA, 601 bp, Human
ttgagtattttagaggatctcagaaatggtccagtatatagtttaatccctcaagaagttcacagtcagcaaaggattttagtccacgccttgcactctcccatgataaagggacagtcacctaacacaggctgtttccccttcaaccaggtctcacttccctgttccctatatgtaacattgtctggtagcccctcctgttaaacacctctggatctttacctgttcacttgtatatttcagcataaggtaaatagccttggatgattctggaaaacttttcttggctgcaagcataaayggaaagcccttggtatcccagaggaagaaagaggcatcgctgaaatataccaaaagatgggctctgctctccacatgacagcacacaaacacaaatcgatttgttttcagcagtgttttttacactttggcaccttgctttcagatagtcagtggtgcctggacacataggcggagccctgtagtaattgttcaatgaacggtgaatgaagaaatgagacaaaaccaaagacatctaccctatctgagtagtttcctttaaggttctgaagtactgggttcggggcaaggagtccagcag

SEQ ID NO: 141929 - DNA, 601 bp, Human
gtagactgtatagtgaagtctagtctcaaggaatggcataaatgttgaattttataatttttttaaaaaaaacagttgacagagagccaagctggattatctataatttttaaaacactttcaacctttcaagttactatttccttgtaagagttataacaagtcatagatgttttatccccaattataacattacttttgtaaaacaaaatgactatattgtaagtctaggtttataaatataggatgtttctttttctctttggataaaaatgaattataggactgctaatggatatgsagtttatttctggggtgatgaaaatgttctaaaattgattgtggtgacgactgcacaattctgcgaatgtactaaaaaccatcgaatcgtacactttaagtgggtgaattgtatggtatgtgaatcatatctcaatagagctgctataaaaaataaattgtggtgtgttttgagtagagtgatgtgcaaagtaaagtgctgtgctttgtcaccacactgtcatagcatcgtctgcaccggctaggaaacggcttcattagggaactctagaaacatttggttttcagtggattcatcgtc

SEQ ID NO: 141930 - DNA, 601 bp, Human
tttttttgcatttccaattttctataatatatgtgttgttttttaaatgtaaaaatgttcttgcattttaaaacatttgaatatcttagaattaatttaaataatatataagaggataaagtaaaaactctctctcccccacttcctctcactcttagttcaatacgctatagataacaatttcttggctggtctgtcctaaaaggtcagagaatatataagcattataaaaatatgcataccagtatgtatatgtgtgtatgtgttttccggtataaaaatgggatacaaaacataataytgataactttgattttatttttgcacttaacaatctatatttgacaatttacaatattggcctatttaggttggcctaattcttattaatgacagcatagtattccattaaatggatatatagtaatttacttagccagatctctactgatagtttttacttttttccctctagatttttgtgattacaaataaactgcagtaaaccttataaaatactttggtatatttgtgcacaaaatttctagagacagagttgctggatcaatgagggcagactgacgtgtctttaaaattttga

SEQ ID NO: 141931 - DNA, 601 bp, Human
actatggtctcttagcaacagcaggattctcctgaggtctgctgggcctcactgagaaaatcatgttcatacacagaaaatatcaacccttcatgcataatttccctctttttctttaaaaataatctatcagaaagggtttgtaatggatttattatttttgtaaatacgttatatgccattataaaaattcaaaatgtgcaaaaatattaaaagaaggaagcaataaatcaccctaaattaggagttaggggctctccctgctgtgtcacacagcagtcttctgtgtctttcctggacmaccactttttaaagtgtaggacccagacttgtttctctgtctttgtttggagtcagctaatgatttcttaattgttttttcatttttgttttaattctttaaatgactatttgttaactttgttagaaatgtagaagacattctgtaattctgattcattccatcatcgttttctttccccccttaagatttggtgatacatcttatttttaaagaatgaacttagcttttgggtctctgagtcaccgcccaatcctcatttatgacatttattttgacaaacctctcctattaccttga

SEQ ID NO: 141932 - DNA, 601 bp, Human
tttaattttaaagcaccctcttcatgaacaatttatctattttccctcctattccaaatgacagacattaaattacatctctgggtacatgtgattaatcttcaattccaaagtgaagaaaagaagaaaaggttagaaacatctaaaccctcttttcttttttattaggagaaagcagactttgggttgaaaacttgatttatttcccttaaacctatttgaagatcacctttacaacaaggggtcaaatgtggcttgaaatgaattccccatgcagtacttatgtaagtccctgggttayagcatttcaaggctaataaatattgtagttatacgaaggcagccatctaatatgacagcatataggcttttggagggattgtggtctttcaatgaaaaggatctggttagaagggagacattacagttgacttgtggccaagacgcctgaaatcagatgatactctatttgcatttggccctcagccatcaaacaaatcagtcattactgcaatccacaaggcagttatcgttggctaagtaattcacaaaattatttcagtagataacttgctgttggtggctagacttatcatcttca

SEQ ID NO: 141933 - DNA, 601 bp, Human
tcacaaccagccaacatatctgccatcatataagtgacctgctgtcctgttctctggatttctggctgcgtgatctggttgctcacaattcccaagggaggctgcacttgctgctcagccctctcctgtcatctgccttagaggaagttgctttcaaggaagagactgggtgggaaagactgatgaagaaacgggaatttgggaaattctatggccattcgtatcatttcaaaaacaaaacttctagtttcctattctgtgaaaaaccaaaggcaaacaattatctaggaactgatcttgkgagcataatttaatcacctatgtcatgtagctagattgttttcttaaggacagagttataccaataaaaatagaagctttcaagccagacactgtggcatgcgcctatagtctcagctactcaggagactgaggtgggaggatctcttgtgcccaggaattcaagcttggacagcatagtaagatcttgtctcaaaaaaaaaaaaaaaaaaaaaaaaaaaaaaaaaggcttcagtggagagcatgttcacacatacatatgcaatgaaaatttacgaatgaaaaagttctcctggattcc

SEQ ID NO: 141934 - DNA, 601 bp, Human
atatttaagcagctccagtgggtctttaagtacaaggtggaaccccttaaagccgttcacaaccagccaacatatctgccatcatataagtgacctgctgtcctgttctctggatttctggctgcgtgatctggttgctcacaattcccaagggaggctgcacttgctgctcagccctctcctgtcatctgccttagaggaagttgctttcaaggaagagactgggtgggaaagactgatgaagaaacgggaatttgggaaattctatggccattcgtatcatttcaaaaacaaaacttcyagtttcctattctgtgaaaaaccaaaggcaaacaattatctaggaactgatcttgtgagcataatttaatcacctatgtcatgtagctagattgttttcttaaggacagagttataccaataaaaatagaagctttcaagccagacactgtggcatgcgcctatagtctcagctactcaggagactgaggtgggaggatctcttgtgcccaggaattcaagcttggacagcatagtaagatcttgtctcaaaaaaaaaaaaaaaaaaaaaaaaaaaaaaaaaggcttcagtggagagcat

SEQ ID NO: 141935 - DNA, 601 bp, Human
cttggtgccatccatgaggtaatgagtgtgttctcgctctgttagttccagcaagagttctcccaacatctagttgttaaaaagagcctggcaccttcccttctcccttgcctcctctctccatgtgatctctgcacataccagctccccttccccttccaccatgagtggaagtagcttgaggccctcagcagatgcaaatgctggtgtcatgcttcttgtgtagtctgcagaactgtgatccaagtaaacttttttctttataaattacccagcctcaagtattcctttatagcaacayaaatggactaagacagcagtggtatggtctgatttgtgagtctaaaagggaactctggctggcgtgtagaggaaacattgcaaagtggttattctgggtgagaaaggatggtggcatggcctaggatggaggtgatagaaacggatagaaaacaatgacttggagatgatgaggagatagagttcgcaaagcttgaggatggattgcataggggcaggtagacatgcaatcccagctcatatgctccttgtgtatgtactgacgagtgagtcctgctgacagccttgcacagtgcagtgg

SEQ ID NO: 141936 - DNA, 601 bp, Human
ccactgcttagaacccttctaggactctttgttgctcttcgagaatatccttagagtagcctgtaaggcccctccctacttcagctttctgtctcccttttctttgggtgcattattttagtttcttaactgcactaagtaacctcctgcctctgggcattggaatatttatttccctgcaaaaggaacaattccccaatactgccaccttgcctggttaacgttctgttcatacctccacactcaacttaaattcatacattttgcaaatatttactgagtctctgctgttttacgtgcygggatactgtagtgtatcagttgacagggtctctgcttttgtggaatttatactccagcggaggaaatgagccttaaacaaacaaaaacaagaacaagagctgagtttataagaactttgccaagaattaaaagggtgatgtgacagcgagtggctgagtgagtggtttctctatattggtggtcagagaaggtctcttggtgttgatgacgttgaagctgagctctgaacacaggaagaagtcagccgtggatacactgaaggaaacagaggaaagcaggcaccagattaagtcaagat

SEQ ID NO: 141937 - DNA, 601 bp, Human
ctcacaattctagaggccagaagtctgaaatcaaggtgttggcaggtctggagtctctccaaaagctctagaatggaatccgttccttgtcgcttatagtttctggtgactccaggcattccttagcttgtggccacattactcaaatctctgcctccatctttacatggacttctctgtgtgtctgtgttatttccttgacctctttcttaggtggacatttgtgataggattttggttcccaccagaataacccaagataatcccctcatctcaagacccttaacttaattaaacctgyagagacctttttccaaataaggtcacatttacacattgaaacctttcagtgactactatttagcctgctacaatatgtatgacatcactttgataccagcctctcttgagcatttttatcaggaaatctattgttgctccactgcttagaacccttctaggactctttgttgctcttcgagaatatccttagagtagcctgtaaggcccctccctacttcagctttctgtctcccttttctttgggtgcattattttagtttcttaactgcactaagtaacctcctgcctctgggcattg

SEQ ID NO: 141938 - DNA, 601 bp, Human
gttactcatacatccagttccttgtggccacatttattccttgtgacaccttggagagtgccaccctgtctccctgccagtctgtcctctggcacttggatagacaccatttcttgagctgaccataaaacaaagcagctaacttcagttgaggggcatgtcgtgtgaaataggcccacctttatcttctagaatcatgataacagttcacaagggaaagaaggttgactgtggaaacagcaggtgaacatctccaatctcatgctaacgctgggcctacactcattggatggactcatgygcataatggtgcacatctgaattttgatttctctttatcttttttccaaagtgtatgctttagttgccataacaaattacaacaaacttcatggcttaaaatgaccaaaatatatttgctcacaattctagaggccagaagtctgaaatcaaggtgttggcaggtctggagtctctccaaaagctctagaatggaatccgttccttgtcgcttatagtttctggtgactccaggcattccttagcttgtggccacattactcaaatctctgcctccatctttacatggacttctctgtgt

SEQ ID NO: 141939 - DNA, 601 bp, Human
ctgttaatgaaaccgtcaccaaccacctgcttgagtctctaaacaatgcattcgtatactctttctgcaggtctggcagacataaactgagtttcgggctttacactgtagtgtagttgatgcaactgacaatgctgaaggtcttccaatagtctgttaaaattggattagtacccattgcttaaccatcctgagaatatgggaacatggggtcttggtttcttagctgagagtctggaggataaagaatgtcatggggcagaggttagagaaagagacttccacattgctgtgtgcgaamccgagtgttgcagaagggccacaagcatggcccgtgatcaggctgccctctaggtaaggttctttcccttccaggtaccacttgacccctacaatgaccctttggaaacaactccaaaatggtgttcctcactattttggattgaatgcaagtacgatgcaagagattatgcttttcttacctattgagatgtggggattttcaaccttagtcattaagcctggcagtattgcctcaaaaacacaaacatgtaccccttttgctgatttgcagttggggtcttatctttctgaatcctaa

SEQ ID NO: 141940 - DNA, 601 bp, Human
ctaccagaacttaatttcctgaaatgaatactgatctttcctttttcccacatgtcatttgcacttttttgtgccagttgctagtggtgtccttggcctcacccactagatgccagtgccactagatgccagtagcttccctagttatgtgaccaaaaacgtccccacacattcccaaatgtcctctgagggcatattacccctggtagagaaccactgccaatgtcttcattaggcaatgtttcccagaggggccctcaattaactcttacattcttcctccacgctgttaatgaaaccrtcaccaaccacctgcttgagtctctaaacaatgcattcgtatactctttctgcaggtctggcagacataaactgagtttcgggctttacactgtagtgtagttgatgcaactgacaatgctgaaggtcttccaatagtctgttaaaattggattagtacccattgcttaaccatcctgagaatatgggaacatggggtcttggtttcttagctgagagtctggaggataaagaatgtcatggggcagaggttagagaaagagacttccacattgctgtgtgcgaacccgagtgttgcaga

SEQ ID NO: 141941 - DNA, 601 bp, Human
ctggagagtaaagtcccggaaactaagattttaaaagtaccttctaaaaatacagggaggtatgtttaaaccagcacttccactggtccaccacaacttccagaacacccagctcagtgctccagatggcgcccacgtgttcctccacctgcacggggctctagaggcactgctgggagcagaaaccttatgtaacatctgcagaaggctttatggcactgggattttctgtattaacatctcaagagtcacagctcagatctactgttctgatagtatgaatgattctcctttccaaacmctttccttttccctaacagtcacataagagaaaagttcatcttttcctacataacagtgcagaggtctgcaggtgtcctgagggataggcggtttagctccgggagattgcttggtaacccaagttcctactatcttatctctgtcaaacctgagtgttctcatccacaagggtcccagttggtttatgttgccttgtctgagtttcaaccccgggggaaagcagaaaaagaggaaggtttgcagacaccgggcatgaaaagctgatctgttccttgttctaccagaacttaatttcctg

SEQ ID NO: 141942 - DNA, 601 bp, Human
ctcttaatatatctcaactctaaattcagttttctgaattgttcaggaaatggacaagttcatctagaagaaaccatcataagcagtagatgctttgtgctttctaccataccctgattacaaaggcaagcttcctcttaatttggcaaaggtacaaagcctgtaaaaggaataatattcctctctgttgctatatgcaaaagagagtgaggaagcacattcagttccagaggcattttataaaaatggcacaaagtcaatgacaaaaagaacttgcaattctgattctccaattctccartaagttgcccctacatgttcacttccctccccttgggaggcgccctcctagaatatcaaggctgtcaatggttaatgagtcaactctctccttaactcaggaatattctctcctcctgtctccattccaactaagtggtggtccagcttccttctgagcacccccagtgcctgggagattcaccacctcctgcctcatggttttgaatctcagtctccatcctcagtctccagcttgtctgcctggttgagctgaacaaagccatcctggtataatggacaactaaaatttactttctat

SEQ ID NO: 141943 - DNA, 601 bp, Human
cccttgagtgtctagacagccttggtgacatgctgcatgttggctagggaatactctttgaacaagaaatggttttacttttctagtctcttttttgaaaccaaccagcataaaagcactcttaggcagaggcctcttaatatatctcaactctaaattcagttttctgaattgttcaggaaatggacaagttcatctagaagaaaccatcataagcagtagatgctttgtgctttctaccataccctgattacaaaggcaagcttcctcttaatttggcaaaggtacaaagcctgtaaawggaataatattcctctctgttgctatatgcaaaagagagtgaggaagcacattcagttccagaggcattttataaaaatggcacaaagtcaatgacaaaaagaacttgcaattctgattctccaattctccagtaagttgcccctacatgttcacttccctccccttgggaggcgccctcctagaatatcaaggctgtcaatggttaatgagtcaactctctccttaactcaggaatattctctcctcctgtctccattccaactaagtggtggtccagcttccttctgagcacccccag

SEQ ID NO: 141944 - DNA, 601 bp, Human
tgaagtcccttgagtgtctagacagccttggtgacatgctgcatgttggctagggaatactctttgaacaagaaatggttttacttttctagtctcttttttgaaaccaaccagcataaaagcactcttaggcagaggcctcttaatatatctcaactctaaattcagttttctgaattgttcaggaaatggacaagttcatctagaagaaaccatcataagcagtagatgctttgtgctttctaccataccctgattacaaaggcaagcttcctcttaatttggcaaaggtacaaagccygtaaaaggaataatattcctctctgttgctatatgcaaaagagagtgaggaagcacattcagttccagaggcattttataaaaatggcacaaagtcaatgacaaaaagaacttgcaattctgattctccaattctccagtaagttgcccctacatgttcacttccctccccttgggaggcgccctcctagaatatcaaggctgtcaatggttaatgagtcaactctctccttaactcaggaatattctctcctcctgtctccattccaactaagtggtggtccagcttccttctgagcac

SEQ ID NO: 141945 - DNA, 601 bp, Human
tatctgatgctgtggcctaagcaagctgttccatggtgacgaaagcctgggaaatgtctatcggtgtccatggtcaggggcagacaaatgggtgatggtgcatcaggggaagaactgcaagcaactgttctcatatcaacattaaataagaaattcaagatatgaaagctacctgtctatcaaatgtttagtatatcagaaaaaaagagaaacaaactgtctttcagaaatggagttataatgaagtaatagcttggaggatcatggagtctgaaagataattacaaatatttcaactctyggaccacttgccttaaggataagagtgatacttcatgagtcatattgtggattagaataattccaaaggcttgggttgaataacaaaaacagaaacaacaacaacagatttatagtaactacgttttctaaaatgggtcaacataaatccagctgaagaatattgcagtgccaagccgtaaattataaaaaacaaaaacaaaaactccaaccatctttccaaataaagtttagattttccatgttttaattaatttaaataggaattgtattttataatggtgaaaatgcagtgaggaac

SEQ ID NO: 141946 - DNA, 601 bp, Human
aggtaacaatcactttgacatttgcatcgtttaataattcccaatacaatttgtgtcatttaataaataattccctttaataacaatagagacccttcacctgagacaaacaaagaagacactttctaactgacttcatgtcagttttaagaccaaaaaggagaaggtagggttgaggtgctcatcttgtgcatacacagcctctccaacaccagcactagaatccactgagagacaggctcaggccaaggtcactgcagcaatccctgctccaccctctcaatctcactacctttagctycagagccatgaaaggaaactgaggccagagccaaaagtgtgtttaataaaggttcagcgaatacaaatgggaaactcttcataggccagtctcaggtagaataaatgctttaacagagacttccagaatctgaaagattaactttggtggtagaaaggatacaagatgataacgttcttctatttgtgggcaaatctgggtttcctgagtcctcactaagtacattttttgaagctcaatgctttttcttgcagccaatatgctagactccagcaaatctgttcaaccgctctaagatgt

SEQ ID NO: 141947 - DNA, 601 bp, Human
ttcaagcgattctcctgcctcagcctcctgagtagctaggattacaggcacccaccaccatgcctggctaatttttgtatttttagtagagatggggtttcactacattggccaggctggtctcaaactcctgacctcaagtgatccacccccatcaacctcccaaagttctgggattacaggtatgagccaccaggcccgggcctatagcccagatttaatcagagaaagtgagaaatgttttttagttaagactgaacatcctccacagagctcaatattaacctgtcagctggacaarctcagttcttccaggggagttttccatgcagcaattccaggatcactctgtcattctgtggaggtcctcttctctgtgtgtgggtggtatctcccttgaagggagagactttccctgacatcctggggaagggatcatcttcagaaagaaattctcttttctcccaggtgactgactctctgaggccaggtcattgcaaggagggagaaaaggaagttggcatctggtactctcctttgttcattgctcttttggtctacacatcaaggtatctaaaaggtctgctcttggattgcaagg

SEQ ID NO: 141948 - DNA, 601 bp, Human
tctttcacatccttctgtgattgcattaagtagccaaaattttaggggcaataagctggctaggcttatgactttgttctcctttattgctccatgggagttcaccctatagcccagatttatttatttctttattatttgttttgagacagtgtcttgctctgtcatccaggctggagtgcagtggcgtgatttctgctcactgcaacctctgcccctcaaggttcaagcgattctcctgcctcagcctcctgagtagctaggattacaggcacccaccaccatgcctggctaatttttstatttttagtagagatggggtttcactacattggccaggctggtctcaaactcctgacctcaagtgatccacccccatcaacctcccaaagttctgggattacaggtatgagccaccaggcccgggcctatagcccagatttaatcagagaaagtgagaaatgttttttagttaagactgaacatcctccacagagctcaatattaacctgtcagctggacaagctcagttcttccaggggagttttccatgcagcaattccaggatcactctgtcattctgtggaggtcctcttctctg

SEQ ID NO: 141949 - DNA, 601 bp, Human
aggctctcattctctttcacatccttctgtgattgcattaagtagccaaaattttaggggcaataagctggctaggcttatgactttgttctcctttattgctccatgggagttcaccctatagcccagatttatttatttctttattatttgttttgagacagtgtcttgctctgtcatccaggctggagtgcagtggcgtgatttctgctcactgcaacctctgcccctcaaggttcaagcgattctcctgcctcagcctcctgagtagctaggattacaggcacccaccaccatgccyggctaatttttgtatttttagtagagatggggtttcactacattggccaggctggtctcaaactcctgacctcaagtgatccacccccatcaacctcccaaagttctgggattacaggtatgagccaccaggcccgggcctatagcccagatttaatcagagaaagtgagaaatgttttttagttaagactgaacatcctccacagagctcaatattaacctgtcagctggacaagctcagttcttccaggggagttttccatgcagcaattccaggatcactctgtcattctgtggagg

SEQ ID NO: 141950 - DNA, 601 bp, Human
ttttgttttttaatattgatgatttttaatagtattgatactattcattaattcattaatatactaattgatacggtttcattaatataggctctcattctctttcacatccttctgtgattgcattaagtagccaaaattttaggggcaataagctggctaggcttatgactttgttctcctttattgctccatgggagttcaccctatagcccagatttatttatttctttattatttgttttgagacagtgtcttgctctgtcatccaggctggagtgcagtggcgtgatttctgctyactgcaacctctgcccctcaaggttcaagcgattctcctgcctcagcctcctgagtagctaggattacaggcacccaccaccatgcctggctaatttttgtatttttagtagagatggggtttcactacattggccaggctggtctcaaactcctgacctcaagtgatccacccccatcaacctcccaaagttctgggattacaggtatgagccaccaggcccgggcctatagcccagatttaatcagagaaagtgagaaatgttttttagttaagactgaacatcctccacagagctca

SEQ ID NO: 141951 - DNA, 601 bp, Human
acaggaaacaaagcaaccatcattccaggctaatttttgtatttttttttttttttttagagaccaggtttcaccagcctgccttggcctcccaaagtgctgggattacaggcatgagccaccacacccagtctaaagatgctttaacattaaaaaatcaggtggtagttgggtttggggcaataccaatgtttatggagtatttaagtaaaattcatgtttgagtccatatgattaatgaaaaacactaaacaggctattttaagaaaatgtgatgtaatccatatagagacaattcaaygtgcctttccactagttccaagagctatagttgagtagggacaggagacctgggccagagcagtggaggggccctgagagaggggtttccctgacatccagcagctacacttgcctctaggagaactggcaacactgccgaattccttaacctctgggcccggttccagggaaaggaggtggtcctgaggtcactggcacaatccacacatttgtgactgggagttgactgccctgtgaaactctctaaattggtaccatccaaaggaaagtggtaacaagtcacttttggtagcaagtc

SEQ ID NO: 141952 - DNA, 601 bp, Human
cctgtatagctgggaccacaggaaacaaagcaaccatcattccaggctaatttttgtatttttttttttttttttagagaccaggtttcaccagcctgccttggcctcccaaagtgctgggattacaggcatgagccaccacacccagtctaaagatgctttaacattaaaaaatcaggtggtagttgggtttggggcaataccaatgtttatggagtatttaagtaaaattcatgtttgagtccatatgattaatgaaaaacactaaacaggctattttaagaaaatgtgatgtaatccrtatagagacaattcaacgtgcctttccactagttccaagagctatagttgagtagggacaggagacctgggccagagcagtggaggggccctgagagaggggtttccctgacatccagcagctacacttgcctctaggagaactggcaacactgccgaattccttaacctctgggcccggttccagggaaaggaggtggtcctgaggtcactggcacaatccacacatttgtgactgggagttgactgccctgtgaaactctctaaattggtaccatccaaaggaaagtggtaacaagtc

SEQ ID NO: 141953 - DNA, 601 bp, Human
gctagtttttaaatttcttgtagacacaggtcttggtatgttgcctaggttggtctcaaactcctgagctcaaccagtcctcctgcctaggcctcccaaagtgttgggattaaaggtataagccaccatgcctggccccagagctttcccaaatccaagaaaagatcaaaattttgaagtttgtaagttttaaggaggactgcagctgtgaaacttcaagataaacacagttttcttgtaagattaagaaaacaatataaagccaactgaaattttatcagtctttattaaaaccaaagtratgcatattttattcctatttttagagttattttattataatttccctgtgtagataaaaaaaattgcttaaaagaattttacttttgccactgcactccaacttgggtgacagagtgagaccctgtctcaaaaataaaattaatgaattttacttttaacttatacattttactagatctgtgttccaaatatatacacatgtatgaagaatcaaacccatatgaaactccttattccttatgatgctcttacagattctcatttctttaagaagcagctagaagtcattttccaattt

SEQ ID NO: 141954 - DNA, 601 bp, Human
gtcaacaagggaccatatatccgatggtggtcccacaagattacaattctgtattttcactgcaccttttctatgtttacacctgttgagatgtgcaaatgcttatcattgcttacaattgctaggatattcagtacaataacatactgtataggtttatagcctaggagcaataggccataccacatagccatgtgtgtagcaggctataccatctaggtttgtgtatgtacactctaggatgttcacacaatggcaaaattgcctaataacacatttcttggaacacatccccatcatyaagcaacacatggctgtatatgtttctctccctactataatataagcaacttgaaggcaaggactgtggtttaatcatctttgcacccttgggacctaatgcatgtctggaacacagtagatactcaggaaatatttaattaacctggggcattaactgtgagaaatttatacaagcagttgatgtaggttgctgcccccaagtagacagtaagtcaagataatggttaaaggctttgaagagtatctttggaggttctgctggggtgaacactaggaagaattggtgggtgcagagaaa

SEQ ID NO: 141955 - DNA, 601 bp, Human
ccttagctcacactgggagggaatgtcctcctggcccttttttacatccaaatttataaatccttttctcttggaagagctttctgaccctattaatgagatctaacctgtttcctctaggtcatcacagcacttattacactattatagttacatgcatacagtcaagtaccacaaaacaatgttttggtcaacaagggaccatatatccgatggtggtcccacaagattacaattctgtattttcactgcaccttttctatgtttacacctgttgagatgtgcaaatgcttatcattgsttacaattgctaggatattcagtacaataacatactgtataggtttatagcctaggagcaataggccataccacatagccatgtgtgtagcaggctataccatctaggtttgtgtatgtacactctaggatgttcacacaatggcaaaattgcctaataacacatttcttggaacacatccccatcatcaagcaacacatggctgtatatgtttctctccctactataatataagcaacttgaaggcaaggactgtggtttaatcatctttgcacccttgggacctaatgcatgtctgga

SEQ ID NO: 141956 - DNA, 601 bp, Human
taggcttctctctctaccaccgggacactcggatctgcctcctttaggcaaggttattgcaatggtaattgtggtttttgccattaaaagtaaagcaaaaactgcaattacttttgcaccaacctaataaaaccactgggctcagtgcttctatttgcatcgccatctctagaaaaatgaaactcaagtgccagacaagtcatttacaatcaaatgcttttggaacacaacttgtctgaacattgggaacagcatgtactcttagggtcagagctctgttcagactcttcctcttggccayacagaagagcattagcaacttcttaaaatggttcttgacatccagaaagcattacacaccttcttgttgaatcactgctgggataaataattttctttcataaataagtttgacacatgtactgagtacacttggtttttactctgtaatgccagaagtttctaagtgccataacaaggctttgtgacttatttaatagaacttattaaaattcaacttaaaatggcattattttttcagaggcccttattacacaattctttatcttgaatgggaacaattaaactaacacggttgttg

SEQ ID NO: 141957 - DNA, 601 bp, Human
tgaccctttgctcatttatagtaaaaaacacacccctgggtggagatttaagatgctaatgagacatgtgatatatgaacacaaacatacagctacagtgcatgtgcacccagaggaccacccagaacatgcttactagcaacacctcttcccaactccttatgaattatcatgtaagactcccacaaagggggtttctctagcaataatcaacactgcctcacccttgcaagcagcccaccctgaactctctctctcagggtatactgtctattctgcatctaactttcaaaatactctyttccttttgcagtgaatgactctctgccgcatctcctttgctgtgtgtcttttgtttaaattcttttaaactaagaagacaagaaccgaggtatcacaacagccattaacagaagtattgggtgttgcaattggaatcctaataaccaacagtgagagttggcctacgcccttcacagagggcagtggatacagaagttagcctggtgaagcaaggggggcacaatgaaggaaaagtgtcctcagcccagggatctcctgtttcagggctggatacgagaaaggaggccagtgtggtaca

SEQ ID NO: 141958 - DNA, 601 bp, Human
accaaatttgaaacaggatcagtttttagggatcttctaggcccattttaactgggagggattatttgatgcagttgcctatatgccaagatgaaagctcctctggctaaagcatctgggaatgccttcatgcactgacacagcacatggatggggaggttcatttatggcctaaattcaaaagcttggaaatggaaccatcttagaatatacccagtgccctgcctcacaacatgtgctcaataaatgttttcagatggtataaaccctttgtcctcctaaaacaaatgggattgttttyttctctcaagtatggtgtttgcactgatcgtttaaatggtaaaatgaagaatctataagaaagccatatcttataatcattccccaagtgctggaaatgttaattatataagccaatagccacagagctgaatggaaattttctgcctcagttggacaaaatcatactgaagtggaaatacagaaagcagaagaagcgaattctagccccattctgccaagaaagggacatctgagcacagctttacatccctaagctggaggtctcctcaataaataagcaaggagaggagctcccatt

SEQ ID NO: 141959 - DNA, 601 bp, Human
atataacctttagaaaaaatatgcctgctagtgccgttttaatatgctttacagaaagtacagaaaaattatatctctatgtctacttataattaagaagaaaactccatctgcagaaattctggctctatattgccacatggttagtgtgttcttgtactcaatattgggtccgtgtatgaaattcatctagagccaggccctgtacaaaaatctcagcattttgtgttcaaactctccccaatcaaatccatgtgggagatatttttaaaaatctctcaatttcaaggttgaacatcaygaaaacaaaatgcatacatatttacttttggatgatttggtcttttatcatttcaaggtatgcaaaactcttttgtgtattttgctgtaagacttttgcttcagaaatgtgaaaccttcacccaatcacaaaccatatacattgctccattgtttcttttacactgagtctcctactgaatccaagtcatccgaagagagggggcggtacaggtcctgcaagatgaagggcagtatagatttgtttactcggctttcttgggtgccctgtggctctcgtgagagcagcactgaatgggca

SEQ ID NO: 141960 - DNA, 601 bp, Human
agcctggagaatatcaaaaccatgcttcacaagtcttaaactgttagtgtttgaactagtaaaagtaaatgaccactaggatatggcttaaatacaatagaccatacacattaaattaatttttaacattcagactttaaaatcattattttatgtttaagcaaagacgactataatttttaaaatagaggactagaagagcagaattagtaggttaatgtttaacaatgggttataatcatagacttaattggtttaacacaaaaggagttttgcatatgaaaatttccaaaacaccagyaagattgagaatttttcagagtggagatttggatactctgggcctgatttatacagcaccatttaagtgaattttgcttttcaaatggatttcttggaaaaagtccagacacaattttttttaggtctgtatggaaaaaaaaaaaattcccagctttagtttttacacatttaaaaaattatgtatatgattgtaagaaaaaattatacaatctatagcaatgccattggccaagttcttcatattggcatatagcttaagctaaatttatactgtttctaataaaataactttaaaaaa

SEQ ID NO: 141961 - DNA, 601 bp, Human
gccttcaagcctaggacaccattagtggttttaaaactgcatgttaatttcttctcctcaatgagttatcgatatgtctgacaaattcctcctttaaggcaaccctgaaaggaaggtagagtcctgattttaacgcaactacctgaaacagaatttttcatcaaataatcttattttgttattactgtcagcattttatactttagacgttatgtggtaccattctgcagtctctcaaatatcactcattgatgctaattacaacagaagaatgccatacacgtgattgtgaaggtcaccyttatcccacatgtggtcatttcaatttcagtgtctacttatcaaattttctgaaagaaactcactgaacaacataggcagtttttcctgtttattatatagttattctaaggtggtaagtgtcacaaagttaacttcaagaggaataacatggtccagtgtgaaacacaaggtacaacattttacaatgaaaccacagcacaaagtaactgaactttcaaaattgggtagttcaatgaaacattttgtcaacccttagctctataaagctctgctgatggacttagttgatggatttaaa

SEQ ID NO: 141962 - DNA, 601 bp, Human
cacatacacatgcacattttttcccctgcaaattagatcaccttgggaaaaatgccttcaagcctaggacaccattagtggttttaaaactgcatgttaatttcttctcctcaatgagttatcgatatgtctgacaaattcctcctttaaggcaaccctgaaaggaaggtagagtcctgattttaacgcaactacctgaaacagaatttttcatcaaataatcttattttgttattactgtcagcattttatactttagacgttatgtggtaccattctgcagtctctcaaatatcactcrttgatgctaattacaacagaagaatgccatacacgtgattgtgaaggtcacccttatcccacatgtggtcatttcaatttcagtgtctacttatcaaattttctgaaagaaactcactgaacaacataggcagtttttcctgtttattatatagttattctaaggtggtaagtgtcacaaagttaacttcaagaggaataacatggtccagtgtgaaacacaaggtacaacattttacaatgaaaccacagcacaaagtaactgaactttcaaaattgggtagttcaatgaaacattttg

SEQ ID NO: 141963 - DNA, 601 bp, Human
aggtcaggagttcgagaacagcctggccaacatggcgaaaccctgtctctactaaaaatacaaaaattagctgcatgaggtggtacacacctgtaattctagctactcaggaggctggggcacaagaaccgcttgaacccagaaggcggaggttgcagtgagccaagatcgcaccactgcactccagcctcggcaacagagcaagactctgtctcagaaaaatatgtatatattttttctagcttggtcagcagaatttcctatcctctttaacatccttttctatccttttggaaatgaratatattatgatttttgttctgagttagagtcaagtattttattatcattattttaattaactttatttttaaaactatatatttatccagtgattttaaaagaaatagcttgtataaatacacacacagacatgctcacatacacatgcacattttttcccctgcaaattagatcaccttgggaaaaatgccttcaagcctaggacaccattagtggttttaaaactgcatgttaatttcttctcctcaatgagttatcgatatgtctgacaaattcctcctttaaggcaaccctgaaa

SEQ ID NO: 141964 - DNA, 601 bp, Human
catctcaaaaaaaaaaaaaaaaaaaaaaaaaaagaagttcttctgtaagttatgttgaaattatgtccctccatgtttgccatttattggtcctatctctgatttctagagttgcccagtacaggtctaatccacttttcacatgacagtgcttttaggtgtttgaaaatagctactggtctccgtctgtgtcttccaagcactttgggaggctgaggcaggaggcttgcttgagcccacaaattcaagaccaccctgggcaacatagtgaaaccctgtctctccaaaaacaaaaaaaaaacctggtgcttgaaagtgaatgcaatattctgggtgtgctctgactagcacaaagcagagaaggatagggttttctttctcatgaatagaatattaattcacttcaagatcttactggcttatgtggatgaggccatagcatttcacctttacaatgagcccacagctatgtcatgtctccctggtgtgtgtttgaaaggttgtcctgggccaagtccaggacttcacacttcctcacgttaaatgtcatctttattacattaatatccttccagtctgttatcttttagattctgatctg

SEQ ID NO: 141965 - DNA, 601 bp, Human
tcaaagagtttgggggactgggatggaccttaaatattacctattctgccccacttccattcagagaccaaatgccccctacagaaatcccagtgggtggtcagatggcctctgtccaaatacttctagtactgaacatactacttcctgaggcagcccttcatcattaatgggaggcaaaataaaggaagttctcctgctaaaaatacaaaaaaaaaattagccaggcatggtggcgggtgtctgtagtcccagctaatcgggaggctgaggcaggagaatggcgtgaatccaggaggcrgagcttgcagtgagccgagatcgcgccactgcactccagcctgggcgactgagtgagactccatctcaaaaaaaaaaaaaaaaaaaaaaaaaaagaagttcttctgtaagttatgttgaaattatgtccctccatgtttgccatttattggtcctatctctgatttctagagttgcccagtacaggtctaatccacttttcacatgacagtgcttttaggtgtttgaaaatagctactggtctccgtctgtgtcttccaagcactttgggaggctgaggcaggaggcttgcttgagccca

SEQ ID NO: 141966 - DNA, 601 bp, Human; identical to SEQ ID NO: 31080

SEQ ID NO: 141967 - DNA, 601 bp, Human; identical to SEQ ID NO: 31081

SEQ ID NO: 141968 - DNA, 601 bp, Human; identical to SEQ ID NO: 31082

SEQ ID NO: 141969 - DNA, 601 bp, Human; identical to SEQ ID NO: 31083

SEQ ID NO: 141970 - DNA, 601 bp, Human; identical to SEQ ID NO: 31084

SEQ ID NO: 141971 - DNA, 601 bp, Human; identical to SEQ ID NO: 31085

SEQ ID NO: 141972 - DNA, 601 bp, Human; identical to SEQ ID NO: 31086

SEQ ID NO: 141973 - DNA, 601 bp, Human; identical to SEQ ID NO: 31087

SEQ ID NO: 141974 - DNA, 601 bp, Human; identical to SEQ ID NO: 31088

SEQ ID NO: 141975 - DNA, 601 bp, Human; identical to SEQ ID NO: 31089

SEQ ID NO: 141976 - DNA, 601 bp, Human; identical to SEQ ID NO: 31090

SEQ ID NO: 141977 - DNA, 601 bp, Human; identical to SEQ ID NO: 31091

SEQ ID NO: 141978 - DNA, 601 bp, Human; identical to SEQ ID NO: 31092

SEQ ID NO: 141979 - DNA, 601 bp, Human; identical to SEQ ID NO: 31093

SEQ ID NO: 141980 - DNA, 601 bp, Human; identical to SEQ ID NO: 31094

SEQ ID NO: 141981 - DNA, 601 bp, Human; identical to SEQ ID NO: 31095

SEQ ID NO: 141982 - DNA, 601 bp, Human; identical to SEQ ID NO: 31096

SEQ ID NO: 141983 - DNA, 601 bp, Human; identical to SEQ ID NO: 31097

SEQ ID NO: 141984 - DNA, 601 bp, Human; identical to SEQ ID NO: 31098

SEQ ID NO: 141985 - DNA, 601 bp, Human; identical to SEQ ID NO: 31099

SEQ ID NO: 141986 - DNA, 601 bp, Human; identical to SEQ ID NO: 31100

SEQ ID NO: 141987 - DNA, 601 bp, Human; identical to SEQ ID NO: 31101

SEQ ID NO: 141988 - DNA, 601 bp, Human; identical to SEQ ID NO: 31102

SEQ ID NO: 141989 - DNA, 601 bp, Human
attgagctgtaaagttgggagactccaaaaaagtctaaaagggcttcctttttttttccccaagtaaaaacttctttttacttttcttttctttcttttctctctctctttctttcaagacagggtctcactctgtcacccagactggagtgcagtagtgtgatcacagctcactgcagccttgacctcctgggctcaagagatcctccagcaacctcagcctcctgagtagctgggactacaggcacacactacgatgtccggctaattaaaaaaaattttttttgtgtagagatggggstctcactatgttgccccaactggcaagtaaaaactttctaacataaaagtgcctaagataaatgacatttgtgtctgtgtaacttgtcgctatcttgtcctagcccaaggtgttcaatacagccctacccttcgcgagttcaattcccattcttgtgcctggtttttgtttgctaataaatcaggtgttcttaagggcgcattaactcatctagatcaacctaaaaggctagtttccaactagctcctgaaggctaactggaaattaacctttcaggtaaatttttaaaaaaagaaagaa

SEQ ID NO: 141990 - DNA, 601 bp, Human
ttttggatcatattattgagctgtaaagttgggagactccaaaaaagtctaaaagggcttcctttttttttccccaagtaaaaacttctttttacttttcttttctttcttttctctctctctttctttcaagacagggtctcactctgtcacccagactggagtgcagtagtgtgatcacagctcactgcagccttgacctcctgggctcaagagatcctccagcaacctcagcctcctgagtagctgggactacaggcacacactacgatgtccggctaattaaaaaaaattttttttktgtagagatgggggtctcactatgttgccccaactggcaagtaaaaactttctaacataaaagtgcctaagataaatgacatttgtgtctgtgtaacttgtcgctatcttgtcctagcccaaggtgttcaatacagccctacccttcgcgagttcaattcccattcttgtgcctggtttttgtttgctaataaatcaggtgttcttaagggcgcattaactcatctagatcaacctaaaaggctagtttccaactagctcctgaaggctaactggaaattaacctttcaggtaaattttt

SEQ ID NO: 141991 - DNA, 601 bp, Human
aatgctcaggggtggataatgaaaggaagaactagcatctttgggaaaagatatatatataaatatatgtatatatatatatatatatgcacagtatatagaaatgaaatatatttcattaaattccagcctgaagagccagcaacatttatattactcccatatttcccagtgaagcaccccatacttagtctctacctcctctttttttcctatgtattccccttaataactgggtgaggaaggacccccatttgcttttgtggagatctctcaaggtttccccagagatgtggagtamatgaaaagcaaaccaaatagtgtaaagttgggggaaggatgtctccgtttttaaaaattagtctttttcaaaattgtttttatgctaaggggctagagtcttaaaaaccaattataatttttttttcttttaggttttggatcatattattgagctgtaaagttgggagactccaaaaaagtctaaaagggcttcctttttttttccccaagtaaaaacttctttttacttttcttttctttcttttctctctctctttctttcaagacagggtctcactctgtcacccagactggagtg

SEQ ID NO: 141992 - DNA, 601 bp, Human
cagaaatttgcatttttaacaggcatctgggaataattttgattcagggagtctttagaccaccctgcagaaacactactttagaaagagaatcctcttttcccagatttctgaagagacgggcaaagtaacagaactcatatatttatacataatgctcaggggtggataatgaaaggaagaactagcatctttgggaaaagatatatatataaatatatgtatatatatatatatatatgcacagtatatagaaatgaaatatatttcattaaattccagcctgaagagccagcaacayttatattactcccatatttcccagtgaagcaccccatacttagtctctacctcctctttttttcctatgtattccccttaataactgggtgaggaaggacccccatttgcttttgtggagatctctcaaggtttccccagagatgtggagtaaatgaaaagcaaaccaaatagtgtaaagttgggggaaggatgtctccgtttttaaaaattagtctttttcaaaattgtttttatgctaaggggctagagtcttaaaaaccaattataatttttttttcttttaggttttggatcatat

SEQ ID NO: 141993 - DNA, 601 bp, Human
gatttggtagggctgcatctaggcccagaaatttgcatttttaacaggcatctgggaataattttgattcagggagtctttagaccaccctgcagaaacactactttagaaagagaatcctcttttcccagatttctgaagagacgggcaaagtaacagaactcatatatttatacataatgctcaggggtggataatgaaaggaagaactagcatctttgggaaaagatatatatataaatatatgtatatatatatatatatatgcacagtatatagaaatgaaatatatttcattaaattccagcctgaagagccagcaacatttatattactcccatatttcccagtgaagcaccccatacttagtctctacctcctctttttttcctatgtattccccttaataactgggtgaggaaggacccccatttgcttttgtggagatctctcaaggtttccccagagatgtggagtaaatgaaaagcaaaccaaatagtgtaaagttgggggaaggatgtctccgtttttaaaaattagtctttttcaaaattgtttttatgctaaggggctagagtcttaaaaaccaattataattttt

SEQ ID NO: 141994 - DNA, 601 bp, Human
gacatgtgtctctcttgttccctggcacagtacctgacacatagcaagtactcagttaacctctccttaatgcagagcttactgtagtgtagtagtatgagctaaggctctggaagtcagaattaggttgagaccttggctcttctacttaagagctgtgacaaccgtgggcaggtcatttaacttctaggtacccatgttccttacctatgaaatgaaacagtaatagaacttacccaatgtggttgctgtgaggatgaaacgagataatgactgtaaagacgttagcacagggccaagyacatagatggttctccatcatggcggatcttactagcttttatttgtgtcatgggagttgggtggctcatctgcttttagacttgagtgtgtatgcgggttacctgggggaggtggctgccttgtggatttctgcaagctgtcatcagtcactggattctgatttggtagggctgcatctaggcccagaaatttgcatttttaacaggcatctgggaataattttgattcagggagtctttagaccaccctgcagaaacactactttagaaagagaatcctcttttcccagatttctgaa

SEQ ID NO: 141995 - DNA, 601 bp, Human
taaatgactgcaattgtttctccatatagttcagcttcttaaattagaagagaagggaaaaagaaaggagagaacattttttttcttttgtggtaatttaaagtaaaatatatttgaatgagcataatacattagaagtatcacgtaaactgtaattttagtaaaagtgcactccaatgtaatcacttatggcatttacagaaatagataacacttcagcgaggagtaagtgaacaatgggtacacaaaactgagcagcaaaagcaaaaaggaaagaaaatgaaactttaattttcagtcrctgaagtttgggagcttagagaagtttttaaacaaaggcccagttgtaagtctgttcccatgagacaatcctacataattcaagacacaggaaaaatgagtgcagatgagagaaaattgctgcagttgatggaggtaactatgcagaagaatatgtttaggctactgtgaagatgaggaatttaaggtgcaattaagtcagggctcagtcacttgacctcagctgccttttattagccagtagctacaagattaccagcataattgcaattaactaattgtgtgcatatttgtttcttga

SEQ ID NO: 141996 - DNA, 601 bp, Human
cccactgctcagtgaagtttacactgaggccagtgtgagaactccgtctaacaggccagttgggaatgttttgggcttgccaggcggctctgtcctctgttcatagaagtatcactcattcactcactcactccactcatccactctgacgtccacctgtccatacaattattaagtaccaggcatgacaaccagtaaagcaacaagaaccatgtaaaatcatgggcatgatcaatttggggggaaaaactttagttaaatacaacaataaatttataaggggtattttttattgggtcartgcccagttttcacctaaaatgtggctgaaaacatccctgtaagtcaaatcatattttctcatcaaaatactttaacccaaccaaacactagagttaaataaatcattcatacaatcaatatagatccttaagaccaggctacatttttatgctgttctataagaattaaaaataaaaaacgctaaaagttctacatacacaattatactgtgtacaatgaaatctatagctgaattagatatgtattaaaaatactttgctagttataacaaatattaatctaacacttagctaacaaa

SEQ ID NO: 141997 - DNA, 601 bp, Human
ttttctcctgcagggtcttggggactttgggagggaaaagatttttgaatgtttatatttgaagaaaacgactatgtttgtttctggaatctaataaaaactagtgatgtgagttatagtttggttagtaaagatttaattttcataaggaggaggcatctgtgtacacatttttgaaagacctgcccaggtccttgaaagaaacacaagctgctactgatggtttttattgctaagggtacaagcttgccatctagtggtgacttgtgtaaactgaaggtattaatttttttttttttaattaagcaaaaagttcctttagtcatgaaccatcatggcatgcatacacacatacatatacacatacacacatacacgcatacatacacagtggtcccatgcctaagcccatctggagaagcatcatactttctcccactgctcagtgaagtttacactgaggccagtgtgagaactccgtctaacaggccagttgggaatgttttgggcttgccaggcggctctgtcctctgttcatagaagtatcactcattcactcactcactccactcatccactctgacgtccacctgtccataca

SEQ ID NO: 141998 - DNA, 601 bp, Human
gtttttctcctgcagggtcttggggactttgggagggaaaagatttttgaatgtttatatttgaagaaaacgactatgtttgtttctggaatctaataaaaactagtgatgtgagttatagtttggttagtaaagatttaattttcataaggaggaggcatctgtgtacacatttttgaaagacctgcccaggtccttgaaagaaacacaagctgctactgatggtttttattgctaagggtacaagcttgccatctagtggtgacttgtgtaaactgaaggtattaattttttttttttwaattaagcaaaaagttcctttagtcatgaaccatcatggcatgcatacacacatacatatacacatacacacatacacgcatacatacacagtggtcccatgcctaagcccatctggagaagcatcatactttctcccactgctcagtgaagtttacactgaggccagtgtgagaactccgtctaacaggccagttgggaatgttttgggcttgccaggcggctctgtcctctgttcatagaagtatcactcattcactcactcactccactcatccactctgacgtccacctgtccata

SEQ ID NO: 141999 - DNA, 601 bp, Human
cacaacctgtcatcgtcatttgggtggaacaggactagcttattgctagatataatccactgcgtgaaaacaaggaccatgagttgcacgtgtcattttgatgggcagctgggagcaggcacaaacacttgaacacagagtttctagccaaggagaggcagtttttctcctgcagggtcttggggactttgggagggaaaagatttttgaatgtttatatttgaagaaaacgactatgtttgtttctggaatctaataaaaactagtgatgtgagttatagtttggttagtaaagatttamttttcataaggaggaggcatctgtgtacacatttttgaaagacctgcccaggtccttgaaagaaacacaagctgctactgatggtttttattgctaagggtacaagcttgccatctagtggtgacttgtgtaaactgaaggtattaatttttttttttttaattaagcaaaaagttcctttagtcatgaaccatcatggcatgcatacacacatacatatacacatacacacatacacgcatacatacacagtggtcccatgcctaagcccatctggagaagcatcatactttctcccac

SEQ ID NO: 142000 - DNA, 601 bp, Human
tccattactgtttctgaaattgacaataacacaactacaccaaaactaacttagtctctagggatttatgtttatctcttgtttaatttcttcttaccagttttggacctttatagagccaaaaatatttttggatttcacttctgtcattggtataattcatcttcatttgaagtcactggtaatgatgaatagggcaggattggggccagactcacagaagatcactggctcccttcctttgggtaacctccaatccattagtcaatacactctgagggctcaagttctgtgtttttgyccatgacctctagacccattctctctgtggcactcatcttgtccaccagtgcagttagctatcctatcaccaaatggatttatttggagaattaagagtcatgggattaaggtgaaggaaatatgttatcttgtgagcatggaattgaaaactaggaagagctggagcacaacctgtcatcgtcatttgggtggaacaggactagcttattgctagatataatccactgcgtgaaaacaaggaccatgagttgcacgtgtcattttgatgggcagctgggagcaggcacaaacacttgaa

SEQ ID NO: 142001 - DNA, 601 bp, Human
atgtgttcagagtattaccataaggggtaccatggtaagccacaccaaggactctcctgactctttcagggaaagaagtctaagggcatatgaatatttttagcaggcttgtcatactgagactcacactgaacgaacagccttctccaggtcaactaatagccttttgacctgcagtcaggccaagtattccattactgtttctgaaattgacaataacacaactacaccaaaactaacttagtctctagggatttatgtttatctcttgtttaatttcttcttaccagttttggacctytatagagccaaaaatatttttggatttcacttctgtcattggtataattcatcttcatttgaagtcactggtaatgatgaatagggcaggattggggccagactcacagaagatcactggctcccttcctttgggtaacctccaatccattagtcaatacactctgagggctcaagttctgtgtttttgtccatgacctctagacccattctctctgtggcactcatcttgtccaccagtgcagttagctatcctatcaccaaatggatttatttggagaattaagagtcatgggattaa

SEQ ID NO: 142002 - DNA, 601 bp, Human
tcatgaaactatcttaaaaggagttctatgcagctgcagcgagatacacaaaacatgcacattccggattctgttaggaattatacatcccaggattttgccaaaactgtgggaactcaatgccactgcaattttaaaaaacgttattacatttctgtcacacaattattatccaatatgtcatagtaggaaaatgatcactatagacgaaaaggaactaaactcacccataatcttgacactcagaaataaacactgttcatattttgggacatggacttccagagctttctttctctcyttcctatccttctttttccattgaacaacatatcctgaatgtttttccgaagtgaatcgcatatatctatacaattactctcagtggctgcaggatattccatatggcaccatattagtaatcccaacagttactattaccactgtcatttattgtacacacaggacataccaggcattgtgatgaagacttcatgtgcattttggcccatttgatcttcataccagccctattaatttagcactcttactcatattttgcagatgagaaaattgagattcgaagatgtaaagtaattta

SEQ ID NO: 142003 - DNA, 601 bp, Human
cggaaactccaggaaacctgattctcaccctcaatttaaaatagtcatgaaactatcttaaaaggagttctatgcagctgcagcgagatacacaaaacatgcacattccggattctgttaggaattatacatcccaggattttgccaaaactgtgggaactcaatgccactgcaattttaaaaaacgttattacatttctgtcacacaattattatccaatatgtcatagtaggaaaatgatcactatagacgaaaaggaactaaactcacccataatcttgacactcagaaataaacacygttcatattttgggacatggacttccagagctttctttctctccttcctatccttctttttccattgaacaacatatcctgaatgtttttccgaagtgaatcgcatatatctatacaattactctcagtggctgcaggatattccatatggcaccatattagtaatcccaacagttactattaccactgtcatttattgtacacacaggacataccaggcattgtgatgaagacttcatgtgcattttggcccatttgatcttcataccagccctattaatttagcactcttactcatat

SEQ ID NO: 142004 - DNA, 601 bp, Human
agtattttgtaagctactcttgggatcattgcagatggctacagtcggagaagttgttctctagggtttattatatggctataaagacatcctatgatttgacagactaaatgtgttaaatggcaacaattatgaaaaaggttccaattaaaacctgaaggcatatccaaccaagaacagatataacgaaaggtcaggtatgtagattttggggcacactggtattttgcacaggattgtttttgaaaggagggttttatttttgtttcttttttgtttatttggggttttgcattagctrcaacttactgaacagtagatctttaggcatatgcttgatttcccttggatgggaaactgagaccatttggaaaaattatttgaaaaaataaaacatttaatatatagtcataaaatgcagctggtggccataaaataatatgaaaattcacagataacctgaacccagtcaaaaggtttctgagattcccataatatggcactaaaagctgactaatgtaacagatgtgttggaacaaacgtaattctcagtgtttctacgaatccaagggtaaccctgatgaaacgttggctaatgaat

SEQ ID NO: 142005 - DNA, 601 bp, Human
tctccagaaagtattattccaaatggcagccataaatccactttgaactaaatttttaattaaaagttagaaatcagaaaggcttctaacaagttcacattgaaaatgccaaatccttggcttagactgctctctggattgacttgttacttggcgttcctccttattctgaccatctttcagaaagggcatgagcaggctgcaagcgcaggcttggacaggctggtccagctagtggagctgtggtgtaagaactttttgccataactgtattttaaagcctctataaaatgtgacccayacgtgaagtgggagtacattaattgtcagtcaaggagtattcacaacatgaggtatgatttaatgttcatccctggtcctttaagtactatagatgttcccccacattttaaacactgaggggctattaaagggacagggattagtgcaaattacccagtatgtagtgctttcactgttttaactaagcaataaaactgtgtaattgtacaacactaattgaatgcagctacacataattgtgggctgccatatgtatcatattaccataaagactgtcagtattttgtaagctactctt

SEQ ID NO: 142006 - DNA, 601 bp, Human
caacggggactcttcattagcacctgctacggcctgagctacgtgcacccttatctcttactgagccagttacacaggggcatgactgaggccatgtgaaaatataattaaacctttgttaaaaaatcacagattgctaaatacacccatttaaagcctgcacgcgcgcacacacgcacacacacacagcctcacaaaaccatctccagaaagtattattccaaatggcagccataaatccactttgaactaaatttttaattaaaagttagaaatcagaaaggcttctaacaagttcacrttgaaaatgccaaatccttggcttagactgctctctggattgacttgttacttggcgttcctccttattctgaccatctttcagaaagggcatgagcaggctgcaagcgcaggcttggacaggctggtccagctagtggagctgtggtgtaagaactttttgccataactgtattttaaagcctctataaaatgtgacccacacgtgaagtgggagtacattaattgtcagtcaaggagtattcacaacatgaggtatgatttaatgttcatccctggtcctttaagtactatagatgtt

SEQ ID NO: 142007 - DNA, 601 bp, Human
cgaggcagagcagaattgtttacttccttaattccattttgttaacaataacctttctaaaatgcaaaataatctcctgctttgatgttctgctaggtccaaacattcattctgtgtgctttgtgaggtgatgcagattgtaatttattcaacccacttgatgcaggaattttgtagcttttttcttaaacacagtatctacaccacctaactgtactcaaaagtttgacaaaagcagatgttggtggattcagtcataagtcccattttagttctaaatatgaccttgtaattctcctayatgtaggaaaagttttcttttcgaacatctacattttaatagaaattccatctaacatatagccatagaccaattatatttaatatgaatgaacaatatagttcaaagtttcaataactaagaaaaaatcactaaaaatcttccttaaaataaagaaaatgagtactaatacaaaatgattattaaaagtaataataagtctacgaaaatgaaaaccattgaagtacatagaaccataattgtgatgttctttttattccctgtacaatggtcttttaatcacttgcacagtgccccgcc

SEQ ID NO: 142008 - DNA, 601 bp, Human
tagtaaaatactttattttcagtgcctcgtattttcaacatgatctatttacatttcttaataattgaaagagatattaacatttcatttcacctgtggcaatttggaaagatttatcaggtgcagagtcagcatcctgtccaggtttcccttattaaggcagtaaaaatcttctctctttcacccaacaaatcaagaaaaggatgcatgtgactgtaggcaagtatttatactcctttaattccagccacgatcaaaacaaatggagctgctctaaaaagtatcccaaataacttatttyatttcaaagaaaagatgaaagggcgttcagaatcctaattgagtcccctctgttggaatgaataagattaagaaaagaaaaccacagtaaaaggctagtaattccagcaagggcaatcttcacgaaatgcctcaaggaagcagctaagttttccatgtacatcaaaatacttgatccagcaagccgaggcttgcatattctcctgttctcactctgtgatcatctgttacttgctgcagtagtttgaatcttttgcacagcaaggcacatctccacacatcaggggcaccgctactgttc

SEQ ID NO: 142009 - DNA, 601 bp, Human
taaattatagtacattcatacaacgagaggttacatgaccttaaaatggcgatacaggtttatagttattgaattatgtttgggaaatgagcagagcaattttcagattggtttttataaaatgtccattaaagaaaaaaagtacatacaaaaaaaaaagaaaaagtctgaaagaacacagtgccgatgtatctgtctcttggtggtaggattacaggttttcttaatccttttgtttatctgtctttgatgttgtctataattaaaactgatttgcataataaaatgaagtatagaaagyccctagtgcagtgtctccgatttatgaaaataatctctttgtttcaatatattaagaaaacttgccgggagctgtggctcacgcctgtaatcccagcactttgggaggccaaggcaggtggatcacctgaggtcaggggttcaagaccagcctggccaatatggtgaaaccctgtctctactaaaaatacaaaaagtagctgggcgtggtggcgggcacctgtaatctcagctactcaggaggctgaggcaagagaatcacttgaacccgggaggtggaggttgcagtgagctgagatca

SEQ ID NO: 142010 - DNA, 601 bp, Human; identical to SEQ ID NO: 31103

SEQ ID NO: 142011 - DNA, 601 bp, Human; identical to SEQ ID NO: 31104

SEQ ID NO: 142012 - DNA, 601 bp, Human; identical to SEQ ID NO: 31105

SEQ ID NO: 142013 - DNA, 601 bp, Human; identical to SEQ ID NO: 31106

SEQ ID NO: 142014 - DNA, 601 bp, Human; identical to SEQ ID NO: 31107

SEQ ID NO: 142015 - DNA, 601 bp, Human; identical to SEQ ID NO: 31108

SEQ ID NO: 142016 - DNA, 601 bp, Human; identical to SEQ ID NO: 31109

SEQ ID NO: 142017 - DNA, 601 bp, Human; identical to SEQ ID NO: 31110

SEQ ID NO: 142018 - DNA, 601 bp, Human; identical to SEQ ID NO: 31111

SEQ ID NO: 142019 - DNA, 601 bp, Human; identical to SEQ ID NO: 31112

SEQ ID NO: 142020 - DNA, 601 bp, Human; identical to SEQ ID NO: 31113

SEQ ID NO: 142021 - DNA, 601 bp, Human
ctgtcattcaggttggagtgcagtggcacgatcttggcttactaccacctctggtttccagggtcaagcaatcctaccacctcagcctcctgagtagctgggaccacaggcttgtgccactatgcccagctaattttttgtattttttggtagagatggggttttgccatgttgcccaagctgtcctcgaactcctgagctcaggcaatccacccacctcggcctcccaaagggctgagattacaggcgtgagacactgcgcctggcccacaacactttcaaaaggaggcaataacattakaaaatctgcaactgatttttaaaaggaatgttaggagagaacaaaggaaatggtgcgagtcacttacattaacccagggatgctcaagtacttgaacagcagaaaatcgctgatctacatcgaccaacagcatcatggtaatgagctcctgtgaaggggaacgttagagtccatttatctgaatttaaggtgaaaagctgtatgtgtgcaaatgcaagagttctcttttagtttcgaaaagcatttgtaaaagctctaaatcttaaatacatcaactccacttacctgtggctatttatc

SEQ ID NO: 142022 - DNA, 601 bp, Human
acacaacacttttttcttttttttttagatgatgtctcactctgtcattcaggttggagtgcagtggcacgatcttggcttactaccacctctggtttccagggtcaagcaatcctaccacctcagcctcctgagtagctgggaccacaggcttgtgccactatgcccagctaattttttgtattttttggtagagatggggttttgccatgttgcccaagctgtcctcgaactcctgagctcaggcaatccacccacctcggcctcccaaagggctgagattacaggcgtgagacactgygcctggcccacaacactttcaaaaggaggcaataacattagaaaatctgcaactgatttttaaaaggaatgttaggagagaacaaaggaaatggtgcgagtcacttacattaacccagggatgctcaagtacttgaacagcagaaaatcgctgatctacatcgaccaacagcatcatggtaatgagctcctgtgaaggggaacgttagagtccatttatctgaatttaaggtgaaaagctgtatgtgtgcaaatgcaagagttctcttttagtttcgaaaagcatttgtaaaagctctaa

SEQ ID NO: 142023 - DNA, 601 bp, Human
tatgccttcttgatgattattcagctctaatctggaccgcagaaagcaggttgcggggtagaagattgagaccactggcacctcaccagttagaaggcagtctcatcagaataaaatgtaatggatacatcagatgccctcgtggaacaagtataagatcctgtaactgtcctggcacatatgagggggaggaacaaaatggaacacaacacttttttcttttttttttagatgatgtctcactctgtcattcaggttggagtgcagtggcacgatcttggcttactaccacctctggttyccagggtcaagcaatcctaccacctcagcctcctgagtagctgggaccacaggcttgtgccactatgcccagctaattttttgtattttttggtagagatggggttttgccatgttgcccaagctgtcctcgaactcctgagctcaggcaatccacccacctcggcctcccaaagggctgagattacaggcgtgagacactgcgcctggcccacaacactttcaaaaggaggcaataacattagaaaatctgcaactgatttttaaaaggaatgttaggagagaacaaaggaaatggtgc

SEQ ID NO: 142024 - DNA, 601 bp, Human
tcctgagtagctgggattacaggtgcgcaccaccacacccagctaatttttgtatttttagtagagatggcgtttcaccatgttgaccaggctggtctcaaactcctggcttcaagcgatctgccggcctcagcctcccaaagtgctgggattacaggcgtgaggcactgcgcccagccaactatgagtattattaatcaaaacaaatttcacccatcggttgtagagaaacacagaattaaaaaataatgactctgctctggagaattccttcatagttaatgaaatatcattagacccrtgtactcaaagaacagccacagaggcagcatcggggagattttagaaatgcagagcctccaatctactgtgttagaatctgcgttttaacaggctctccaggtgatttgtgagcacattcaagtttgagaagtgctgaaatggagtagcccaaggtttatgtcgaaacccttaggtcacttgcactttgggtaggaatcatgcaaaaagcaggactgactcagaaagtctgttatgccttcttgatgattattcagctctaatctggaccgcagaaagcaggttgcggggtagaagattg

SEQ ID NO: 142025 - DNA, 601 bp, Human
actggggaagctgttctcactaccctggaactgtctggttgtatcagactttgttcctagaaggcagggctggcacacagtgtctctctgataaaaatgtatttagaaatctctacatataatttttcaaaaaaattgctcagttgtggtggtgcacacctggggtcccagctacttgggaggctgaggcgggaggattgcctgagcccaggaggtcgaggctgcagtgagccatgattgagccactgcattccagcctgggtgacagagtgagaccctgtctcaaaaaaaaaaaaaaaaagtaaaatgattatttgtcacctatgaatatctttcctctatggctcttcaggagccttttaaggccacatgtcaaattcagattgtctagtttcttctgtgtggtcaccctgtctcagtttctccagagctaatatgcaatttgacaatttatggatggtaagcttttattttttttctttgaaatttaaagaaaaaatttattgaagatctgaaaaacaattcctaaaagatcaacttttccagaaaactagctacacaacgcattacgtctatcatgttaaaacatgcattagacaca

SEQ ID NO: 142026 - DNA, 601 bp, Human
atttcaaaagttaagcactcacttaatcgagtctttaaaaagcttttattaagaccatttttttttctaggatggtaagtctgtttgaattacagaaagggtattttttttttagttttcgatctcctagatgattacttaaattctctccctgcttttagaaaatgcctgtaggaaatcagagaggaaaaactgaaatggacagcagaagtctaaggtccagagggagcaatggaacataattatcagcaaagtgggaccatgtgtaaaactgtgcacaaaaccaggtagaagaggcagwaagttactgctgagacacgtatatattgccataatgagcaacctgttttttcactggtaacagccagaagccttcttaattttgtttctttaccacagttgagttgggatattattaatatagggccatttggtctggaatcaggggaagattcatgtcgttcccaacagcattccagacccctcatgtatataaacaaatttgctcacatttacaaagttatcttctagcaaacatgcacattctgctggaactgactgtcagatatcttcttcccagtcttctccaggattgagctct

SEQ ID NO: 142027 - DNA, 601 bp, Human
tgtttgtttgttttttgagacagagtctccctccatcacccaggctggagtgcagtggctcaaacttggctcacagcaacctctgcccccaggttcgagccatcctcattcctcagcctccccagtagctgggattacaggcacccaccaccatgctgggctaatttttttttttttttttttaagtagaggtgtggcttcactacgttggccaggctggtcttgaactcctggcctcaaatgatccacctgccacggcctcccagagtgctggggttacaggcatgaaccactgcacccrgccaagactgccttttcaattccaagtatgccaagtaaaaaagtcatggtataagcaatagagaaaattagaactaatgagagcagagaaagtgctttttgacaacgtccttacggttcacataattattagtacttttcttcccccttctctcctttgtggtaatcagatataatttgattgccaaatgcaaaatgtcttactaaatggatattctttgaaatccctaatttatttatttcatttgcttggccattcatttgttgtacttggagacatcaacaaatgctaaatgctgat

SEQ ID NO: 142028 - DNA, 601 bp, Human
acaaatagttacggtattattaccatacgttctggtttggtggtagtttctgaagttcgacacaggctggttgtggtttgaggttagtagtttttgatttagaaattcccatccaccacttggcagagcattgcaactgacacgaacaaaattagtttgcaaaatggaaaatgaactctcaccactgtccataggagacctggcctcctggtctccatttctctaggggttactggggaagagctgtggggaggcttgtgggggaacggatgtgaagtcactctgtagtgtagaattcctygctttcctctgggaaaccatttcaggcgtcatgctttaaaaaattctcatccccttgcggatttttggttttgaatcatggatctggtttgcagtctattcattgccagactccattattaatatctgtaaactcaggagaagcatggcagtcttgagcagtttactgctaaaatattcccacgtagtttaaaaccattccaaggttattaaaggactcttcaatagcagttccgctgcacctcccagtgtgcttgactcctgttaaccatccccacctgcacggcacccccagtcccct

SEQ ID NO: 142029 - DNA, 601 bp, Human
cctggaatttaagttggacaatagcgtttgggaactaagttagaatttttgacagtttttccacatttgacaagggataaaatgatactgaaagtcttctgaatattagtatcatgtcttggcagagtgtcgggttctgccagaatgaaaggggccaccttgggtgctctactggcctcacccccaagattacacaagtacttcttaccatctctttgtagagttccaggctacctcgggcaaaatgatcaaatgagctttcaatgatgagatactttgaaaaacatgattgtggagaagrttgaggaaaggtttttctttttaggatgaaagaaacttgagcataattgtggtcttaggataagaagctagtgaaaagggagagttgaaagatacgagaaagggcagggtagggacggagggtagaagtgaagtggtttgccttggggaggtataggtttacctctttctctgaggcaaagatgaaacaaagagggaacgagcagaggtgcgggggagggaagttagaagagcacggcagggcgaggaaggtgacacaagtgttaactgctgtttacatgtatgatctctttcctcctca

SEQ ID NO: 142030 - DNA, 601 bp, Human
agactgcgccattgcactccagcctgggcaacaaaagcaaaactccatctcaaaaaaaaaaaaaaaaaaaaccaacaacaaaaaaccaacaacaactggtgaatgaaacaaaaggcccctggaatttaagttggacaatagcgtttgggaactaagttagaatttttgacagtttttccacatttgacaagggataaaatgatactgaaagtcttctgaatattagtatcatgtcttggcagagtgtcgggttctgccagaatgaaaggggccaccttgggtgctctactggcctcacccmcaagattacacaagtacttcttaccatctctttgtagagttccaggctacctcgggcaaaatgatcaaatgagctttcaatgatgagatactttgaaaaacatgattgtggagaaggttgaggaaaggtttttctttttaggatgaaagaaacttgagcataattgtggtcttaggataagaagctagtgaaaagggagagttgaaagatacgagaaagggcagggtagggacggagggtagaagtgaagtggtttgccttggggaggtataggtttacctctttctctgaggcaaagat

SEQ ID NO: 142031 - DNA, 601 bp, Human
gagactgcgccattgcactccagcctgggcaacaaaagcaaaactccatctcaaaaaaaaaaaaaaaaaaaaccaacaacaaaaaaccaacaacaactggtgaatgaaacaaaaggcccctggaatttaagttggacaatagcgtttgggaactaagttagaatttttgacagtttttccacatttgacaagggataaaatgatactgaaagtcttctgaatattagtatcatgtcttggcagagtgtcgggttctgccagaatgaaaggggccaccttgggtgctctactggcctcaccmccaagattacacaagtacttcttaccatctctttgtagagttccaggctacctcgggcaaaatgatcaaatgagctttcaatgatgagatactttgaaaaacatgattgtggagaaggttgaggaaaggtttttctttttaggatgaaagaaacttgagcataattgtggtcttaggataagaagctagtgaaaagggagagttgaaagatacgagaaagggcagggtagggacggagggtagaagtgaagtggtttgccttggggaggtataggtttacctctttctctgaggcaaaga

SEQ ID NO: 142032 - DNA, 601 bp, Human
atgcggtggctcacatctgtaatctcagcactttgggaggccgaggcaggtggatcacctgaggtcgggagtacgagaccagcctgaccaacatggagaaaccctgactctactaaaaatacaaaattagctgggcatggtggcgcatgcctgtagtcccagctccagctactcaggaggctgagacgggagaatagcttgagcccggaggcggaatttgcagtgagctgagactgcgccattgcactccagcctgggcaacaaaagcaaaactccatctcaaaaaaaaaaaaaaaaaaaaccaacaacaaaaaaccaacaacaactggtgaatgaaacaaaaggcccctggaatttaagttggacaatagcgtttgggaactaagttagaatttttgacagtttttccacatttgacaagggataaaatgatactgaaagtcttctgaatattagtatcatgtcttggcagagtgtcgggttctgccagaatgaaaggggccaccttgggtgctctactggcctcacccccaagattacacaagtacttcttaccatctctttgtagagttccaggctacctcgggcaaaatgatcaaat

SEQ ID NO: 142033 - DNA, 601 bp, Human
acactatgtaaaatcatgaaacaggccaacaagattaaaaggagctgttacaaggctgcatggctggatggctcagctagattcaccaaagaagttcagaggagaaagggcatattttctggtgtgaacagttacagctgacgtcatgagggatatgggacttgacctggcccttaatgatggagagtgtgttgacaggcagagaggaggtgtggtgatatttggtgtgcggtgtgtgcaagtgggaagccacaaagtcatctctgccaaacaagaagtcaaacagtttgtctctagttaagagtttatgtgccatggtaatggcagagaaagctgaaaaaacagaagactggccataaatgaatacccaaaagatcccagaattgaagccttcatctccattaggaatagagctttttaataagaggactgtaagtttaagaaatgtgaaggactaccttccctttactgtggtatttttatagtacattatccagctcttggttcactctacaagtgaaagagaaatcagatgataattacaaagaattaggattatgcgtccagagttctaaacacaagggtgaattgaatggtgtat

SEQ ID NO: 142034 - DNA, 601 bp, Human
aaagaaaatgagataaatgaaaaatgaaggctaaatcttctagtcacaggcagtgatcttagaattcataagatgtcagaaataaaccaaccaatgtctactcattaaacactattgttggaagtactgctccaaggtctcattcatttccacatctgctctaaaattaatttgctttgtgtcatctgaccctcagagatttgtctctaaattaaaaaaaaaaatttctgtttttggtttctaataaaatctattccaaccacggctctaggaacatgtcaaaaagcaagttaatctagaygaccagaaaaaaaattcaatgtgaacatcttctttttaatttttttttcctcttaacccatcatttagacccaaagccaagggtcttggatggcaagcttgggcttctgcatggcccataaataaactcaggctgttccacagttactcatttggccattctaaaattccaggcagccttccaggcagaaagatcttccttaaattttaagtctttcttgctgccttcaaatcatctgttattatgacatagtttatattggagcttattttaaccaaggtctctattctctgctggagc

SEQ ID NO: 142035 - DNA, 601 bp, Human
ccagctactgacagctgatgttcattttctgggaggccatcatcctggagaaaaagaaataaagagaagagaaaaagaaagaaaatgagataaatgaaaaatgaaggctaaatcttctagtcacaggcagtgatcttagaattcataagatgtcagaaataaaccaaccaatgtctactcattaaacactattgttggaagtactgctccaaggtctcattcatttccacatctgctctaaaattaatttgctttgtgtcatctgaccctcagagatttgtctctaaattaaaaaaaaaaatttctgtttttggtttctaataaaatctattccaaccacggctctaggaacatgtcaaaaagcaagttaatctagatgaccagaaaaaaaattcaatgtgaacatcttctttttaatttttttttcctcttaacccatcatttagacccaaagccaagggtcttggatggcaagcttgggcttctgcatggcccataaataaactcaggctgttccacagttactcatttggccattctaaaattccaggcagccttccaggcagaaagatcttccttaaattttaagtctttcttgctg

SEQ ID NO: 142036 - DNA, 601 bp, Human; identical to SEQ ID NO: 31114

SEQ ID NO: 142037 - DNA, 601 bp, Human; identical to SEQ ID NO: 31115

SEQ ID NO: 142038 - DNA, 601 bp, Human; identical to SEQ ID NO: 31116

SEQ ID NO: 142039 - DNA, 601 bp, Human; identical to SEQ ID NO: 31117

SEQ ID NO: 142040 - DNA, 601 bp, Human; identical to SEQ ID NO: 31118

SEQ ID NO: 142041 - DNA, 601 bp, Human; identical to SEQ ID NO: 31119

SEQ ID NO: 142042 - DNA, 601 bp, Human; identical to SEQ ID NO: 31120

SEQ ID NO: 142043 - DNA, 601 bp, Human
ggtgcactgttcagtacagcactaactataaacattgttgttactgccccagctggaaaacagagcactttatgtgcgcaagaaaaaagagattatctcccatctgctcctgcccattattcagggatgtgtcattttgtctgctgatgggaaccatcactaggattttagttaaatggcctttttatagttggctacgtttattaattattgtgtttacttggggtttagttcccatccttaatcctacaaatttagtaatttaattttccagaggtttttgaaattagatgactttatrtgtgtaatttttataacacaaatatgcacaactataattagatatacttgatgcctatttttaattgtatattaactttacacatatatatctggttaatattcctgacattaggagacatataatttaaaaaggatggagcatggtgtgattcgatttctatagagtacaaaaccagccaaagctaattaatgtggctggactctagggtcagtgtttaccctcgaggtgaagtgacccctcctggaagggagcccctggggtgctaggaatgttctgtgcctgatctgggtgctgcct

SEQ ID NO: 142044 - DNA, 601 bp, Human
ctggagaatggagagaaaggggaaaacaaatccccactatttgtctacaatcaccaaaaagccagttaagagagacagaccaattctgggcaccctgaggagatggttttcccagcctgtgccctcatgtgatctgctttacaaaaagcaagcgcgactcccaagtgttcggcttacagcagtaaaaacagccatgagcgctttaaacacaacaattgggagcagggatgctcgcctgtaatgattgtttgtgttagaaagttggctgccaccatggttagacaaatgctcccacttctgyggagataaaaggcaagcactcgcaatcagtaaggagagcgtgtacgttctggggctaaatggcattataaaacttcctaattaagcatatatgccgatgagtttttagcatcatttctccaatttagctttacatactgggtgcactgttcagtacagcactaactataaacattgttgttactgccccagctggaaaacagagcactttatgtgcgcaagaaaaaagagattatctcccatctgctcctgcccattattcagggatgtgtcattttgtctgctgatgggaaccatcact

SEQ ID NO: 142045 - DNA, 601 bp, Human
tcccctttgaataaggatgcatttccaggaaggggaaaatataacgggatgcaaatgttctccagtggcttgcagcagggggaaatggtggcttcttaggtcaggagagtgtgcaatagcccagtgagctcacacctggggcagcgtcctccctggactctgggtgacaggagcaaagtctcctggatgcgtgggtcaagtgaaggatgctgctcccttggaagcagctctctggtatgaggctggagaatggagagaaaggggaaaacaaatccccactatttgtctacaatcaccaaamagccagttaagagagacagaccaattctgggcaccctgaggagatggttttcccagcctgtgccctcatgtgatctgctttacaaaaagcaagcgcgactcccaagtgttcggcttacagcagtaaaaacagccatgagcgctttaaacacaacaattgggagcagggatgctcgcctgtaatgattgtttgtgttagaaagttggctgccaccatggttagacaaatgctcccacttctgcggagataaaaggcaagcactcgcaatcagtaaggagagcgtgtacgttctggggctaa

SEQ ID NO: 142046 - DNA, 601 bp, Human
cctctggagtgggtggagcatctgccctggctgccaaccatgctctggctgtccccggggacggcgttctcactctgcagagcaaagccaggacaactagccaccgagcaacctgcaatgcattgcaacttgctgtgtacatttggctgcttctggccgaggcgggccctacatcccttctcacaccacacggaggttcctccctggcttccaggggaacagttttctcaaacctgcacggagcaagatgcgtttaactgaccccattccttttaacaaccgagcatgacagcgcggccaycaccgctctgcctcattactcactgtttcaggacggtgcttgaatccaatatgcacattttagtcacatcttgcctgagaactcaaccacccttttgtcctagctcacctccccattttatcttatttctcatgtttagcttatgtcttgttttgatatttgttttatttaatcgggttacccagttctagctgttgccctgttctgtgtgctgaaggtgcaggattcttctccatgtgttacagggcatagcacttgccatggtgacagcttcacttgggaaggtagaaatgtgtgtga

SEQ ID NO: 142047 - DNA, 601 bp, Human
cccatgttctttccaatgacccttggtgaccttcacgccacaacaggcatagtatcactcatcttttgagcctatggcctaatagctcatgcttgggtacaaggtacaactgcaagaccaatcctaactactttcctgagacttctctctaatcacagtttgagtggttttgaagtttaaatctatgacttttcgatgtgttaaactgaatcccccaaattctgtgttacagagggagcctctggagtgggtggagcatctgccctggctgccaaccatgctctggctgtccccggggacrgcgttctcactctgcagagcaaagccaggacaactagccaccgagcaacctgcaatgcattgcaacttgctgtgtacatttggctgcttctggccgaggcgggccctacatcccttctcacaccacacggaggttcctccctggcttccaggggaacagttttctcaaacctgcacggagcaagatgcgtttaactgaccccattccttttaacaaccgagcatgacagcgcggccatcaccgctctgcctcattactcactgtttcaggacggtgcttgaatccaatatgcacatttta

SEQ ID NO: 142048 - DNA, 601 bp, Human
ttcgctcttgctgcccaggctggagtgcagtggtgtgatctcggctcattgcatttccgcctcccgggcccaaatgattctcctgcctcagcctcctgagttgctgggattacaggtgcccaccaccatgcccagctaattttttgtatttttagtagagacggggtttcaccatgttggccaggctagtcttgaactcctgaccttaggtgatccacccaactcggcctcccaaagtgttgggattacaggtgtgagccaccgcgcccagcctccaagactgtttaatttctaaaagtgycatgtgtctgacatatatttgagaattgtttatttcagcctatgaatacttacaccctttcttagcaaaaggtgtgttgatacttataattacgttctttatgtatgatttcctgtgcatttatacctcataaagcctctatcctctcaatgaacctcactaaggagcattcacaaagtatggcaggaatgaatatgtagaaaagagcatagatgtttacttttaagtcaaaatgagggaaagagattctgaggcaagggcagaataaatatgatactacacaattttcagtcaatctag

SEQ ID NO: 142049 - DNA, 601 bp, Human
agcagtaggtggaagtcaggagaattagctttttgtcctagttcagctaattatgtgaccttggacatgttttctaaccacatcgagccccaatttccaggtccatagactgaaagggggttattgtgcataatccctagggaaactttcacctatgaaattctatgaatattcttaatatcaccatcaatctacttaatgggttatgtttttctcttagcaaacaataggccttacagtctatggaccaaacatgtttctgttccgcaatgcttgcaggattcacaagagatgtactcaytttcattgtgaggcaatggtttctgtcatggcagtaattattggatttaagtaactgcatttttcagaggcaaacattgactgcttttccttttttgcttttcttaatttattgctagccatcacatatagtcttcatttcattaataaaagaacattattgtgcattttgccttttagcccatccattattcatgctacctaggagactgaactggggatgcagctgctgggacattaatctcaggaaccctttcttttgcttacccttactctgtggggactacattacgatttgctt

SEQ ID NO: 142050 - DNA, 601 bp, Human
aaattaacttgactctaaaatatatgcagttcatcttttccaattgaattctgtagcccatatatgcagtttgggacagatgaagttaccaaggaaatagcactgtaggctaatatataatttttacaaggtatactcataaaacatgtaatccaattgaaaatttcttccccgcccctgaaaaaaaaaaaagcatttgaaacataatttgttcctctgaaatcctgcatcacaacttcagagtgtgagccctttcaaccatttctaaaaggcagctttactatttttttaggcaggggartcctcaagagtcaacttgattttgtgtgtgtgtgtatggctagctttactctttatcaatcacaaaaaaatccccagacatcaagcaaatagggtctcttcagaacgcctatttttgtaaattaagtatgtcctcaggtataggcttgaggctccatgaacacttaagagttcctaacagatttattattttattagttattttgttcacagtttgtagctttgttggaacctacatgaataggcttgcagtagaattcccaagtgtttccttagtaagttaccacttcactaagagatc

SEQ ID NO: 142051 - DNA, 601 bp, Human
acagctgtcaggtcaatttctacaaggtccaatttatttacagctcctcataaagcccaattccttgtcccagcctttgcaatgtgcttccaataaaaacttccagggtgtatacctattattactcaaaatgatcctatggcatcagtagactcattgtcttcctttactggacacttgattttcaagcacagcatctgtttactctgcctatggttaactataccttaatttccctttgcatacctcctcactcccacattccatgatcctgatgaagttgaccctactcctatctctrggagtagggttggggtgggcttgtgactcaggagtaagcctgagtttactgcattccccaatacccatgaatggcccaagatgggcacccgaccccatcaataggacatggtaagacttttgctggaacttcacatttataatgaatcccaattttgagagactggcaggcctggagctgcttctcccatcctgggaaccatgtgaagtccaacactaaagccaacacagggaggcagggttggaggatgtcaagaaaccaagcattaactgagtgctggatccatccatcactgaactc

SEQ ID NO: 142052 - DNA, 601 bp, Human
acaggtctctccttctgggcccccgcccactctgcttagagaaagtattttaggaacttcttccttctctgtttccatgacagtctagtaccattatcgttgttcatcctgcctgcaccataattgatcctaattaactgttttccctaccactttgtagactctttggaggaccaaggtcaagcgttggacattgtctctgtgttttccacagttcacagcacacagtagatattctacgaactttgtggcatttgaaagatgggaaagtataatggaagtgatctgtttctctctcttsaaaaactttgtggcttttgagatatgagaaagtacaatagaggtgatctgcttctctctggagcacccaccttccggtccattctgcacacagctgtcaggtcaatttctacaaggtccaatttatttacagctcctcataaagcccaattccttgtcccagcctttgcaatgtgcttccaataaaaacttccagggtgtatacctattattactcaaaatgatcctatggcatcagtagactcattgtcttcctttactggacacttgattttcaagcacagcatctgtttactctgcc

SEQ ID NO: 142053 - DNA, 601 bp, Human
ttccagagggtgtctctgactacaggtctctccttctgggcccccgcccactctgcttagagaaagtattttaggaacttcttccttctctgtttccatgacagtctagtaccattatcgttgttcatcctgcctgcaccataattgatcctaattaactgttttccctaccactttgtagactctttggaggaccaaggtcaagcgttggacattgtctctgtgttttccacagttcacagcacacagtagatattctacgaactttgtggcatttgaaagatgggaaagtataatggargtgatctgtttctctctcttcaaaaactttgtggcttttgagatatgagaaagtacaatagaggtgatctgcttctctctggagcacccaccttccggtccattctgcacacagctgtcaggtcaatttctacaaggtccaatttatttacagctcctcataaagcccaattccttgtcccagcctttgcaatgtgcttccaataaaaacttccagggtgtatacctattattactcaaaatgatcctatggcatcagtagactcattgtcttcctttactggacacttgattttcaagc

SEQ ID NO: 142054 - DNA, 601 bp, Human
agaggtgcagttttccacccctcaggtcctcataatattctcaaaccagcattgaggattcccaactgacctgctctcagagatgttccagagggtgtctctgactacaggtctctccttctgggcccccgcccactctgcttagagaaagtattttaggaacttcttccttctctgtttccatgacagtctagtaccattatcgttgttcatcctgcctgcaccataattgatcctaattaactgttttccctaccactttgtagactctttggaggaccaaggtcaagcgttggacatygtctctgtgttttccacagttcacagcacacagtagatattctacgaactttgtggcatttgaaagatgggaaagtataatggaagtgatctgtttctctctcttcaaaaactttgtggcttttgagatatgagaaagtacaatagaggtgatctgcttctctctggagcacccaccttccggtccattctgcacacagctgtcaggtcaatttctacaaggtccaatttatttacagctcctcataaagcccaattccttgtcccagcctttgcaatgtgcttccaataaaaacttcca

SEQ ID NO: 142055 - DNA, 601 bp, Human
aagctggtggcacttaatattgagcccatgcttggatggtcccctcacgctcactttcaccttcatttctgcaaatccttgtaagaacaattatattctcttccttacttgtcctgcctagaaagcccttcccctgtccctgttgaagtagtcagttctggccactcctacagatttccctactcagcagctttctaaatgttcacctttgtagataagacctcatgcacaaatgctcctgagctttcaggtgcatggatccccaggatcctcatgacacgtattcttggaaatatatcayggtcatgggcatgtgtcatgagtggttcaaggttgtctctattggatttgcagactcttaaagttgaatgagggtttataaagcatttttgtccaatgttctgtctttacaggcagggaaactgagacctaggcatgtggagagacttgcccatgtgcattgctaactaggaacagaactcagtcttctcctgtgcaaagcccaagcagtttcttcccatttactctgaagtttattgaaatgataaattaaagtcactgcactcccagcagctcaacccttctctgttcccagccagca

SEQ ID NO: 142056 - DNA, 601 bp, Human; identical to SEQ ID NO: 31121

SEQ ID NO: 142057 - DNA, 601 bp, Human; identical to SEQ ID NO: 31122

SEQ ID NO: 142058 - DNA, 601 bp, Human; identical to SEQ ID NO: 31123

SEQ ID NO: 142059 - DNA, 601 bp, Human; identical to SEQ ID NO: 31124

SEQ ID NO: 142060 - DNA, 601 bp, Human
gccttgctcaggcataaatggagagaacccccaaaccctctcctcctagttgggcatctgcctgtgggaggagggaaaggtcttagggaggctgggggggtgggtggggagggtggtttaacttttaaatcccctagtcttgggggagggccagggacgcgggtcttggcagaagggtgatggacaagttgaggtcatgggcaggtcttccaagctcggcacctacaggccaagagcagggtgacctccgtggtccagcactgcagacccagtcctggcagcacctgcctccctattgacsgtacaagggaccctccacggcctgaggaactgagattgtgagctgccagccactgaccccaccatttcccaggcttgcaaaggagagcgctggggcccaggcccaggcccagcccacgtagaccacagggcagtgacccgggcaggggcactctgggggtttgcccagcgcttccccctgggagatcctgccgccctgctctcctgctcagctgcagtgctgggtcaacaagctcctgcaccgtccccaccctgccccaacactcacgaagccgtgcttgtcagagatgttgttggtcag

SEQ ID NO: 142061 - DNA, 601 bp, Human
gaagcaaaggagctttctcagacctgaactgctattttccttcccttgagataagatctcaggggttcaatttgccagaaacctcagagggaagaaaatgaatgaagagattccaaatctttccacagggaatattccacccaagcaaccaaagaggccactgtccccatcggatctccttactgtgccccagccacattttcgtcaacactcccctgggagcttggaatttcaatggggcctgaagagctgagttctcatccctgacatgtggctgggggtgctgggaactcaaggtagrggaaagaccagccttgtccttcaccaggacagaggacttcgtagaaggcctgggaggggccagagacctctgggagggctggtggtcaactgtccagaaaataatgcaaatgttccttctccctttgtctgtctggccaccttagcctttcagaatggacagggagccaagggtctttgttctcaagaaaaatgtcctgaggccaggagagaagacttcacaagccaggggtggccctggtctgtgagggtgagaagagtctcgatgggcaccgcactcctcgctggggctatagggaag

SEQ ID NO: 142062 - DNA, 601 bp, Human
gaagaaaagaggcagcttcatcaggcctgagaaaataccccctcctgagacagtcaggtcctactgggcatttcagacctggcatcccaggttgggaggaaggagggaggcttcagttctcttgggatttggctctacctgatgtctgggatgggctgcactggcctgggaatgtaaccaccagcagccctaccaacggatgcctcccaggtgctggtattctcacccgggtcatgcacctgttggccaggctgtgtctagaagccctgacttcctcatgacctctgtgatgctggtgatyattaccagtttgtctggggaggaggcattcatatacacaaataatcaggggtgcagattaaacctctgggccctgaactttctccagaggcttcccttccagcccagagccccagatgagtgatggtgatacctcaaacactccacacaccctaacactgagctgtgtgtaaaactcatttcagaatcgcctgcctcccaaccccccacccccccacccaccaacccaacttttaaaatatttgctgctgaagcaaaggagctttctcagacctgaactgctattttccttcccttgaga

SEQ ID NO: 142063 - DNA, 601 bp, Human
gactgccctagcacgggtgaaggccttgagggagaaaacggggcaggcatagggccaggtggcaaacaggcagctttgggtgtcttggaggttctgctcattgagaacagtgtcctcgccacccctcctatctgcaggctctgaagggcagagggcacacatgctggggaaggcactttgcaaagtctccttctgcctgctcatggttctcctgcctgggccaggaggaggacacgggtgccaaccagttcataaactggcctgaaagttctacagggaatgcctggcagcacctcactgrcagctgaggaaggaatgcagtctttgcctgtgaagggcacagcagccaggaactcctggacaagcaccttcctgagttcatgaggtctggctggtgcacggcctgacctttgagataatggcttactccccagagctagtgggtatggggaggagggcagggggctgatgattgcactgggctcccagggagcctcaggcctggctctagcaggaagaagaaaagaggcagcttcatcaggcctgagaaaataccccctcctgagacagtcaggtcctactgggcatttcagacctggca

SEQ ID NO: 142064 - DNA, 601 bp, Human
aattccctggaagaaacagaacaagacgagggttagacatcttgcctgaagtctttctgaagttgggctgggtgctatcccctggacaccgtgcccttctgttttagggatgtaaaaccacaattcgcataactataaccacaggcagcacaggtaagcatgagccagtgtgcctgtggccaaacccagttagaagggtgagatcgcttcaggctaccatgcaaaggcctgccatcaagttctgtgctgggcattacagcaggggtaatggaaaggacattccaggtgactgccctagcaygggtgaaggccttgagggagaaaacggggcaggcatagggccaggtggcaaacaggcagctttgggtgtcttggaggttctgctcattgagaacagtgtcctcgccacccctcctatctgcaggctctgaagggcagagggcacacatgctggggaaggcactttgcaaagtctccttctgcctgctcatggttctcctgcctgggccaggaggaggacacgggtgccaaccagttcataaactggcctgaaagttctacagggaatgcctggcagcacctcactggcagctgaggaagg

SEQ ID NO: 142065 - DNA, 601 bp, Human
ctcccggctgtttccaccagcggccttggagccctcagaggccagcccggtggtgaggaggctagtgctaggcgggatggtgaccgggatctgataggggctgaaacgcagtcggggccgggcactgcccaggaagggactccgggagagggagccggcggctgcggcggcggcagctgcagcactagtggcgggcaaagccgaggcggctgcggctgctgctgccatgtaggtgtaggggtaggggaagaggcctccgaaagtgggcattggaattccctggaagaaacagaacaagacragggttagacatcttgcctgaagtctttctgaagttgggctgggtgctatcccctggacaccgtgcccttctgttttagggatgtaaaaccacaattcgcataactataaccacaggcagcacaggtaagcatgagccagtgtgcctgtggccaaacccagttagaagggtgagatcgcttcaggctaccatgcaaaggcctgccatcaagttctgtgctgggcattacagcaggggtaatggaaaggacattccaggtgactgccctagcacgggtgaaggccttgagggagaaaacgg

SEQ ID NO: 142066 - DNA, 601 bp, Human
ctcccggcctggggagagggctcgctggctctccagcccactcaccagtctctggatgctctgcagttcattggccgcctccttggccgagccactgggcgacagggcaccgcgggatggggcccctactttgcggagagccagctcgggcagggggctaggctcccggctgtttccaccagcggccttggagccctcagaggccagcccggtggtgaggaggctagtgctaggcgggatggtgaccgggatctgataggggctgaaacgcagtcggggccgggcactgcccaggaagggrctccgggagagggagccggcggctgcggcggcggcagctgcagcactagtggcgggcaaagccgaggcggctgcggctgctgctgccatgtaggtgtaggggtaggggaagaggcctccgaaagtgggcattggaattccctggaagaaacagaacaagacgagggttagacatcttgcctgaagtctttctgaagttgggctgggtgctatcccctggacaccgtgcccttctgttttagggatgtaaaaccacaattcgcataactataaccacaggcagcacaggtaagcatgagcc

SEQ ID NO: 142067 - DNA, 601 bp, Human; identical to SEQ ID NO: 36704

SEQ ID NO: 142068 - DNA, 601 bp, Human; identical to SEQ ID NO: 36705

SEQ ID NO: 142069 - DNA, 601 bp, Human; identical to SEQ ID NO: 36706

SEQ ID NO: 142070 - DNA, 601 bp, Human; identical to SEQ ID NO: 36707

SEQ ID NO: 142071 - DNA, 601 bp, Human; identical to SEQ ID NO: 36708

SEQ ID NO: 142072 - DNA, 601 bp, Human; identical to SEQ ID NO: 36709

SEQ ID NO: 142073 - DNA, 601 bp, Human; identical to SEQ ID NO: 36710

SEQ ID NO: 142074 - DNA, 601 bp, Human; identical to SEQ ID NO: 36711

SEQ ID NO: 142075 - DNA, 601 bp, Human; identical to SEQ ID NO: 36712

SEQ ID NO: 142076 - DNA, 601 bp, Human; identical to SEQ ID NO: 36713

SEQ ID NO: 142077 - DNA, 601 bp, Human; identical to SEQ ID NO: 36714

SEQ ID NO: 142078 - DNA, 601 bp, Human; identical to SEQ ID NO: 36715

SEQ ID NO: 142079 - DNA, 601 bp, Human; identical to SEQ ID NO: 36716

SEQ ID NO: 142080 - DNA, 601 bp, Human; identical to SEQ ID NO: 36717

SEQ ID NO: 142081 - DNA, 601 bp, Human; identical to SEQ ID NO: 36718

SEQ ID NO: 142082 - DNA, 601 bp, Human; identical to SEQ ID NO: 36719

SEQ ID NO: 142083 - DNA, 601 bp, Human; identical to SEQ ID NO: 36720

SEQ ID NO: 142084 - DNA, 601 bp, Human; identical to SEQ ID NO: 36721

SEQ ID NO: 142085 - DNA, 601 bp, Human; identical to SEQ ID NO: 36722

SEQ ID NO: 142086 - DNA, 601 bp, Human; identical to SEQ ID NO: 36723

SEQ ID NO: 142087 - DNA, 601 bp, Human; identical to SEQ ID NO: 36724

SEQ ID NO: 142088 - DNA, 601 bp, Human; identical to SEQ ID NO: 23629

SEQ ID NO: 142089 - DNA, 601 bp, Human; identical to SEQ ID NO: 23630

SEQ ID NO: 142090 - DNA, 601 bp, Human; identical to SEQ ID NO: 23631

SEQ ID NO: 142091 - DNA, 601 bp, Human; identical to SEQ ID NO: 23632

SEQ ID NO: 142092 - DNA, 601 bp, Human; identical to SEQ ID NO: 23633

SEQ ID NO: 142093 - DNA, 601 bp, Human; identical to SEQ ID NO: 23634

SEQ ID NO: 142094 - DNA, 601 bp, Human; identical to SEQ ID NO: 23635

SEQ ID NO: 142095 - DNA, 601 bp, Human; identical to SEQ ID NO: 23636

SEQ ID NO: 142096 - DNA, 601 bp, Human; identical to SEQ ID NO: 23637

SEQ ID NO: 142097 - DNA, 601 bp, Human; identical to SEQ ID NO: 23638

SEQ ID NO: 142098 - DNA, 601 bp, Human; identical to SEQ ID NO: 23639

SEQ ID NO: 142099 - DNA, 601 bp, Human; identical to SEQ ID NO: 23640

SEQ ID NO: 142100 - DNA, 601 bp, Human; identical to SEQ ID NO: 23641

SEQ ID NO: 142101 - DNA, 601 bp, Human; identical to SEQ ID NO: 23642

SEQ ID NO: 142102 - DNA, 601 bp, Human; identical to SEQ ID NO: 23643

SEQ ID NO: 142103 - DNA, 601 bp, Human; identical to SEQ ID NO: 23644

SEQ ID NO: 142104 - DNA, 601 bp, Human; identical to SEQ ID NO: 23645

SEQ ID NO: 142105 - DNA, 601 bp, Human; identical to SEQ ID NO: 23646

SEQ ID NO: 142106 - DNA, 601 bp, Human
caacagcaatcctatttactgtctgtattattacatgtcagaggtatgaatcagattaacaaattaaattgcctcaaatgtgagtttttgtattaatgccatcggtgaaggcatttgtcattttttgctcctattagccaggaaaggggatgtcatgcatcttgtggcttggaaaatgttcataatttgtctgtgcttagacacagttatggagtagtcttgtttttgtcctgatccaccatgatcagagtggccttgtctgctgttgatgttctaggagattgtttatgtccaacagggracaccaaggcctggttgatttcaccaggccagctcttggatgtcaggtgctgcttttcttctttctcaagtaaagctcactcaagttggagtaggaggtttaagtgtccagcacaccctctccattctcctccccttttctggctaacagaacctctctttcctgcaggtaacacattgaaggtggtttgtgtggactactgaacctcaacaatactcacttagccaatgaaaaatcatttattattatgctaatttatgaattcaccagtggaattgtaaactcttgtctaagatcacc

SEQ ID NO: 142107 - DNA, 601 bp, Human
gtgaccatgacggatcaggacaaaaacaagaaaaccccataaccgtgtctgagcacagacaaattatgaacattgtccaagatgcaagatgcgtgacaccccctttcccggctaatatgagcatctgctgctgttttaccaattatggctttaacctcagtctagtctgccccatatacagacataatcactctatcaagatacccactcatagaatcaggaagcatacccctgcttcctgacaacatctgattcagagcaaagcttccaaaagtcctccccaaatcacctagcacaagcycaaaccctttctgtcttttccaacacccactggctgagactttccacagtcctccattctctgcctgcaaggagtaacagaccaatgtattcaactacattgtgttcctagaggtcacagactgaagagcattgactagggtagctgaacagtgtagccctgactcgtatttccccattttgtttgtcttagaaaagttcaccaggggatgaatatactttaaaaactaaagactgggcccagtggttcacgcctgtaatcccaggactttgggaggctgaggtgggcagatcaggaggt

SEQ ID NO: 142108 - DNA, 601 bp, Human
agaccagcctggccaacatggcaaaaccttgtctctactcaaaatacaaacattagccaggcgcagtggcacgtgcctgtaatcccagctactcgggaggctgaggcaggagaatcacttgaacgcaggaggcggaggttgcagtgggtcaaaattgcaccactgcatttcagcctggatgacagagagagactccgtctcaaaaagaaaaaagaaaagaaaaacaaacttctataaactgatggtttgacaatgcattataaatgctatatctggactgaactgtgtttccccaaaatcygtgtgttgaagccctaacccacaatgtgactatacttggagatagagcctagaaagaggtaattaaggtttaatgaggtcagaaccatagggccctggattagtgttatcataaaaggaggcatcagagagtttattctctctctccctccactatatgaggatgcagctagaaggctcaggaagagagtcttcaccaggaaccaaatcagctggcaccttggtcttagacctcctggcctctagaactgtgggatataaatttctgttgtttaagccatccaatctgtggtctttcatt

SEQ ID NO: 142109 - DNA, 601 bp, Human
cttagagacgtatagtataaatagatgtacagatacatggctgagaaagcagacaccagaaatgcttggcataagctatggctgagacgatagccagaaaaaatgatgtgaactatcaagttaaaatcattgaacaaagcaggcattctagagaaaagcaaagatcgctgtggcggcgtcacagataagcccccaccttgttagaggctgggaccattaattcagacttctgacaaccccttcatttattgctactatgcaaatatgaggaaagaaacattttttagaaggaaagaacaaytctaccaactaattccgtctcaggatttcttgaagctcacctgactatgctttaatctatctaggagccccagaaagctacttcacacccatcaggcaagcttagaatcattgaaagctatacctttactctccctcttcatagctcctttttttgtaccctgggttgagtaacaataataaatcacctgtgaaatacttctgactttgtgcttattagtaaaatgtcttagggcattactgtctgctttggagaacaagataagaaatattaattaaggtttgaaaatctaaacctaac

SEQ ID NO: 142110 - DNA, 601 bp, Human
tcaagtcacaatgtgagcttccaccctaaagcagaaggagaaatatgactaaagggaaatccctactacaggccagatatggtgactcacccagtgctttgggaggccaaggtgggaggattgcttgaggctaggagttctgagaccagcctaggcaacatagtaagacctcatctctacaaaaataaaaaatttaaaaagctgagcatggtggtatgtggctatagtcctagctacttgggaggctgaggcaggaggatcacttgagcccagaagtttgaggctgccgtgagctatgatyatgccactgcatttcagcctgggcaacagagagagactgtctcttagagagagagagagagagagagagagagagattcctactatccttactacaaactaatacaaagaagaaaagtgaatcctttacaccacaggttgataaattaaagcctgagggccaaatagagcctacaacctgtttttgtaaataacgttttattggaacaccacattcatttgtttatgcatgatctatggctgatttcatgatacaggggcagagttcagtagttacaacagaaaacatctggcctccaaa

SEQ ID NO: 142111 - DNA, 601 bp, Human
ccttcttttgctcattattgtgatcacatacaattttgtagctctattgcttggagagatttcacaaaaaaaattttaataaatgtcatgtgcaatatatttgcatgaattgcctcatgaatttgaaattccagaagctataactctgttaactgaaatactttaacctggatctcaatatgtgaaaaatcatttaaggctgaattggcttcagcataaaactctttgaaaatagcctaaagtaatggtgagttctggaactaggcccaaaacattattcattctgtgcctttaaagaaasgctgtggctttttgtttatttatatgtatattacacatactactaaagaaaaataaaattttaacattaagcacattagaaacaacgaacacaaagatgattaaatgtcttatatctctgaaccacgggatttctcacccatcaagtcacaatgtgagcttccaccctaaagcagaaggagaaatatgactaaagggaaatccctactacaggccagatatggtgactcacccagtgctttgggaggccaaggtgggaggattgcttgaggctaggagttctgagaccagcctaggcaac

SEQ ID NO: 142112 - DNA, 601 bp, Human
cacatagacttgtataatagccttgtatactatatgtgtgtaaaaatgtacacaatatacattgtatacaagctctaacagcacacatacaaaaaaaaatcgagagaattagaaatgctgattctaaacccttgaggaaaaaaagcttcttcttcaagaattaaactctgaacagatgcagaggactacagaaagactctgctaggtcaactttaaaagaagtgaccagttcaacatgcatcataagttgacattacggattggagaaagaaccaaggtgatgctagaagagattctagayagagactaagctacctctcaggccattcttgactaaacaatcatgaaaactctaggagagagttgctcaactcaatgctagaaccatcttagatttgtatgtaagttgtggtttgttattatattcatattttatcagaatgaattggatgtaattcataggtttagttcttctcaatatagtatgcatttatccttataaattctagagttgaagagaatccattcaggtgacatttagcacctgtgaaattaaagaaaacaagccagcccccagcctagtccatagaaacactgccac

SEQ ID NO: 142113 - DNA, 601 bp, Human
tgccttgatcttcaacttctcagcctccagaactgtgagaaataaatgttgtttaggccacccagtctctggtatttttgttttagcagcctgaatggactaggacacaaccacggaagagaaaaaaaaagatattggagcaataatagcatcttccaggcagggcgcagcaaggatggtgctataattttctctccctatatttccctatccattcttttatagcaccctgggcaggcaaaacagaaagtatttctcaggcattttggaggagttatatcaggaacacattctcccacayagacttgtataatagccttgtatactatatgtgtgtaaaaatgtacacaatatacattgtatacaagctctaacagcacacatacaaaaaaaaatcgagagaattagaaatgctgattctaaacccttgaggaaaaaaagcttcttcttcaagaattaaactctgaacagatgcagaggactacagaaagactctgctaggtcaactttaaaagaagtgaccagttcaacatgcatcataagttgacattacggattggagaaagaaccaaggtgatgctagaagagattctagacagag

SEQ ID NO: 142114 - DNA, 601 bp, Human
aatggccgttatgagccaggaagaagttcctcaccacacgctgaatctgctaatgccttgatcttcaacttctcagcctccagaactgtgagaaataaatgttgtttaggccacccagtctctggtatttttgttttagcagcctgaatggactaggacacaaccacggaagagaaaaaaaaagatattggagcaataatagcatcttccaggcagggcgcagcaaggatggtgctataattttctctccctatatttccctatccattcttttatagcaccctgggcaggcaaaacagaragtatttctcaggcattttggaggagttatatcaggaacacattctcccacatagacttgtataatagccttgtatactatatgtgtgtaaaaatgtacacaatatacattgtatacaagctctaacagcacacatacaaaaaaaaatcgagagaattagaaatgctgattctaaacccttgaggaaaaaaagcttcttcttcaagaattaaactctgaacagatgcagaggactacagaaagactctgctaggtcaactttaaaagaagtgaccagttcaacatgcatcataagttgac

SEQ ID NO: 142115 - DNA, 601 bp, Human
atcattgggctgggcatggtggcccacacctgtaatcccagcactttgtgagactgaggtgggaggatcacccgaggtcaggagttcgagaccagcctagccaatatggtgaaaccccatctctactaaaaatacaaaacattagctgggtgtggtggcgtgcacctgtgatcccagctattcgggaggctgaggcaggagagtcacttgaactcgggaggtggaggctgcaatgagccaagaacgcaccactgcactccagcctggaccacagagtgagactccatctcaaaaaaaaaawaataataataaataaataaatttgtatcattggtgcctttcatctgctcgagggctacatagctacgttttggtattagaaactgagtacttcagaaatgaggttccgaattttggcatataaacctattctgtcttgttccaacaaaatgaggataggtacagaaaaggaaaaaaaaaacaacactaaatttcaaagtagaggccataatggaaaaaaaaatgtgattacatgggctttcaaggtaaagatttttcatgtaacccatgcaggagaaagtaatcaaccaacaaatattgc

SEQ ID NO: 142116 - DNA, 601 bp, Human
atatacagagtacccaaattatagaatgtaagtttttttgaaaagactggtacatgctgagaaaatgcaaagcatccaatgaacaaaatgctacaagcaataacatatctacaagctaaaaagagaagtagtacaatctacggaataggtagttttgttaaaattgtgggcattattcctcaataaggtaccttgaattgctcttgaaaaactaattgtatctttgttaaatacaagttaaaaatgttaaatacaagttaatatctctgtaaagggtcaaatgtcatttgagggtaggaarcaaaagcaaaagttaaatgaaagtgtatcattgggctgggcatggtggcccacacctgtaatcccagcactttgtgagactgaggtgggaggatcacccgaggtcaggagttcgagaccagcctagccaatatggtgaaaccccatctctactaaaaatacaaaacattagctgggtgtggtggcgtgcacctgtgatcccagctattcgggaggctgaggcaggagagtcacttgaactcgggaggtggaggctgcaatgagccaagaacgcaccactgcactccagcctggaccacag

SEQ ID NO: 142117 - DNA, 601 bp, Human
agatggggaataaaaggcacaaaagtgttaagtgacttgcctaaggtcacacagctaatatatggtagagtaagaatttgaacccaggaagtctggttctaaagtgagagttcctaatccacatactctacttcctctacaccaccggtccccaacctttttggcaccagggactggttttcgaggaagacaattttcacggaccagggggtggtggatgggaagggagatggtttcaggatgaaattgttccaccttggattatcagacattagttagattctcataaggagtgtgcaayctagggccctctcaggtgcagttcatgatagggtttgcactcttatgagaatctaatgctgctgatctgacaggaggcggagctcaagtgataatgctcaattgcttaccatccacctgctgtgtggcccagttcctaagaggccacagaccagcatgggcccatggcccaggggttggggacccctgctttacaccaccacactgtagtacaaccttcaggaccaactagaataagaaaaattgattttgaaggcatattctccaatcttaacaatgcagaaagaggatactttgacct

SEQ ID NO: 142118 - DNA, 601 bp, Human
attcaacccataacattattaccctgttttacagatggggaataaaaggcacaaaagtgttaagtgacttgcctaaggtcacacagctaatatatggtagagtaagaatttgaacccaggaagtctggttctaaagtgagagttcctaatccacatactctacttcctctacaccaccggtccccaacctttttggcaccagggactggttttcgaggaagacaattttcacggaccagggggtggtggatgggaagggagatggtttcaggatgaaattgttccaccttggattatcagrcattagttagattctcataaggagtgtgcaacctagggccctctcaggtgcagttcatgatagggtttgcactcttatgagaatctaatgctgctgatctgacaggaggcggagctcaagtgataatgctcaattgcttaccatccacctgctgtgtggcccagttcctaagaggccacagaccagcatgggcccatggcccaggggttggggacccctgctttacaccaccacactgtagtacaaccttcaggaccaactagaataagaaaaattgattttgaaggcatattctccaat

SEQ ID NO: 142119 - DNA, 601 bp, Human
tgtgaagaagcccaaaccaactcatatagagtgaccatgatggcgaggctcaagatttcaggaagaaaaacagatagcgggccagtccacagctgttccaacacctatcaccatctgactgcagctgcactgaaagatgctaggctagaactgcctagtcaagcccttccaaaattcctgacccacagaaatggtaagaaatgaaatggtcaccttcaagccactgagtgtttgggtaatcgtaatctgttatgcagaaatggataaacacaacaaaggaaaaaaacctgagtagagcctyccaggctcatggttaccagcacatgcagggaagggagttccttggtcgctttctcttttctgttgagacacaaaatttaatagaaattttgtttgtagttcttacattctcagtgtgagctgaattgggacccgctgccccatgcagaagtggcccattcctggaggcaggggagaaactgtgggggggcggggtgaaatgggaagagccccattcttcctcagtgttggggggctagagatgccacccccttttcctggccccctctgggttccaggaaggagaacagatggaatgtca

SEQ ID NO: 142120 - DNA, 601 bp, Human
ataaacagtgtctagggatatacaaaaatatattttccaaagaaggccacacaatgtttgtttcttgactaacatgcttttctagaatcttgccactccctcattgaaggttggcttcatctggccttcccttgaaacttggtgagtttctgactcttttataaccaataaaatgcaacagaagtgacattttgtgactttcaaggttaaatcataaagtgtattgcagttcctatcttgtgcctgagccctgaaccatcaaataagcagtccagctgtcctgaggcagccatgctgtgargaagcccaaaccaactcatatagagtgaccatgatggcgaggctcaagatttcaggaagaaaaacagatagcgggccagtccacagctgttccaacacctatcaccatctgactgcagctgcactgaaagatgctaggctagaactgcctagtcaagcccttccaaaattcctgacccacagaaatggtaagaaatgaaatggtcaccttcaagccactgagtgtttgggtaatcgtaatctgttatgcagaaatggataaacacaacaaaggaaaaaaacctgagtagagcctcccagg

SEQ ID NO: 142121 - DNA, 601 bp, Human
atggtaagttcaaggagctcaggggcagtgtccttttttcattccccctggatccccagagcttgtcaccccagggtgtctcatatggagaaagggaggtacttatttcagtaaatacttattcagtgtattcattcctccattcaccactgtaccttgtacctcatttatagcactgatcaaatgatactataacttgttatttatgtatctatgtcccctaacaagatcctaactccttaaggtctaagataaggacttttcacctttgaagtctcaggtttagtatacaacctggacrgagtcaatgtttactaactatgtgtttgctgatgacagtgtcatgcagacactttgcatacagtgcaaagcttagcatacaacctggacagagtcaatatttactaagtatgtgttggctgatgacagtgtcatgcatctttatttacataaacagtttgtgcaaataaacagtgtctagggatatacaaaaatatattttccaaagaaggccacacaatgtttgtttcttgactaacatgcttttctagaatcttgccactccctcattgaaggttggcttcatctggccttcccttga

SEQ ID NO: 142122 - DNA, 601 bp, Human
tttaaaatatagcaattactatatgttttgaaatattaacagcaaaatttccacattgatagccctgattttgtaacatgatacaagtttgagagttcagtcccaccttgatggcagttgttggagttccttgttccttcctggatggtaagttcaaggagctcaggggcagtgtccttttttcattccccctggatccccagagcttgtcaccccagggtgtctcatatggagaaagggaggtacttatttcagtaaatacttattcagtgtattcattcctccattcaccactgtaccytgtacctcatttatagcactgatcaaatgatactataacttgttatttatgtatctatgtcccctaacaagatcctaactccttaaggtctaagataaggacttttcacctttgaagtctcaggtttagtatacaacctggacagagtcaatgtttactaactatgtgtttgctgatgacagtgtcatgcagacactttgcatacagtgcaaagcttagcatacaacctggacagagtcaatatttactaagtatgtgttggctgatgacagtgtcatgcatctttatttacataaacag

SEQ ID NO: 142123 - DNA, 601 bp, Human
aaacagttaagttttcaacgatgtatgaatctctctctccaagcaggactataaacccctttgtcaagtgagcaaatgaaagttcatgttggatttaacattggttgcagattgaacatttgaggccttcaacatatatgtgttaattatgaaattcagaaaaaggcaagtatgataagatacatgttctagtattgagatgatttggtttaacaggagagaaagaaaaagttgtgtttacaggttgagtatctgaaatctgaaaatttaaaacctaaaatccccctaaacctgaaacttyttgagtgccaacatgacacttgaaggaaatgctcattggagcatttttgaattttttggatttgggattctcaactggtataatgcaagtattccgaaatctgaaaaaattcaaaatcccaaacacttctggtcccaagcatttcagataagtgatactcaatctgtatcaatattataatataaaggaacagtaaatttttctcaccaggaatactcttctgtctactcatttcataaactctcacttgaattcttgctgttatgccagcaaaagaaagtctaaaaaggtaatgtacaa

SEQ ID NO: 142124 - DNA, 601 bp, Human; identical to SEQ ID NO: 23647

SEQ ID NO: 142125 - DNA, 601 bp, Human; identical to SEQ ID NO: 23648

SEQ ID NO: 142126 - DNA, 601 bp, Human; identical to SEQ ID NO: 23649

SEQ ID NO: 142127 - DNA, 601 bp, Human; identical to SEQ ID NO: 23650

SEQ ID NO: 142128 - DNA, 601 bp, Human; identical to SEQ ID NO: 23651

SEQ ID NO: 142129 - DNA, 601 bp, Human; identical to SEQ ID NO: 29595

SEQ ID NO: 142130 - DNA, 601 bp, Human; identical to SEQ ID NO: 29596

SEQ ID NO: 142131 - DNA, 601 bp, Human; identical to SEQ ID NO: 29597

SEQ ID NO: 142132 - DNA, 601 bp, Human; identical to SEQ ID NO: 29598

SEQ ID NO: 142133 - DNA, 601 bp, Human; identical to SEQ ID NO: 29599

SEQ ID NO: 142134 - DNA, 601 bp, Human; identical to SEQ ID NO: 29600

SEQ ID NO: 142135 - DNA, 601 bp, Human; identical to SEQ ID NO: 29601

SEQ ID NO: 142136 - DNA, 601 bp, Human; identical to SEQ ID NO: 29602

SEQ ID NO: 142137 - DNA, 601 bp, Human; identical to SEQ ID NO: 29603

SEQ ID NO: 142138 - DNA, 601 bp, Human; identical to SEQ ID NO: 29604

SEQ ID NO: 142139 - DNA, 601 bp, Human; identical to SEQ ID NO: 29605

SEQ ID NO: 142140 - DNA, 601 bp, Human; identical to SEQ ID NO: 29606

SEQ ID NO: 142141 - DNA, 601 bp, Human; identical to SEQ ID NO: 29607

SEQ ID NO: 142142 - DNA, 601 bp, Human; identical to SEQ ID NO: 29608

SEQ ID NO: 142143 - DNA, 601 bp, Human; identical to SEQ ID NO: 29609

SEQ ID NO: 142144 - DNA, 601 bp, Human; identical to SEQ ID NO: 29610

SEQ ID NO: 142145 - DNA, 601 bp, Human; identical to SEQ ID NO: 29611

SEQ ID NO: 142146 - DNA, 601 bp, Human; identical to SEQ ID NO: 29612

SEQ ID NO: 142147 - DNA, 601 bp, Human; identical to SEQ ID NO: 29613

SEQ ID NO: 142148 - DNA, 601 bp, Human
cacacgattcccacgcggccccacacccctccacacacttccgctcccatttccacaggtcctcagagtacgcggagctccagctccacagagcccccatgtggttccccacacgagcgcacactttccccaagcgattccccacacacttcccgcctgcttccccgccttctccacacagtcacattcagtttctcacaaatcctcccacagttccccacgcaattcctcacacggtttctcacatactttcccgtagctgcacagagagctctgcacggttccctcacatgattccacrtagctccccaccctgtggcacacacgtcctgtcccggcaccacgcacagctcatgttcccacgcagctaccctcaggcccccagagttcctcgggttccccccacggttcctgaggcatttattcctctggtcctcacacaggttcttccggcttctgacagagttggacacacagttctctgcaggctccccacacagctccacacacacacacacacacacacagctccacacacacacacacacacacacacagctccacacacacacacacacacacacacacacacacacagctc

SEQ ID NO: 142149 - DNA, 601 bp, Human
ccgttccccgcacggttcccacgcggctgctcgcagctcaccacacagttcctcagctcctcccgctccccacgcacttcctcgcgtttctccacacggttcttcacgcagctcctcctgcttccccctttattcctccattcaggaaaacggcagtcactcgaatgcggaccccacccgcgggatggctgccggtcacaccattcatcaagtttccccacaagttccacacgcaattctgtcacagttctctgtggagttctttacacagttccacgcgatcctcacctaggtctctacrtagggcctcgttacacaggcgttcctcaccattctccacacgccagtccccaccgtccctgacacactcgctctcacggttcctcacagctccagagaaacttgcccacgttcctccaacatttcctaacacggctccccacgggaggcctcacacgatcctccatttctcagagctctcagcaggcgctcgcagctcccgcacagcgttacacacacacacacacacacacacacacacaggcttctcagtgtcccacgggcctcacagcagccacgcagctcccgaaaaccccttcag

SEQ ID NO: 142150 - DNA, 601 bp, Human
tccctatggtcctgcagaagccagctcacaagctttcctctaacggcctgttctcccatccctcccctcagaatgaagcatcctccatgctcttgctgcctctttggctctttaaaatatggactccatccacataatgcctgccaggaattgcttctgacagacactctgtgactgacttaatgatcccactaactgtgggtttcagtgacttccaatgtctactggttcatgtatgcattggcttatgaagcatttccagagcacctgctgggccggcagatgaggcctctgaccctgsagcctgcaccccaggacatgcacgcagatgccacctcaagggctgggagcacacacagacatcattgttcttgaagacaaccccaggagaagctccaccagctcacaaggcacataaaatttgaaagctcttgagactcccggtcaaagggggtccagaatactgcactggcttctctgcgagcagggtttcagggtgtccatctcgcagctcagcagcataactgactgctttcttttttctttggaaacttagtagggactaactctactctatttctagtttttcttttgttttgtt

SEQ ID NO: 142151 - DNA, 601 bp, Human; identical to SEQ ID NO: 29614

SEQ ID NO: 142152 - DNA, 601 bp, Human; identical to SEQ ID NO: 29615

SEQ ID NO: 142153 - DNA, 601 bp, Human; identical to SEQ ID NO: 29616

SEQ ID NO: 142154 - DNA, 601 bp, Human; identical to SEQ ID NO: 29617

SEQ ID NO: 142155 - DNA, 601 bp, Human; identical to SEQ ID NO: 29618

SEQ ID NO: 142156 - DNA, 601 bp, Human; identical to SEQ ID NO: 29619

SEQ ID NO: 142157 - DNA, 601 bp, Human; identical to SEQ ID NO: 29620

SEQ ID NO: 142158 - DNA, 601 bp, Human; identical to SEQ ID NO: 29621

SEQ ID NO: 142159 - DNA, 601 bp, Human; identical to SEQ ID NO: 29622

SEQ ID NO: 142160 - DNA, 601 bp, Human; identical to SEQ ID NO: 29623

SEQ ID NO: 142161 - DNA, 601 bp, Human; identical to SEQ ID NO: 29624

SEQ ID NO: 142162 - DNA, 601 bp, Human; identical to SEQ ID NO: 29625

SEQ ID NO: 142163 - DNA, 601 bp, Human; identical to SEQ ID NO: 29626

SEQ ID NO: 142164 - DNA, 601 bp, Human; identical to SEQ ID NO: 29627

SEQ ID NO: 142165 - DNA, 601 bp, Human; identical to SEQ ID NO: 29628

SEQ ID NO: 142166 - DNA, 601 bp, Human; identical to SEQ ID NO: 29629

SEQ ID NO: 142167 - DNA, 601 bp, Human; identical to SEQ ID NO: 29630

SEQ ID NO: 142168 - DNA, 601 bp, Human; identical to SEQ ID NO: 29631

SEQ ID NO: 142169 - DNA, 601 bp, Human; identical to SEQ ID NO: 29632

SEQ ID NO: 142170 - DNA, 601 bp, Human; identical to SEQ ID NO: 29633

SEQ ID NO: 142171 - DNA, 601 bp, Human; identical to SEQ ID NO: 29634

SEQ ID NO: 142172 - DNA, 601 bp, Human; identical to SEQ ID NO: 29635

SEQ ID NO: 142173 - DNA, 601 bp, Human; identical to SEQ ID NO: 29636

SEQ ID NO: 142174 - DNA, 601 bp, Human; identical to SEQ ID NO: 29637

SEQ ID NO: 142175 - DNA, 601 bp, Human; identical to SEQ ID NO: 29638

SEQ ID NO: 142176 - DNA, 601 bp, Human; identical to SEQ ID NO: 29639

SEQ ID NO: 142177 - DNA, 601 bp, Human; identical to SEQ ID NO: 29640

SEQ ID NO: 142178 - DNA, 601 bp, Human; identical to SEQ ID NO: 29641

SEQ ID NO: 142179 - DNA, 601 bp, Human; identical to SEQ ID NO: 29642

SEQ ID NO: 142180 - DNA, 601 bp, Human; identical to SEQ ID NO: 29643

SEQ ID NO: 142181 - DNA, 601 bp, Human; identical to SEQ ID NO: 29644

SEQ ID NO: 142182 - DNA, 601 bp, Human; identical to SEQ ID NO: 29645

SEQ ID NO: 142183 - DNA, 601 bp, Human; identical to SEQ ID NO: 29646

SEQ ID NO: 142184 - DNA, 601 bp, Human; identical to SEQ ID NO: 29647

SEQ ID NO: 142185 - DNA, 601 bp, Human; identical to SEQ ID NO: 29648

SEQ ID NO: 142186 - DNA, 601 bp, Human; identical to SEQ ID NO: 29649

SEQ ID NO: 142187 - DNA, 601 bp, Human; identical to SEQ ID NO: 29650

SEQ ID NO: 142188 - DNA, 601 bp, Human; identical to SEQ ID NO: 29651

SEQ ID NO: 142189 - DNA, 601 bp, Human; identical to SEQ ID NO: 29652

SEQ ID NO: 142190 - DNA, 601 bp, Human; identical to SEQ ID NO: 29653

SEQ ID NO: 142191 - DNA, 601 bp, Human
tccactctgggcttgtgcatcatgagccaggtcgagcccccagggagcagccaggactggacactggagcccccgcctcactttccccaagcccctggaaggcagcgtctgggacgcagtggagcccgcgggacgtccccacccaccagggctgcccctggcagtgctgagccacctgcccaggccaaccgcaggggctgcctccctctcccatcccctaaccccagcagaccccgatagggctgccacagacatcccagagcgccaaaaccccagcctaaatgcggtcgggctgggacckcccagactgtggggtcttggccgtgcaaggagtgtaggaaggagcagcctggtgatgaggggcctgtgccaagcagtgcctatgggcgcccaccccagctgctccacctctagccccaggatgcctgccagaggccactgactcatccacagcagcatggtccttggacatacagccacttgtccccacaccacgcaaccacaaaactcccgaggacagaactcagctcatcttccaacccctgcgctggcccctctgcttggtgataaacaaatgggcatggggatgcctgaaccagca

SEQ ID NO: 142192 - DNA, 601 bp, Human
agctctgagggtccactctgggcttgtgcatcatgagccaggtcgagcccccagggagcagccaggactggacactggagcccccgcctcactttccccaagcccctggaaggcagcgtctgggacgcagtggagcccgcgggacgtccccacccaccagggctgcccctggcagtgctgagccacctgcccaggccaaccgcaggggctgcctccctctcccatcccctaaccccagcagaccccgatagggctgccacagacatcccagagcgccaaaaccccagcctaaatgcggtcrggctgggaccgcccagactgtggggtcttggccgtgcaaggagtgtaggaaggagcagcctggtgatgaggggcctgtgccaagcagtgcctatgggcgcccaccccagctgctccacctctagccccaggatgcctgccagaggccactgactcatccacagcagcatggtccttggacatacagccacttgtccccacaccacgcaaccacaaaactcccgaggacagaactcagctcatcttccaacccctgcgctggcccctctgcttggtgataaacaaatgggcatggggatgc

SEQ ID NO: 142193 - DNA, 601 bp, Human
ggaggcagggtggctgctgcaaggccgtgtgcaaaagcgtctctgttagcacacgggagacagcggcggcctcgctgtgttcctaatctccaccctggagttatgatgagcacggcctgagccagccacccacaaaccctgtcccagggtggctcagggccagccccaggggcctgggattttacatccccatggggtcgaaccacgttccgcaaacaccttgggtgccctctgctccggaacagggttttctgttacgtgagagttcctgttttcagccttctggatggcagtgactgarctacttcctcaggcctggtgctcacagggaggactggtcatacccgaggtggacaatttgcctgactccagaatgtggctactctgcagaccctgagcagcacgttcagctcgcccaccccaccatccacccagcctcacccagctcccctccaagcatcctcgcaaggacacagttcagagacatcaacacacacagctgggcggccacgcaggctccaaggcggccgggcccctcccgagaccgcggtggagcacaggtggcaccaggctgccctgtctactgcacacatggtctggg

SEQ ID NO: 142194 - DNA, 601 bp, Human
tctctccctggacctgaaggggacctgcccgggtttgccaaaaacctccatggtccatctcctctgacaatggactcacccttggtccattgggaagaggaaggccccggggggaggatgcttggcatggaggcagggtggctgctgcaaggccgtgtgcaaaagcgtctctgttagcacacgggagacagcggcggcctcgctgtgttcctaatctccaccctggagttatgatgagcacggcctgagccagccacccacaaaccctgtcccagggtggctcagggccagccccaggggsctgggattttacatccccatggggtcgaaccacgttccgcaaacaccttgggtgccctctgctccggaacagggttttctgttacgtgagagttcctgttttcagccttctggatggcagtgactgagctacttcctcaggcctggtgctcacagggaggactggtcatacccgaggtggacaatttgcctgactccagaatgtggctactctgcagaccctgagcagcacgttcagctcgcccaccccaccatccacccagcctcacccagctcccctccaagcatcctcgcaaggaca

SEQ ID NO: 142195 - DNA, 601 bp, Human
atctctccctggacctgaaggggacctgcccgggtttgccaaaaacctccatggtccatctcctctgacaatggactcacccttggtccattgggaagaggaaggccccggggggaggatgcttggcatggaggcagggtggctgctgcaaggccgtgtgcaaaagcgtctctgttagcacacgggagacagcggcggcctcgctgtgttcctaatctccaccctggagttatgatgagcacggcctgagccagccacccacaaaccctgtcccagggtggctcagggccagccccaggggcctgggattttacatccccatggggtcgaaccacgttccgcaaacaccttgggtgccctctgctccggaacagggttttctgttacgtgagagttcctgttttcagccttctggatggcagtgactgagctacttcctcaggcctggtgctcacagggaggactggtcatacccgaggtggacaatttgcctgactccagaatgtggctactctgcagaccctgagcagcacgttcagctcgcccaccccaccatccacccagcctcacccagctcccctccaagcatcctcgcaaggac

SEQ ID NO: 142196 - DNA, 601 bp, Human
ggcgccaccatctctccctggacctgaaggggacctgcccgggtttgccaaaaacctccatggtccatctcctctgacaatggactcacccttggtccattgggaagaggaaggccccggggggaggatgcttggcatggaggcagggtggctgctgcaaggccgtgtgcaaaagcgtctctgttagcacacgggagacagcggcggcctcgctgtgttcctaatctccaccctggagttatgatgagcacggcctgagccagccacccacaaaccctgtcccagggtggctcagggccarccccaggggcctgggattttacatccccatggggtcgaaccacgttccgcaaacaccttgggtgccctctgctccggaacagggttttctgttacgtgagagttcctgttttcagccttctggatggcagtgactgagctacttcctcaggcctggtgctcacagggaggactggtcatacccgaggtggacaatttgcctgactccagaatgtggctactctgcagaccctgagcagcacgttcagctcgcccaccccaccatccacccagcctcacccagctcccctccaagcatcct

SEQ ID NO: 142197 - DNA, 601 bp, Human
tcccacgcagcctcaaattggtaaaaggtcctgaaaggaagcagagacaaagtagaagttgatggcgtgggggctgctttcagccaggccggggacatgcagacagacagagcgacagacaaggggcagccgcaagggagcggctgggggcacaggctggaagcccgggcggcggtgccaggaaggacaggtccctccttactcaggacccagagagtagggtctcttggacgccccgatgagggtgagcccagcattttcccagctccaccacaaatggtgccccagctgtcacgctgargctggaaggagaggaggcggcagggaatgagaacaagaagggcagagagggaagggaggagggaggcaggacagggagctgggatgtggggaacacagggaagggagaggggagggcaggaggagaggactcaggcagggaggagaggaaggacagaggcagggagggagagggcagagcctgcgcgggcccaccccagcctcagtctgagtaaggaggcgccaccatctctccctggacctgaaggggacctgcccgggtttgccaaaaacctccatggtccatctcctctgacaatgg

SEQ ID NO: 142198 - DNA, 601 bp, Human; identical to SEQ ID NO: 29654

SEQ ID NO: 142199 - DNA, 601 bp, Human; identical to SEQ ID NO: 29655

SEQ ID NO: 142200 - DNA, 601 bp, Human; identical to SEQ ID NO: 29656

SEQ ID NO: 142201 - DNA, 601 bp, Human; identical to SEQ ID NO: 29657

SEQ ID NO: 142202 - DNA, 601 bp, Human; identical to SEQ ID NO: 29658

SEQ ID NO: 142203 - DNA, 601 bp, Human; identical to SEQ ID NO: 29659

SEQ ID NO: 142204 - DNA, 601 bp, Human; identical to SEQ ID NO: 29660

SEQ ID NO: 142205 - DNA, 601 bp, Human; identical to SEQ ID NO: 29661

SEQ ID NO: 142206 - DNA, 601 bp, Human
catagagatacggggaaataatcactgggaaagaaaagggagggagagaagattaaggcaaaaataattaaaaataaatccacacgcaagtatacacacactggaaagatatttagcaacacacacgtgattttcttaggaagaagatagacccatttaggagggcatacacactggtaaaatgtttcatttccaccctggcacctacggagttactgtacttaatgcacacataggctgacagctgcacggagctataggtgctctgaagtcagacagtgcagccaagccagtgccttcrccgtccccattgaggaaggagagcctcaacattatttttaaacatacagaaaagttgttttccatgttacgtatgggctatttaggtgtattacgaccgtgagtacaaagatatgcctgcatcaagccgccttctaaaggaaaggagacttagtgcatgaaaaacgcagtaattcaatccttatgttgctcatctttcacatactcattatgcatgtatacacaggctttagcaaacgaagctgcgagatttgaatgaaatgttccttgttagtcaagaattttaaaagttttgaattaa

SEQ ID NO: 142207 - DNA, 601 bp, Human; identical to SEQ ID NO: 29104

SEQ ID NO: 142208 - DNA, 601 bp, Human; identical to SEQ ID NO: 29105

SEQ ID NO: 142209 - DNA, 601 bp, Human; identical to SEQ ID NO: 29106

SEQ ID NO: 142210 - DNA, 601 bp, Human; identical to SEQ ID NO: 29107

SEQ ID NO: 142211 - DNA, 601 bp, Human; identical to SEQ ID NO: 36595

SEQ ID NO: 142212 - DNA, 601 bp, Human; identical to SEQ ID NO: 36596

SEQ ID NO: 142213 - DNA, 601 bp, Human; identical to SEQ ID NO: 36597

SEQ ID NO: 142214 - DNA, 601 bp, Human; identical to SEQ ID NO: 36598

SEQ ID NO: 142215 - DNA, 601 bp, Human; identical to SEQ ID NO: 36599

SEQ ID NO: 142216 - DNA, 601 bp, Human; identical to SEQ ID NO: 36600

SEQ ID NO: 142217 - DNA, 601 bp, Human
ttattctgcctgggcttttttaagaggtttgcacaccatataaaagtaacataacttgtgatttttaatattttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtrcaataagtgtagaagacatattggattttagagatccagtatggaaaatacaaagtatttcattagttttattcatcaaatattaaacaaatattggtttttatatggaaaaaatacttaaaattaattttgaattcttttgaaatacttttgatattgggttaaataaaatgtattttgggctgtgcgtgttgcctcatgcctgtaatttcagcactttgggaggccaaggtgggaggatcagttgagcccaggagtttgagaccagcctgagcaacataatgagactccatctctaca

SEQ ID NO: 142218 - DNA, 601 bp, Human
tgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtgcaataagtgtagaagacatattggattttagagatccagtatggaaaatacaaagtatttcattagttttattcatcaaatattaaacaaatattggtttttatatggaaaaaatacttaaaattaattttgaattmttttgaaatacttttgatattgggttaaataaaatgtattttgggctgtgcgtgttgcctcatgcctgtaatttcagcactttgggaggccaaggtgggaggatcagttgagcccaggagtttgagaccagcctgagcaacataatgagactccatctctacaaaataaataataaaatttgctgagcatggtggtgtgcacctgtagacccatccactcagtagtctgaggtgggaagatcccttgagctcaggagctcaagactgagtgaaccatgatctgccattgcactccaccct

SEQ ID NO: 142219 - DNA, 601 bp, Human
cccaggagtttgagaccagcctgagcaacataatgagactccatctctacaaaataaataataaaatttgctgagcatggtggtgtgcacctgtagacccatccactcagtagtctgaggtgggaagatcccttgagctcaggagctcaagactgagtgaaccatgatctgccattgcactccaccctgggcaacagagcaagagtgtttccaaaatatatgtatgttttttgaagtttactttttttttttttctttttttgagaagtagtcttcctttgtcccccaggctggagtgcartggcatgatcttggctcatagcaacctctgcctcccaggttcaagtgattctcctgcctcagcatcctgagtagctgggattacaggcgcccgctaccatgcccagctaatttctgtatttttagtagagacagggtttcaccaggttggccaggctggtgttgaactcctgacttcaggtgatccaccctcctcggcctcccaaggctctgggattataggcgtgagccaccgcgcctggccagttttcaccttaatgtggttactaaacaatttaaagttatatgtatgtctcacatt

SEQ ID NO: 142220 - DNA, 601 bp, Human
ggcgtgagccaccgcgcctggccagttttcaccttaatgtggttactaaacaatttaaagttatatgtatgtctcacattatgtacctattgtacagctctgctttagcatagaaagtttaataatgcattacaccattctcaagagattgagtcattagaaaactgttttctttcctgtatttcagtcttttggaaagaaattacaaaatttgttattgttaaacttggaggtatatatatttgaaagagtcattttattttattttactttaagtgccgggatacatgtgcagaatgcrcagatttgttaacataggtatacatgtgccatggtggtttgctgcatctatcaacctgtcatctaggttgtaagccccacattcattaggtatttgtcctaatgcttttccaccccttgccccccacctcctgacaggcctctgtgtgtggtgttccccaccctgtgtccatgtgttcttattgttcaactctcacttatgagtgaggacatgtggtgtttggttttctgttcttgtgttagtttgctgaggatgatggcttccagcgaaggagtcttgtattagtggctttttccccac

SEQ ID NO: 142221 - DNA, 601 bp, Human
gttttcaccttaatgtggttactaaacaatttaaagttatatgtatgtctcacattatgtacctattgtacagctctgctttagcatagaaagtttaataatgcattacaccattctcaagagattgagtcattagaaaactgttttctttcctgtatttcagtcttttggaaagaaattacaaaatttgttattgttaaacttggaggtatatatatttgaaagagtcattttattttattttactttaagtgccgggatacatgtgcagaatgcgcagatttgttaacataggtatacrtgtgccatggtggtttgctgcatctatcaacctgtcatctaggttgtaagccccacattcattaggtatttgtcctaatgcttttccaccccttgccccccacctcctgacaggcctctgtgtgtggtgttccccaccctgtgtccatgtgttcttattgttcaactctcacttatgagtgaggacatgtggtgtttggttttctgttcttgtgttagtttgctgaggatgatggcttccagcgaaggagtcttgtattagtggctttttccccacctaatcgttagaagttgtgaatag

SEQ ID NO: 142222 - DNA, 601 bp, Human
ccttaatgtggttactaaacaatttaaagttatatgtatgtctcacattatgtacctattgtacagctctgctttagcatagaaagtttaataatgcattacaccattctcaagagattgagtcattagaaaactgttttctttcctgtatttcagtcttttggaaagaaattacaaaatttgttattgttaaacttggaggtatatatatttgaaagagtcattttattttattttactttaagtgccgggatacatgtgcagaatgcgcagatttgttaacataggtatacatgtgccrtggtggtttgctgcatctatcaacctgtcatctaggttgtaagccccacattcattaggtatttgtcctaatgcttttccaccccttgccccccacctcctgacaggcctctgtgtgtggtgttccccaccctgtgtccatgtgttcttattgttcaactctcacttatgagtgaggacatgtggtgtttggttttctgttcttgtgttagtttgctgaggatgatggcttccagcgaaggagtcttgtattagtggctttttccccacctaatcgttagaagttgtgaatagggacttc

SEQ ID NO: 142223 - DNA, 601 bp, Human
ttttttttttggagacggagtctggctctgtttcccaggctggagtgtagtggtgtgatctctgctcaccatacaacctccacttcccgagttcaagagattctcctgcctcagccttccgagttgttgggactacaggcgcgtgctgccatgcctggctaatttttgtatttttggtagagacggggattcactatgttggccaggttggtcttgaactcctgaccttgtggtccgcccatctcagcctcccaaagtgctgggattacaggtgcgaggcaccgcgccccgcgccctgcckatgaacctaaattttaactaaacagtggccttatctactttcagaccatgtggtatatttacatgactacaggagaagctttgctaattcagaataaattatgttacttaaattggcgactgtctttaaaaaaaaagtgattttttggatgcagtagctcgtgcctataatcccagtgctttgggaagctgagataggaagatctcttgaactccggagtttgagaccagcctgcgcaacacagtgagaccctaatcactacacccctccaccccatgtaacttttgttttatccaggtt

SEQ ID NO: 142224 - DNA, 601 bp, Human
gtatttttggtagagacggggattcactatgttggccaggttggtcttgaactcctgaccttgtggtccgcccatctcagcctcccaaagtgctgggattacaggtgcgaggcaccgcgccccgcgccctgccgatgaacctaaattttaactaaacagtggccttatctactttcagaccatgtggtatatttacatgactacaggagaagctttgctaattcagaataaattatgttacttaaattggcgactgtctttaaaaaaaaagtgattttttggatgcagtagctcgtgcctrtaatcccagtgctttgggaagctgagataggaagatctcttgaactccggagtttgagaccagcctgcgcaacacagtgagaccctaatcactacacccctccaccccatgtaacttttgttttatccaggttgtggtatattaaatgggcattagtgtaaagtgggaaaattatattaattcttgaatatgattactaaactgaatttgaaaagttttcaggctatcaagagaatttttaacttaaaacttatataatttgaactttttacttcatatatccgtaatgatgatggtcat

SEQ ID NO: 142225 - DNA, 601 bp, Human
ggacactggcatttataaaatctccacgtagcgcagacattgacactatcagaagaccagcaagtaactagaagttactttgatcttaaatcaactacaaaaaacttgactcactagttatggagaatacattttttattgttaaactgaaaaaaaattcagtcacttataaggtgtagcctcttctaatcctgtttatataaatttatttattattattattttttgagatggagtcttgctctgttgccaggctgtagtgcattggcgcgatctcggctcactgcatcctccacctccygggttcaagcaattctcttgcctcagcctcccaagtagctgggactacaggcacgtgccatcacgatcagcacttttagtagagacggggtttcaccatgttggcaaggacgtgtctcgtcgtgacctcgtgatccgcccgtttcagcctcccaaagtgttgggattacaggtgtgagccacaatgtccagctgataaatttaattttgcttttctgagttttcatttatggtaatggttaaatcagctaggctttacagttgttactcacatataattctttgtccatcctttaattct

SEQ ID NO: 142226 - DNA, 601 bp, Human
cataggcatgtaccatatacctagctaaatgtgtttttgactttcttttttctttgtagagtcaagttctcactatgttgtccaggctggtcttgaaatcctgggttccagcaattctcctgcttagccttacagagtgtcgggattgtaggcataggccactgcacccggccttgggctgatatttatttgctatggggaactttcctgtgcgttgtaggatgtttggcaatgtccctggccggccaggtgcagcggctcacacctgtaatcccagcactttgggaggctgaggtgggcrgatcacttgaggctgggagttcagaagagaccagccaacatggtgaaaccctgtctctactaaaaatacaaaaattagccgggtgtggtgacacacatgagaatcacttgaactcaggaggctgagtttgccgtgagctgagatcgcgctgctgtactccagcctgggtgacaaagcaagaatctgtctcaaaaaaaaaaaaaaaaaaaaaaaaaattcgctggtctccacctacgtttgtatccccaccccaagtcctgacaataaaaaatgtcttcaaaatgttccttgcaaaattgc

SEQ ID NO: 142227 - DNA, 601 bp, Human
tgttttaatactcaacatgtatatggattatatatctatacgtttatagtattgtagctggatttatgttacatttttagcataaaatttggcttttgctgggcccagtggcttgcgactgtagtcccagcaactcaggagggtaaggtgggaggattgcttgaaccaaagagtttgaggctgcagtgagctgtgacctcacctctgcacaccagcctgagtgacagagcaagacccatccctgaaaagaaaaaacttggctgttttactttgctttcaatttgtagtatattctacttartataataaacttactttctgtgaggtgcttgaatactttttaatggttatttatgaagtggtgaactgtaattctgtatttgtacatttggatgtacaaatagtgttgctacagttgtccttttttggtatgtctccagtgttcttaggataaattcctgaaagtgaatttcagttttgaatttcagagaaacatgtcaaagttcttctttaagcctttaagtctcctgatatgttttgtcgtattgcagcttggaaaggttgaaataaaatcttctattagggctgggtgcagtggctc

SEQ ID NO: 142228 - DNA, 601 bp, Human
atttgagacagggcctgtctctgatacccagacgtgtgcagtatctttcaaaaatcatatatctatatatagtttgccccttccttcagtctttgctgcccctaatatctgtccttaatggttaccatggtgaaactcttggaaatcattcagggggaaaaaaaatttgtgttgggataggggagggatgtcagcataagtttttaatacttgataaatgattgccaacagaatcaaaaacaccttgttttctatcttttttcaccatataatattcttgagaataatttcgtaacagcasttaacagatataccttatttttcaaagaaggctgtgtagcattctattttaaagttgtttcacagtatatgagtctcctattgataggtatctgcatttttgtctttttgatctagggttgtttttaaggcagtttaaaaactatagtaagtaaaagaggccaggtgcggtggctcacacctgtaaacccagcactttgggaggccgaggcgggtggatcacttgaggtaggagtttgagaccagcctggcaaacatggtgaaacccttctctactaaaaatacaaaaaattagccggcc

SEQ ID NO: 142229 - DNA, 601 bp, Human
tagagatgggggtttcaccatgtttgccaggctggtcttgaactcctaacctcaggtgatccgcccaccttggcctcccaaagtgctgggtttataggtgtgagccgccgcgcttggctcaacatcttattgtttgagacagggtctccttctgttatccaagctggagtgtagtagtgtgatcttacagctcactgcagcctccaactcttgggctcaaatgattctcctgtctcagcctcccaagtagctagtactacaggtgtgcaccaccatgccctgctgtttctttgttttttttatatggacagtcttgctatgttgcccaggctggtctcaaactcctgagctcgagtgattctgctgcctcagctactcaaagtgctgggattgtaggcgttaactatcaggttaggcctgttctgtttttattagcgtggatgactgctggttactactggccgtttgtatatccttgaattacctctttgtttttagccatttttctccatttgggtgctttttcacagtgacttctgggaatattatgttcttttcttttgatttacctttcaaattttatttttatggatatataata

SEQ ID NO: 142230 - DNA, 601 bp, Human
catcctgggtgacagagcgagactctcaaaaaaaaaggtgggtgtgaattttgttatgttgtgcgggctggagtgtagtgcccatccattggcacgatcatagagtactacagctccctaactcccagactcaagtgattctccctcctctgtctccccagtagcaggaactacaggcctgtgccaccatgcccagctttcttagtcttgagggactgcatttacacctatgccttttactctagggtcttttattcatattgctagaaatttggagaagaaagaaaggcataatctctgsagaaaagccattatttctgcagatagttctttttttttttgagatggagtctttctttgtcacccaggctggagtgcagtggtgtgatctaggctcactacaagctccacctcctgggttcacgccattctcctgccttagcctcccgagtagtgggactacaggcacccgccaccatgcccagctaatttttttttgtattttttagtagagacggggtttcaccatcttagccaggatggtctcgatcttctgaccttgtgatccgccgacctcggccacccaaagtgctgggattac

SEQ ID NO: 142231 - DNA, 601 bp, Human
ggtgtgaattttgttatgttgtgcgggctggagtgtagtgcccatccattggcacgatcatagagtactacagctccctaactcccagactcaagtgattctccctcctctgtctccccagtagcaggaactacaggcctgtgccaccatgcccagctttcttagtcttgagggactgcatttacacctatgccttttactctagggtcttttattcatattgctagaaatttggagaagaaagaaaggcataatctctgcagaaaagccattatttctgcagatagttctttttttttttgagatggagtctttctttgtcacccaggctggagtgcagtggtgtgatctaggctcactacaagctccacctcctgggttcacgccattctcctgccttagcctcccgagtagtgggactacaggcacccgccaccatgcccagctaatttttttttgtattttttagtagagacggggtttcaccatcttagccaggatggtctcgatcttctgaccttgtgatccgccgacctcggccacccaaagtgctgggattacaggcatgagccaccacatccggccaatttctgcggatagt

SEQ ID NO: 142232 - DNA, 601 bp, Human
tataaggatccctatggcagcaacagaatggcccagccctcatgattggttgcttaaaaaggctttaggatattcaaactgggtggcctgtcttgtttggaataggactaagcatgtcacactttcaccatggaagagttaatccatattctatctgtaagttgtatctccagtcattggttttcaacaagtggtcctatcttaggaggagtggtatattagaacagtccttccagagtaatttttttcattatttcagattttttagttttttttgtttttttgttttttttttttttttaaaggctctcactctgtcacccaggctggagagcagtgatacgatcatagctcactggaacctctacctccctgggctcaggtgatcctcccacctcagccttctgagtttctgggactacaggcatgaaccgtgaggcccagctaatttttgtgatttttgtgttttttgtagagtcagggtttctccatgttgcccaggctggtctcgtactcctggtctcaagtaacctgcccgcctcggccttccaaagtgctgggattagaggtgtgagccaccacacctgtactactactttta

SEQ ID NO: 142233 - DNA, 601 bp, Human
ggaccaaaattgatactttttctctgatctttttgccatgtgtatatctgaattctttgtttttaaagaagaaacagcattgaagcattatttggggggaaaaacacacacacaaaatccagcaactcagcattcatgagcaactctatactataccagtatgtgcctgtgcagtggaaggaaaacaattttggtaaggattaaaactttagctttaaacttccagcaggttgatattctaatgaatgataaatcaaaaaaaaattttaaatattcttgtattgacagtgcttttttttttaaatcaccctaccttgatatctgtaattttagtttaaactttcccatttttctttaaagaaaaaaatctgaatttgcagccaacaaaaattagatatcctaaggttgtattacttctgacttttattaaaatatcaacatttcttagagatgtttatgggccgactttgtctttttcttcaaggggccaagttcactaattgctgagttttatgcatatgacagcaaccgtccttttgtaggtgtgtgtcgcatccatctagatactttaaaatgctcatctatttcatttttaaaatta

SEQ ID NO: 142234 - DNA, 601 bp, Human; identical to SEQ ID NO: 36601

SEQ ID NO: 142235 - DNA, 601 bp, Human; identical to SEQ ID NO: 36602

SEQ ID NO: 142236 - DNA, 601 bp, Human; identical to SEQ ID NO: 36603

SEQ ID NO: 142237 - DNA, 601 bp, Human; identical to SEQ ID NO: 36604

SEQ ID NO: 142238 - DNA, 601 bp, Human; identical to SEQ ID NO: 36605

SEQ ID NO: 142239 - DNA, 601 bp, Human; identical to SEQ ID NO: 36606

SEQ ID NO: 142240 - DNA, 601 bp, Human; identical to SEQ ID NO: 36607

SEQ ID NO: 142241 - DNA, 601 bp, Human; identical to SEQ ID NO: 36608

SEQ ID NO: 142242 - DNA, 601 bp, Human; identical to SEQ ID NO: 36609

SEQ ID NO: 142243 - DNA, 601 bp, Human
caccatcagctgttgtggcctctccctttccctggtctctagggggctccctcgctcccatctccatccctgtgcccctttccgttgcagttggcttggatgcggctggcaagaccacaatcctgtacaaactgaagttgggggagattgtcaccaccatcccaaccataggtgagcccggggacgaagcagggagcgggagcgccgcggcgggccctcgcggggtctgctcccagttctgccacttttctggagctgaccctgacaccagatacagctatttgagaagtgggtcagggtrtctctacgtggataccggaggcagggtggatgtgacctagccccgccctgttgaccgccagttctggggttctgttcccctgggccttgatcattgccttctggttttgtgtccctgctgaaatctaagtagttttagtgagttcctttctttcaggagttttctcatcttttttttccaattatctgcaggcttcaatgtagaaacagtggaatataagaacatctgtttcacagtctgggacgtgggaggccaggacaagattcggcctctgtggcggcactacttccagaacactca

SEQ ID NO: 142244 - DNA, 601 bp, Human
atagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatctttgtggtggacagtaatgaccgggagcgggtccaagaatctgctgatgaactccagaagatggtgagtacccagagccctgggaactgagccctcagcttggggacagagtgatctctgtagtggtatagaagtcagggagcccccmacaggcattgaagaccaggaatataagtttttctttgtggacagacacattgtgtatctcaccctgttttggatgggagtgactttttcactttttctgtgcattgtcttgtctttttttttttttgaaatgggagttttgctgttgttgcccaggctggagtgcaatggtgcaatctcggctcactgcaacctccgtctcccgggttcaagcaattctcctgcctcagcctcccaagtagctgggattacaggcgcccgctgccatgcccagttaatttttgtatttttagtagagacg

SEQ ID NO: 142245 - DNA, 601 bp, Human
gatgaactccagaagatggtgagtacccagagccctgggaactgagccctcagcttggggacagagtgatctctgtagtggtatagaagtcagggagcccccaacaggcattgaagaccaggaatataagtttttctttgtggacagacacattgtgtatctcaccctgttttggatgggagtgactttttcactttttctgtgcattgtcttgtctttttttttttttgaaatgggagttttgctgttgttgcccaggctggagtgcaatggtgcaatctcggctcactgcaacctccgyctcccgggttcaagcaattctcctgcctcagcctcccaagtagctgggattacaggcgcccgctgccatgcccagttaatttttgtatttttagtagagacggggtttcaccatgttggccaggctggtcttgaacccccaacctcaggtgatccacccgtcttggtctcccaaagtgctgggattacaggagtgagccactgcgcccggccgcattctcatgtctttacatctgagtctgagaagttgtgggagagatgggacttatatgtggcaaagagaaacattttacattcctgc

SEQ ID NO: 142246 - DNA, 601 bp, Human
gcccgatgcgtgcccaaggacaaggccattaagaaattcgtcattcgaaacatagtggaggccgtagcagtcagggacatttctgaagcaagcgtcttcgatgcctatgtgcttcccaagctgtatgtgaagctacattactgtgtgagttgtgcaattcacagcaaagtagtcaggaatcgatctcgtgaagcccgcaaggaccgaacacccccacccagatttagacctgcgggtgctgccccacgtcccccaccaaagcccatgtaaggagctgagttcttaaagactgaagacaggytattctctggagaaaaataaaatggaaattgtaaaaaaataataataataataaaagaaagaaaaaaaacaacatctaaaaaaaaataaataaaaataaaaataaaacccttagaccaaatataaagccttgaactgtctatgccttcttacatcctgttttaagaactgagatgagtctagacccaaatgaatacaaatgggatttgaaaagcataaagcttttttttttgtttgcttgtttggaaaataatacatacacatggtattaccataatcttatcaatattatgaagtcgtt

SEQ ID NO: 142247 - DNA, 601 bp, Human
tcccggcacagagctcttacccacaactaccaacatccagcgaccaccagaggaccctggcgctccacccggcgctccgaccagcgttccctcgggcgatgcagttcaaccacagaacccgtatgacactgcctgctgcctctaccacctcctggccacccctgggccctgggccaggcctgcaccgtcagcaccacctggatggagccctctccagcccccagtggagtgggaaacattaagtccttctacaaggagagtcaaccggggtaaacacctcacagggcacacacctttgacktgggcactgcatggggagcaccagggcacagccgggcacaaagtgctgcctgaagagttctcagcaacactagtggtgccagccacacgcctcttggctcagtgacaccaccgtcagctcagaccaggtcacattctgggggtactggccacaggaagttgagagggcaagtgacagtcagaggagaaaaaccagaaaaactgccaggctggtggggaaccaggtgtggcttgacggccacctctaagccccgagggaagagactgggcctctcgagcctggggcccgtttcctggagag

SEQ ID NO: 142248 - DNA, 601 bp, Human
attcctctccaggacatccgtggagccgcacgtttccctgtttgttcagcgagcacatgcacacaacctgtgagctccaggaacccccagaacgccaccttcctggctcctaccacatgtggggtatcagggctacaccttcctccccttcccaacacagtctacacacgacaccactggagagacagcctcggatgcctctgaggctcctgccagccacgcagacagggcagcccaggagcccccacaccacagacgggcggcaggtcagggtggcacaggagggcacggtgacacgggyggcagggaagagtggcacgggagggcagggtgacacgggcggcatagcagagtggcatggacgggcagggtgacacgggcggcagggcagggtggcacgggtgggcagggtggcacgggcgggcaggatggcacaagcaggtcagggtggcacgtgtgggtagggtagcacgggtaggcagggtggcttgggccacaccaggcctggagagttaacggcggtgccaggggagggtgcagaaggggcctggtcccaacaccgcccacacctctctcagggccatagccccaacgcctcccc

SEQ ID NO: 142249 - DNA, 601 bp, Human
acctgccgcccagagaaaactgaggccctgccctgcaatggcagagaaggcaggcccccaagagggagccgcacagcagcatggagccactgggctgagagcacggggccaacagaacctcccccagacagacaaagcccgtcacccacaggttgaaacagctcctccgacgacagcaccccagacagacactgcccaagtcatccacgagccgatacggcaccttggacggcagcatccctgtgagccagggagccaccgcactccacggggcctgcagggccgcatcacagctcagagracacagcgcaggggctgtgatcaaaggcatggatttgccagcaagattcctctccaggacatccgtggagccgcacgtttccctgtttgttcagcgagcacatgcacacaacctgtgagctccaggaacccccagaacgccaccttcctggctcctaccacatgtggggtatcagggctacaccttcctccccttcccaacacagtctacacacgacaccactggagagacagcctcggatgcctctgaggctcctgccagccacgcagacagggcagcccaggagcccccacaccacag

SEQ ID NO: 142250 - DNA, 601 bp, Human
atgccagccaatactcatcaatactggccaaactcattgatacgggccaatactcattgataccggctgatactcattgataccagtcaatactcatcaatgctacccacggtggcccagtaccggctgctgctcgtcaagaccggccaatactcaatactgcccacagcagcatggcaccagccgctgctcctggaggatcatcgatacccatcaatgctgctcaatgcttatctatactggccagtacgtgcccacacctgtgtctctgaggaggaagcagatgtgtgaaggccaccckggccctcctgaaaggaccctgcagtgaggaggccgtgagctcccgagctgaggaacctgtggcagggctcctggggccctgcactccctgggctagccctgccagacctgaggggctgcaccccatgccacagggacttcctgtggttccttgttccaaggctgctccagttcaggacagacacctgaggcccagcacctggttctcctccagggacctctgtctcagaaacagccctggggtaggtctgcccaccatctgcaccaccctggggccactgtgcacccacaaagcgccccc

SEQ ID NO: 142251 - DNA, 601 bp, Human
catcaacgccaaccgatactcatcaatgccagccaatactcatcaatactggccaaactcattgatacgggccaatactcattgataccggctgatactcattgataccagtcaatactcatcaatgctacccacggtggcccagtaccggctgctgctcgtcaagaccggccaatactcaatactgcccacagcagcatggcaccagccgctgctcctggaggatcatcgatacccatcaatgctgctcaatgcttatctatactggccagtacgtgcccacacctgtgtctctgaggargaagcagatgtgtgaaggccaccctggccctcctgaaaggaccctgcagtgaggaggccgtgagctcccgagctgaggaacctgtggcagggctcctggggccctgcactccctgggctagccctgccagacctgaggggctgcaccccatgccacagggacttcctgtggttccttgttccaaggctgctccagttcaggacagacacctgaggcccagcacctggttctcctccagggacctctgtctcagaaacagccctggggtaggtctgcccaccatctgcaccaccctggggc

SEQ ID NO: 142252 - DNA, 601 bp, Human
tcaacgccagccgatactcatcaatgccagccgatactcatcaacgccaaccgatactcatcaatgccagccaatactcatcaatactggccaaactcattgatacgggccaatactcattgataccggctgatactcattgataccagtcaatactcatcaatgctacccacggtggcccagtaccggctgctgctcgtcaagaccggccaatactcaatactgcccacagcagcatggcaccagccgctgctcctggaggatcatcgatacccatcaatgctgctcaatgcttatctayactggccagtacgtgcccacacctgtgtctctgaggaggaagcagatgtgtgaaggccaccctggccctcctgaaaggaccctgcagtgaggaggccgtgagctcccgagctgaggaacctgtggcagggctcctggggccctgcactccctgggctagccctgccagacctgaggggctgcaccccatgccacagggacttcctgtggttccttgttccaaggctgctccagttcaggacagacacctgaggcccagcacctggttctcctccagggacctctgtctcagaaacagccc

SEQ ID NO: 142253 - DNA, 601 bp, Human
cagtagaggcttgagagtgcacacgatcgcccagccctcgggagggtgtcactgagctgcccacacctggcccctgctctggcatgaagacacagcaccgaggctgaccccaacgtgcagctgacatcaggctgaccaggacaggagccggccaccaccagcccagcagcgtggcaggcgtgggctgagacgactgcctgccaggccagaaggggccactcagccaagcctaagaccctggtagtgtgctgtgaggccgcccctgcgcagaggcctcgcagacaaatctccaaccctcaaytccctctgcaggattcaagcatacatgccgaccatctccagcttccagagacaccatcacaggggctggggtgcagccccacgcacgcacctcccatccagggtccccaacaccactcctcatggcaggtgctgtgtgggactccctgacggagggcccaagagcaacactgtggagcgggatccccatcacctgcgcctgagcccccatgacctgcgctgcagcctcctgccctgaatgccagatctccccatggtacccggataccacataaaaacaaactaaaaggacaggagaaaa

SEQ ID NO: 142254 - DNA, 601 bp, Human
ggagaggtgctgctggctttccagcatccagcctggcactgcctgcactgagccgcgccggctccacctccgaccctcagtgcatcctggcgacgctccctcaattctcccaaaaaaactgctcagctcttcctgaccgctacggccagggcctggcgggaagctgagggcacgaaccccagtggctgaatgcacaggggcagggggcccctgagagggccaagccttccagtagaggcttgagagtgcacacgatcgcccagccctcgggagggtgtcactgagctgcccacacctggcycctgctctggcatgaagacacagcaccgaggctgaccccaacgtgcagctgacatcaggctgaccaggacaggagccggccaccaccagcccagcagcgtggcaggcgtgggctgagacgactgcctgccaggccagaaggggccactcagccaagcctaagaccctggtagtgtgctgtgaggccgcccctgcgcagaggcctcgcagacaaatctccaaccctcaactccctctgcaggattcaagcatacatgccgaccatctccagcttccagagacaccatcacaggggctgggg

SEQ ID NO: 142255 - DNA, 601 bp, Human
atcgaaggtccgaccagaactcacagactccagggaacgcctcagaagtggacctcactgcatctgccacacccgggactgctgtctgggacctacctggactcgggggcctgctgacagccaggggccccggctcctgccgcacacacgaagggcgctcaccctgaggttgcagtgccaggcccgaggccgcgcccctgtggccccgaggcctactcctgggaacagtcccccagggctgcggccacccccacaggctctagccgcatccagatgtccccagtgtccaagaaccaggggrcggagggcacagggtgtgtgctgtgggcagggaaactgcggaaaggctctgcctcctgttctggaagcttctatctcatgtcactgattcccgggcctctgtgaccaggcaaggacgtggaacttcccaggagccaccgggagaggtgctgctggctttccagcatccagcctggcactgcctgcactgagccgcgccggctccacctccgaccctcagtgcatcctggcgacgctccctcaattctcccaaaaaaactgctcagctcttcctgaccgctacggccagggcctggcggga

SEQ ID NO: 142256 - DNA, 601 bp, Human
ggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcagaaccgcgtgggggactcccgggtgctgggtgagtgggaaccgggtccctcgtcggaaccgcgtgggggactcccgggtgctgggtgagtgggaaccgggtccctcagctgaacggtggggaggggggagcaggtggagacaccargccccatcaggctcaggcacccaaggtgcctcctcacatcacccatgagctgcccctgaccaccgtgccagggttccccggacagcccacccttgcaggcttggggacacacccaggaggcttcacagtcacacggcctgtgctgaagcaggctttgcagcatcccccaagcccaaggctgtttccgactgcacgcacttccgggccagagagcgcagaccaaccacaaggaacagctccacaggggccacggccctgctcctgggccagccgggtggacacctgagatttccagggttc

SEQ ID NO: 142257 - DNA, 601 bp, Human
cggctgcgtcagaaccgcctggggggactcctgggtgctgggtgagtgggaaccgggtccctcgtcagaaccgcgtgggggactcccgggtgctgggtgagtgggaaccgggtccctcgtcggaaccgtgtggggcactcccgggtgctgggtgagtgggaccgggtccctcgtcggaaccgcctggggggactcccgggtgctgggtgagtgggaaccgggtccctcgtcggaaccgcgtgggggactcccgggtgctgggtgagtgggaaccgggtccctcgtcggaaccgcgtggggsactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcagaaccgcgtgggggactcccgggtgctgggtgagtgggaaccgggtccctcgtcggaaccgcgtgggggactcccgggtgctgggtgagtgggaaccgggtccctcagctgaacggtggggaggggggagcaggtggagacaccaagcc

SEQ ID NO: 142258 - DNA, 601 bp, Human
accgctcggctgcgtcagaaccgcctggggggactcctgggtgctgggtgagtgggaaccgggtccctcgtcagaaccgcgtgggggactcccgggtgctgggtgagtgggaaccgggtccctcgtcggaaccgtgtggggcactcccgggtgctgggtgagtgggaccgggtccctcgtcggaaccgcctggggggactcccgggtgctgggtgagtgggaaccgggtccctcgtcggaaccgcgtgggggactcccgggtgctgggtgagtgggaaccgggtccctcgtcggaaccgcstgggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcagaaccgcgtgggggactcccgggtgctgggtgagtgggaaccgggtccctcgtcggaaccgcgtgggggactcccgggtgctgggtgagtgggaaccgggtccctcagctgaacggtggggaggggggagcaggtggagacac

SEQ ID NO: 142259 - DNA, 601 bp, Human
aaggtttatgttgctgtttctgagtgagtggatagacatccgctctcagtatccttggatttcacttctgatgaggaaggcatggacacacgggatcactgcagaccgctcggctgcgtcagaaccgcctggggggactcctgggtgctgggtgagtgggaaccgggtccctcgtcagaaccgcgtgggggactcccgggtgctgggtgagtgggaaccgggtccctcgtcggaaccgtgtggggcactcccgggtgctgggtgagtgggaccgggtccctcgtcggaaccgcctggggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcagaaccgcgtgggggactcccgggtgctgggtgagtggga

SEQ ID NO: 142260 - DNA, 601 bp, Human
gagcagaaaggtttatgttgctgtttctgagtgagtggatagacatccgctctcagtatccttggatttcacttctgatgaggaaggcatggacacacgggatcactgcagaccgctcggctgcgtcagaaccgcctggggggactcctgggtgctgggtgagtgggaaccgggtccctcgtcagaaccgcgtgggggactcccgggtgctgggtgagtgggaaccgggtccctcgtcggaaccgtgtggggcactcccgggtgctgggtgagtgggaccgggtccctcgtcggaaccgcstggggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcggaaccgcgtgggggactcccgggtgctgggtgagtgggaaccgggtccctcgtcagaaccgcgtgggggactcccgggtgctgggtg

SEQ ID NO: 142261 - DNA, 601 bp, Human; identical to SEQ ID NO: 21596

SEQ ID NO: 142262 - DNA, 601 bp, Human; identical to SEQ ID NO: 21597

SEQ ID NO: 142263 - DNA, 601 bp, Human; identical to SEQ ID NO: 21598

SEQ ID NO: 142264 - DNA, 601 bp, Human; identical to SEQ ID NO: 21599

SEQ ID NO: 142265 - DNA, 601 bp, Human; identical to SEQ ID NO: 21600

SEQ ID NO: 142266 - DNA, 601 bp, Human; identical to SEQ ID NO: 21601

SEQ ID NO: 142267 - DNA, 601 bp, Human; identical to SEQ ID NO: 21602

SEQ ID NO: 142268 - DNA, 601 bp, Human; identical to SEQ ID NO: 21603

SEQ ID NO: 142269 - DNA, 601 bp, Human; identical to SEQ ID NO: 21604

SEQ ID NO: 142270 - DNA, 601 bp, Human; identical to SEQ ID NO: 21605

SEQ ID NO: 142271 - DNA, 601 bp, Human; identical to SEQ ID NO: 21606

SEQ ID NO: 142272 - DNA, 601 bp, Human; identical to SEQ ID NO: 21607

SEQ ID NO: 142273 - DNA, 601 bp, Human; identical to SEQ ID NO: 21608

SEQ ID NO: 142274 - DNA, 601 bp, Human; identical to SEQ ID NO: 21609

SEQ ID NO: 142275 - DNA, 601 bp, Human; identical to SEQ ID NO: 21610

SEQ ID NO: 142276 - DNA, 601 bp, Human; identical to SEQ ID NO: 21611

SEQ ID NO: 142277 - DNA, 601 bp, Human; identical to SEQ ID NO: 21612

SEQ ID NO: 142278 - DNA, 601 bp, Human; identical to SEQ ID NO: 21613

SEQ ID NO: 142279 - DNA, 601 bp, Human; identical to SEQ ID NO: 21614

SEQ ID NO: 142280 - DNA, 601 bp, Human; identical to SEQ ID NO: 21615

SEQ ID NO: 142281 - DNA, 601 bp, Human; identical to SEQ ID NO: 21616

SEQ ID NO: 142282 - DNA, 601 bp, Human; identical to SEQ ID NO: 21617

SEQ ID NO: 142283 - DNA, 601 bp, Human; identical to SEQ ID NO: 21618

SEQ ID NO: 142284 - DNA, 601 bp, Human; identical to SEQ ID NO: 21619

SEQ ID NO: 142285 - DNA, 601 bp, Human; identical to SEQ ID NO: 21620

SEQ ID NO: 142286 - DNA, 601 bp, Human; identical to SEQ ID NO: 122099

SEQ ID NO: 142287 - DNA, 601 bp, Human; identical to SEQ ID NO: 122098

SEQ ID NO: 142288 - DNA, 601 bp, Human
gggcttcctttccacagggtcctatcggtggtgctaatagagatatttctattctccagtgccacggggattgtgaccctttggttcccctgatgtttggttctcttacggttgaaaaactaaaaaacattggtgaatccagccaatgtgacctttaaaacctatgaaggtatgatgcacagttcgtgtcaacaggaaatgatgaatgtcaagcaattcattgataaactcctacctccaattgattgacgtcactaagaggccttgtgtagaagtacaccagcatcattgtagtagagtrtaaaccttttcccatgcccagtcttcaaatttctaatgttttgcagtgttaaaatgttttgcaaatacatgccaataacacagatcaaataatgtctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggta

SEQ ID NO: 142289 - DNA, 601 bp, Human
gaccctttggttcccctgatgtttggttctcttacggttgaaaaactaaaaaacattggtgaatccagccaatgtgacctttaaaacctatgaaggtatgatgcacagttcgtgtcaacaggaaatgatgaatgtcaagcaattcattgataaactcctacctccaattgattgacgtcactaagaggccttgtgtagaagtacaccagcatcattgtagtagagtataaaccttttcccatgcccagtcttcaaatttctaatgttttgcagtgttaaaatgttttgcaaatacatgccwataacacagatcaaataatgtctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgctta

SEQ ID NO: 142290 - DNA, 601 bp, Human
gtttggttctcttacggttgaaaaactaaaaaacattggtgaatccagccaatgtgacctttaaaacctatgaaggtatgatgcacagttcgtgtcaacaggaaatgatgaatgtcaagcaattcattgataaactcctacctccaattgattgacgtcactaagaggccttgtgtagaagtacaccagcatcattgtagtagagtataaaccttttcccatgcccagtcttcaaatttctaatgttttgcagtgttaaaatgttttgcaaatacatgccaataacacagatcaaataatrtctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgta

SEQ ID NO: 142291 - DNA, 601 bp, Human; identical to SEQ ID NO: 35106

SEQ ID NO: 142292 - DNA, 601 bp, Human
atttctgggagttctgaaactactgttctcgtgggccttggcgactgatttgggaaagctgaccctgggttggcctggcttccagccaccgtcgcaacataaacaagccaattcaaaacagggtcgcagtctttgaaactagctgaggcaacagatcccctccacacttcgcgggccccacgatcgccccatcaaacaccattatccctcttcccatcacactcccgtccgcccgaggccggcggacctgcagcggcggcgggatggggttggatagaatgcggcccggtcccggcccagmggagctgggggagccgttcccttcggtcctgtgcccaccttggtactggggtccgcgtcggagcagcaactgagggcggcctcgtccgtgaggccgccggacgggggctgcggttctgccatggctgcactgcagtatcacagacgacgggacccaaggaacggaggagtcacccacactacgcctcggccctgtgccgccttaactaggaatggcgcgatggcgccgcgggcgggagaccgctgacttccagccaatcgctgcgcggagagcaagttgactctctgctgattgggtccc

SEQ ID NO: 142293 - DNA, 601 bp, Human
tagtcaaataaataaatacaaaggtgtttacagacactgatgacttcactggaataaacagcggttactgtgcctgaatttttttttttttttttttttagacagagtctcactctgtcgcccaggctggagtgcagtggcacgatctcagctcactgcaagctccgcctcccgggttcatgccattctcctgcctcagcctcccgagtagctgggactacaggcacccgccaccacgcccagctcatttttttgtatttttagtagagacggggtttcaccgtgttaggatggtctctayctcttgacctcgtgatccgcccgccttggcctcccaaagtgctgggattacaggcgtgagccaccgcgcccgccaactgtgtctgatcttaacaaggcaaccgaaacaccacacctgagtgagttacactgattcttactcagtaaagacatgttcggtaagtgaaagcctttgtatgcaacaggtcatttctcttactgggtcattactgtaaaacgagagggtaagagaaggaatttctaagattcctttcagatccaaactctatgattctgtaatctctcctgggccccacgaaga

SEQ ID NO: 142294 - DNA, 601 bp, Human
agatgtgtctgactctttgccctgaaggtaaagaacaagcagggaccagagtcatggaccacttatctaccccttttaaaggtctgcacgaagcacatattcaatcttcaaggaatttacaaatgatgtagtcaaataaataaatacaaaggtgtttacagacactgatgacttcactggaataaacagcggttactgtgcctgaatttttttttttttttttttttagacagagtctcactctgtcgcccaggctggagtgcagtggcacgatctcagctcactgcaagctccgcctccsgggttcatgccattctcctgcctcagcctcccgagtagctgggactacaggcacccgccaccacgcccagctcatttttttgtatttttagtagagacggggtttcaccgtgttaggatggtctctacctcttgacctcgtgatccgcccgccttggcctcccaaagtgctgggattacaggcgtgagccaccgcgcccgccaactgtgtctgatcttaacaaggcaaccgaaacaccacacctgagtgagttacactgattcttactcagtaaagacatgttcggtaagtgaaagcctt

SEQ ID NO: 142295 - DNA, 601 bp, Human
agcaatgagatgtgtctgactctttgccctgaaggtaaagaacaagcagggaccagagtcatggaccacttatctaccccttttaaaggtctgcacgaagcacatattcaatcttcaaggaatttacaaatgatgtagtcaaataaataaatacaaaggtgtttacagacactgatgacttcactggaataaacagcggttactgtgcctgaatttttttttttttttttttttagacagagtctcactctgtcgcccaggctggagtgcagtggcacgatctcagctcactgcaagctcygcctcccgggttcatgccattctcctgcctcagcctcccgagtagctgggactacaggcacccgccaccacgcccagctcatttttttgtatttttagtagagacggggtttcaccgtgttaggatggtctctacctcttgacctcgtgatccgcccgccttggcctcccaaagtgctgggattacaggcgtgagccaccgcgcccgccaactgtgtctgatcttaacaaggcaaccgaaacaccacacctgagtgagttacactgattcttactcagtaaagacatgttcggtaagtga

SEQ ID NO: 142296 - DNA, 601 bp, Human
taagccaagtaccaggtgctagtcaaaagttttagcaatgagatgtgtctgactctttgccctgaaggtaaagaacaagcagggaccagagtcatggaccacttatctaccccttttaaaggtctgcacgaagcacatattcaatcttcaaggaatttacaaatgatgtagtcaaataaataaatacaaaggtgtttacagacactgatgacttcactggaataaacagcggttactgtgcctgaatttttttttttttttttttttagacagagtctcactctgtcgcccaggctggagkgcagtggcacgatctcagctcactgcaagctccgcctcccgggttcatgccattctcctgcctcagcctcccgagtagctgggactacaggcacccgccaccacgcccagctcatttttttgtatttttagtagagacggggtttcaccgtgttaggatggtctctacctcttgacctcgtgatccgcccgccttggcctcccaaagtgctgggattacaggcgtgagccaccgcgcccgccaactgtgtctgatcttaacaaggcaaccgaaacaccacacctgagtgagttacactga

SEQ ID NO: 142297 - DNA, 601 bp, Human
agggtttttttttttttttttggacaaagtctcactctgtcacccaagctggaatgcagtggcatgatctcggctccctgcaacctccacctcatgggttcaagtgattttcctgcctcagcctcccaagtagctgggattacaggtgcccgccaccatgcccagctaatttttgtatttttagtagagcagagttttgccatgttggccaggctggtctcgaactgctaacctcaggtgatctgcccacctcgctctcccaaagtgctgggattacaggcatgagccactgcacccagcsttcattgaggttttttattttcctttatggcaaattccaaaattactgctggagtcagcaccccagaagcagaacagggtggaggttggaagtgtggggtcctccctgggcaaatcactcaacacctctatgtgcctgagtgtccttatttgtaaaatgaagatcataattatgccttcttcatagggttgttgttaggattaaattaaacaatgtacttaaaataccaagccagggcctggcacactcaatatataccagctattattatgtattccattttatgtctccacgtggtat

SEQ ID NO: 142298 - DNA, 601 bp, Human
cagaagtggggattcaaatgcaggtcttcaggctccaaataccctgtgcataccccattccactaatgctacctttaaaaacctctacctcccagggtgctctcagggtgatttatatttcaatagcacactaaccccaggtccattgtatattagagttgatataagttggtgaagggagggaacctcatcttgtttatcccagtatccccaaagtacttaccatcttctttacatatagcataaatgtatcaagtgatcaaactgaatttaattcattgagggtttttttttttttttttggacaaagtctcactctgtcacccaagctggaatgcagtggcatgatctcggctccctgcaacctccacctcatgggttcaagtgattttcctgcctcagcctcccaagtagctgggattacaggtgcccgccaccatgcccagctaatttttgtatttttagtagagcagagttttgccatgttggccaggctggtctcgaactgctaacctcaggtgatctgcccacctcgctctcccaaagtgctgggattacaggcatgagccactgcacccagcgttcattgaggttttttatt

SEQ ID NO: 142299 - DNA, 601 bp, Human
agttctgcttttgccctttgccttgtgatctttgttagacccttattagtagttctgctttttgccctttgaagcatgtgatctttgtacctactccctgttcttacaccccctccccttttgaaacccttaataaaaacttgctggtctaagactcaggtgggcatcacggtcctactgatatgtgatgtcaccccccggcagcccagctgtaaaattcctctctttgtactctttatttctcagctggccaatacttatggaaaatagaaagaacctacgttgaaatattggggtgggytccccccgtatcaaaacacatttttgctaagatgtttccttcatcagaatgccttcccatgtactctgctggaatcctacccaatctatcaaggcataggcccatcaccaccatctttttgatgtgtgccctgatccccacagctgaaatacaaccttgaattgtatcactcttcatagtttagagaacataatacatgtcattttatcctcatagcagctctctgagatatctttatgctccttctacaaactgagcccaagtgccctggcaaggtcactgcagccaacaacagaagtg

SEQ ID NO: 142300 - DNA, 601 bp, Human
actgcctgaggggtcggacaaaaagagccatatttttcttcttgcagagagcctataaacggacgtgcaagtaggagagatattgctaaattattttcctagcaaggaatattaatattaataccctgggaaaggaacgcattcctggggggaggtctataaacgcccgctctgggaatgtctgtcttatgaggttgagataaggactgagatacgccctcgtctcctgcagtaccctcaggcttactagggtggggaaaaaacttcaccctagtaaatttgtggtcagaccgcttctctrctctcgaaccctgttttctgttgtttaagatgtttatcaagacaatacgtgcactgctgaacatagacccttatcagtagttctgcttttgccctttgccttgtgatctttgttggacccttatcagtagttctgcttttgccctttgccttgtgatctttgttagacccttattagtagttctgctttttgccctttgaagcatgtgatctttgtacctactccctgttcttacaccccctccccttttgaaacccttaataaaaacttgctggtctaagactcaggtgggcatcacgg

SEQ ID NO: 142301 - DNA, 601 bp, Human
ttagcctcttccaccactgcttagataacctgaactgcaaccaataacatttaactaactctccagtacctgccctgcattgcaattctaccatcctaaaactgttgtgggaagtcagggaccccgaatggagggaccagctggagctgtggcagaggaacataaattgtgaagatttcattttaatatggacatttatcagttcccaaataatacttttataatttcttatgcctgtctttaatctcttaatcctgttatcttcgtaagctgaggatgtacatcacctcaggaccactgmgataattgtgttaactgtacaaattgattgtaaaactgtgtttgaacaatatgaaatcggcgcaccttgaaaaacaacagaaaaacagcgattttagggaacaagggaagacaaccataaggtctgactgcctgaggggtcggacaaaaagagccatatttttcttcttgcagagagcctataaacggacgtgcaagtaggagagatattgctaaattattttcctagcaaggaatattaatattaataccctgggaaaggaacgcattcctggggggaggtctataaacgcccgctctg

SEQ ID NO: 142302 - DNA, 601 bp, Human
catgttagcctcttccaccactgcttagataacctgaactgcaaccaataacatttaactaactctccagtacctgccctgcattgcaattctaccatcctaaaactgttgtgggaagtcagggaccccgaatggagggaccagctggagctgtggcagaggaacataaattgtgaagatttcattttaatatggacatttatcagttcccaaataatacttttataatttcttatgcctgtctttaatctcttaatcctgttatcttcgtaagctgaggatgtacatcacctcaggaccrctgcgataattgtgttaactgtacaaattgattgtaaaactgtgtttgaacaatatgaaatcggcgcaccttgaaaaacaacagaaaaacagcgattttagggaacaagggaagacaaccataaggtctgactgcctgaggggtcggacaaaaagagccatatttttcttcttgcagagagcctataaacggacgtgcaagtaggagagatattgctaaattattttcctagcaaggaatattaatattaataccctgggaaaggaacgcattcctggggggaggtctataaacgcccgc

SEQ ID NO: 142303 - DNA, 601 bp, Human
gttggctgggcttggtggctcatgcttgtaatcccagcactttgggaggccgaggtggctggattgcttgagccccagagttcaagaccagcctaggcaagatagtgagaccccatttctacaaaaaatagaaaaattagctgggtgtggtagtgtacacatgtagccccagctccttgggaggctgaggtaggaggagcccttgaacccgggaagcagagattgtagtgagctgagacggcaccactgcactccagcctgggtgacaggagtgacaccctatctcaaaaaaaaaaagagyagtgttgaggtctccaactataattttagatttttctatttctcctttcagttatatcagttttgcttcatgtgttccctagctctgctgtttagtaacatatatttatgattactgtgtcatcttggtcaatcacaactcttttatcactgtataatgtacttcttatgtctggtaattttctttgccccaaagtctactttatctgatatcaagatagccactcctgctttcttttgatgaatatctgcatgaattatcttttctacccttttacttttaccttgtctctatcatatt

SEQ ID NO: 142304 - DNA, 601 bp, Human
tgtagacaatcatgtcatcttcaaataaggacagtttgatttcttcctttccaacctatatgtctcttatttccttttcttgctttactgcactgtctagaactttcagcactttgtcaaataagagtggtaacagcagacatccttgtcttattaccaaaattagggagaaagcatcaccactgagtgtaatattagctctaacttttcaagagaagctctttatcaagttaaagaaatgcccccattcctatttttttctgaacttaaaaaaaataatgaatgagtgttgaattttgtyaaatgccttttctgtaccaactgatatgatcatgtgattcttctttaccctcttaatatggtggattatactgactgatttttgtatactgaaccaggcttgcatcctagatataaacctcacttggttaaggtgtataattctttctatatatactgttgaattctgtttactaacattttgtcaagggtttttacatttatattcattggagatattggtctgtagttttcttgtactgtcttcatttgtttttggtatcagggtaatattagctttatcaaatgaattgggaagtgt

SEQ ID NO: 142305 - DNA, 601 bp, Human
ctctctgccaataccacagagtagtgattactgtagctatgtaagtcttaaaatcaggtagaaaaattcttcccactttattcttttccaaaatggtttgttattctagtttttttgcctttcaatctagaataaccctgtctctgtctaaaaaagtttgataaggagtgtgttaaacatgtatattgatttggggagaattgatatccttactgtgctgagtcttccaatcatgaacacaataaatctctccatttatttagatctatgactttttgcatcgccattgctgttttcagcrtatgtgtcctgtaaatgtttattagatttatatctaagtatttcattttattgggcaattgtaaatggtaatgtattttttaatttttggtgcctgtgtgttctttgctagtatatagaaacgcgattgatttctgtatgtttattttgtaccctgcaaccttgctgaactcatttatgaattctgggagttttctgtaaattacttattattccctatgtagacaatcatgtcatcttcaaataaggacagtttgatttcttcctttccaacctatatgtctcttatttccttttcttg

SEQ ID NO: 142306 - DNA, 601 bp, Human
tatcctccctctggtgaactgctttttcatctttgtcaaaaagctgttgggcatactagtgtgggtatattttggggttctctattttgtttcaatgttctatctctctgccaataccacagagtagtgattactgtagctatgtaagtcttaaaatcaggtagaaaaattcttcccactttattcttttccaaaatggtttgttattctagtttttttgcctttcaatctagaataaccctgtctctgtctaaaaaagtttgataaggagtgtgttaaacatgtatattgatttggggakaattgatatccttactgtgctgagtcttccaatcatgaacacaataaatctctccatttatttagatctatgactttttgcatcgccattgctgttttcagcatatgtgtcctgtaaatgtttattagatttatatctaagtatttcattttattgggcaattgtaaatggtaatgtattttttaatttttggtgcctgtgtgttctttgctagtatatagaaacgcgattgatttctgtatgtttattttgtaccctgcaaccttgctgaactcatttatgaattctgggagttttctg

SEQ ID NO: 142307 - DNA, 601 bp, Human
aaatggatataaaaacaagaagggcttatttttaagaaaatgatcaagttattctatgctcagataacagttttatttttatcaccaaaatagtctgttaactccatgtgcctcttgtgaacacttgcatgatcttgagaaaaagttcctgttttaaaaagttaagttcctaaaaattattgctttattggtatggttctaaaatatcgtttaaaatacatgtatctcctgttttaaaaagtaagacttatgctatgctcatgtcttgtctcacctgatagtccttaattttgtctttccyttatcatgctttaaatttagaacaataaaaataaggtgtcttttatgcctaaactatctttggttttacagggatggctactgggtgacaaagatttgctcctgtgccttatcaaaaggtggacaatagaaataataaggtttttttcggggggaggggaagtgtcattctccaaatttaattaagaaaactactgtaagaaaactttttttttttttaagatggagtctcgctctgtcacccaggctggagtgcagtggcgcaatcttggctcactgcaagctccgcctcccgagcttc

SEQ ID NO: 142308 - DNA, 601 bp, Human
ttaaaattcactttaaaaagtctatacgtggcaaaaaaagtaagatatattcaatgttagtgaatttattgataaaatagaggcttataaatcctttgctacaaattgttaaatggatataaaaacaagaagggcttatttttaagaaaatgatcaagttattctatgctcagataacagttttatttttatcaccaaaatagtctgttaactccatgtgcctcttgtgaacacttgcatgatcttgagaaaaagttcctgttttaaaaagttaagttcctaaaaattattgctttattggtatggttctaaaatatcgtttaaaatacatgtatctcctgttttaaaaagtaagacttatgctatgctcatgtcttgtctcacctgatagtccttaattttgtctttcccttatcatgctttaaatttagaacaataaaaataaggtgtcttttatgcctaaactatctttggttttacagggatggctactgggtgacaaagatttgctcctgtgccttatcaaaaggtggacaatagaaataataaggtttttttcggggggaggggaagtgtcattctccaaatttaattaagaaaa

SEQ ID NO: 142309 - DNA, 601 bp, Human
aaatgctgcgtcgaggtatattaaatggcatggagatatatacagatggtatactaagtctaatggcatgggaatatataaaatggtatattagcttttaaaaacattatatatatatacacacacacatgcatatgaaaacaaataccacttaatatgctattgagattaattatatcttaaaattaatgttacagactttaactttattattaagagaactatgtactgtatctgcctaaacacatacacataaagaatattaaaattcactttaaaaagtctatacgtggcaaaaaaagtaagatatattcaatgttagtgaatttattgataaaatagaggcttataaatcctttgctacaaattgttaaatggatataaaaacaagaagggcttatttttaagaaaatgatcaagttattctatgctcagataacagttttatttttatcaccaaaatagtctgttaactccatgtgcctcttgtgaacacttgcatgatcttgagaaaaagttcctgttttaaaaagttaagttcctaaaaattattgctttattggtatggttctaaaatatcgtttaaaatacatgtatctcc

SEQ ID NO: 142310 - DNA, 601 bp, Human
ctgtttatgttttgtttcttcaacatctttctagtaccaacattagtattggtactttaccaacgactttatcattacttctgttcacactatacaggctatactcaaatccatatatcttaggcacagcatgtattttttgttgtagatgccatgccaagtacttgccaaagttagacaaccttaactattctatcccatagtctatcatatccttatcttacaatctttctggaaaacaactggaatatcaagagtcctcaagaattcatattcttggccaggtgcagtggctcacgcytgtaatcccagcactttggggggctgagacgggcggatcacgaggtcaggagctcgagaaacagactgatcaacatggtgaaaccccgtctctactaaaaatacaaaaaatcagccagtagtggtggtgcacgaattaatattcttttctttttttttgagatagagtctccctctgtttccaggctagagtgcagcagtgagatcttggctcactgcaacccgcctcccgggttcaagcgattctcctgcctcagcctcccgagtagctgggactacaggcgcccgccacccagcccgg

SEQ ID NO: 142311 - DNA, 601 bp, Human
aagtagaagaggagtgtggcataaagggaagtgggacagattccaagtgtgagaaggggccaacctgcaggtgctggctctgagacatggggcacatgtgccaggagttaaaggcagctgccctctgctcccaccccaccatacccatccacgcctgacagccagcaaggaagctgggacccctgtccgacagtggaaagaaactgaattcagggaacaatctaaatggatttagatgcagattcttccccagagcctctgagtaaggaacacagtcctgtcaatacagtgggacagaccyaagtcggacctctagcctatggaattatgagataatatatttccaaccaagctgcacccaacattatttgttgctcagtttttttaaaaaaggataaaatctaaaaactatcttttaaaatctgctttgtagtgaccctgtttatgttttgtttcttcaacatctttctagtaccaacattagtattggtactttaccaacgactttatcattacttctgttcacactatacaggctatactcaaatccatatatcttaggcacagcatgtattttttgttgtagatgccatgccaagta

SEQ ID NO: 142312 - DNA, 601 bp, Human; identical to SEQ ID NO: 35107

SEQ ID NO: 142313 - DNA, 601 bp, Human; identical to SEQ ID NO: 35108

SEQ ID NO: 142314 - DNA, 601 bp, Human; identical to SEQ ID NO: 35109

SEQ ID NO: 142315 - DNA, 601 bp, Human; identical to SEQ ID NO: 35110

SEQ ID NO: 142316 - DNA, 601 bp, Human; identical to SEQ ID NO: 35111

SEQ ID NO: 142317 - DNA, 601 bp, Human; identical to SEQ ID NO: 35112

SEQ ID NO: 142318 - DNA, 601 bp, Human; identical to SEQ ID NO: 35113

SEQ ID NO: 142319 - DNA, 601 bp, Human; identical to SEQ ID NO: 35114

SEQ ID NO: 142320 - DNA, 601 bp, Human; identical to SEQ ID NO: 35115

SEQ ID NO: 142321 - DNA, 601 bp, Human; identical to SEQ ID NO: 35116

SEQ ID NO: 142322 - DNA, 601 bp, Human; identical to SEQ ID NO: 32709

SEQ ID NO: 142323 - DNA, 601 bp, Human; identical to SEQ ID NO: 32710

SEQ ID NO: 142324 - DNA, 601 bp, Human; identical to SEQ ID NO: 32711

SEQ ID NO: 142325 - DNA, 601 bp, Human; identical to SEQ ID NO: 32712

SEQ ID NO: 142326 - DNA, 601 bp, Human; identical to SEQ ID NO: 32713

SEQ ID NO: 142327 - DNA, 601 bp, Human; identical to SEQ ID NO: 32714

SEQ ID NO: 142328 - DNA, 601 bp, Human; identical to SEQ ID NO: 32715

SEQ ID NO: 142329 - DNA, 601 bp, Human; identical to SEQ ID NO: 32716

SEQ ID NO: 142330 - DNA, 601 bp, Human; identical to SEQ ID NO: 32717

SEQ ID NO: 142331 - DNA, 601 bp, Human; identical to SEQ ID NO: 32718

SEQ ID NO: 142332 - DNA, 601 bp, Human; identical to SEQ ID NO: 32719

SEQ ID NO: 142333 - DNA, 601 bp, Human; identical to SEQ ID NO: 32720

SEQ ID NO: 142334 - DNA, 601 bp, Human; identical to SEQ ID NO: 32721

SEQ ID NO: 142335 - DNA, 601 bp, Human; identical to SEQ ID NO: 32722

SEQ ID NO: 142336 - DNA, 601 bp, Human; identical to SEQ ID NO: 32723

SEQ ID NO: 142337 - DNA, 601 bp, Human; identical to SEQ ID NO: 32724

SEQ ID NO: 142338 - DNA, 601 bp, Human; identical to SEQ ID NO: 32725

SEQ ID NO: 142339 - DNA, 601 bp, Human; identical to SEQ ID NO: 32726

SEQ ID NO: 142340 - DNA, 601 bp, Human; identical to SEQ ID NO: 32727

SEQ ID NO: 142341 - DNA, 601 bp, Human; identical to SEQ ID NO: 32728

SEQ ID NO: 142342 - DNA, 601 bp, Human; identical to SEQ ID NO: 32729

SEQ ID NO: 142343 - DNA, 601 bp, Human; identical to SEQ ID NO: 32730

SEQ ID NO: 142344 - DNA, 601 bp, Human; identical to SEQ ID NO: 32731

SEQ ID NO: 142345 - DNA, 601 bp, Human; identical to SEQ ID NO: 32732

SEQ ID NO: 142346 - DNA, 601 bp, Human; identical to SEQ ID NO: 32733

SEQ ID NO: 142347 - DNA, 601 bp, Human; identical to SEQ ID NO: 32734

SEQ ID NO: 142348 - DNA, 601 bp, Human; identical to SEQ ID NO: 32735

SEQ ID NO: 142349 - DNA, 601 bp, Human; identical to SEQ ID NO: 32736

SEQ ID NO: 142350 - DNA, 601 bp, Human
gggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgagtgcgaggacgactacaactactactacacccgcagctagcatccccactcctcctccagcccacccaaccgccttggktcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgtagagcctgcatctgtctgtccttccttccattgctcccagtgccaaacttgggccgctgcaccg

SEQ ID NO: 142351 - DNA, 601 bp, Human
atgagaaggataattgttttgagataattatccttggctacaaagatcaataaaaaaagtgatgccagtccagagtcatacaggcagttgctgggtagatgtccttgtagaagtatttttttgtgtacagttgggatggcctttatgcaaagttgtggtttttgcagagtcttttgtgatagtttttgttattaggcatccaagtgtgagaaccctctttttatagccttcctcagctctttttgtgtgagttttttaacactagtgactccattttgattttgacaacttccatacttcttttttttttttcctgcctcaggtttatttgtacaaatagcacaggaggaccccagccccatgcagatggtagcccaggggcgggggtggggggtcgcaccagtccttctgtcctcacattggcagagatatctactctgaagcctttgtaggggcctgggcacctttgggagcctgagctggaactgaagctggagctgcagcctgggccttggtttgatccttggccttggcctttggccggcacagcctgagccctttggcaatatgggcacaagcacgcttcccaagcttggggtgg

SEQ ID NO: 142352 - DNA, 601 bp, Human
ggcaaaagtgtggaagaaatgttttctatgaaggagataacagccaatttaactccctttttaataaaagaaaatattacactgacaggcacatggttgatttgtatattaattgttggaagcacggcctattccttaacatgctcaggcactgaatatcctacagtttgtagtcagttcacttatgtctgaacaagttgttcacgtgcagattctagaaagtttatttttgagcacaaactaacacttagctcgctagaacaatgttgtttcacatgcagttactgggtcagggttaggmacgaaaatcatgccgtatatttacaaatgaggatgctcctctcccggggccctcacttgggggagccccgtcccagcgtctagctcatcaaattcccgaaagcaattacaaaggcatctcttctccaccccaaaacaaaataatgatctaccaatcttgcgaacacattaagacaaactccctacaggaaggagcatgacttaaacaagttcaagatactttgtcagtcttaacctcaggtatcttggctgaagggattaaatcattagactttacgtacccaacctcttcctagcaata

SEQ ID NO: 142353 - DNA, 601 bp, Human
ctccttcactgaactcctcataacctgcaactgtttgttggtgaattttgtcttccttgctaaattcaaggatcatttgttcaacagccttctaaccaccataatgctgaatacacagaaggtacacatttcttattctaagcctcaatattttcaattcttacatcaatacgaggcccgagtttttaaaaataactcttccaaatgattgtttctcatgcattgggaggcaaagatgttagaatttttttagagaaaatgccagtgtaaataaactgtgtaaaaatatttcacacaagcytatcaatattacataaatgcatgctcctgagcacaattgcctagtctaataataacgtttcctcctacttagcaagatgtaaaggtaacagccatataggatgggagaaaagctatctagctatgtgaatgaagcatctctttcaaaggggacaagcttaataccaaattgacgtctgagcccttatttaattgcagatatttaatgtggacccttagagttaagtgacacctacaagatcactttttgatttggaaaagttcatgaaaggatggtcacgaaagaggccatgttcaccac

SEQ ID NO: 142354 - DNA, 601 bp, Human
gaactcctgagctcaagcgatctgcccgccttggtctcccaaagtgctgggattacaggcatgagccaccgcacctggactgtacgcaaattttagaatagattttttaaaatccctctgcctattcaaggatttgtaattttttcctctcaccagcaagctttatgggagggtctattaaattggctacctttcttcccaaactgcttatctcacaatcacttctaatctgatgtagccccaactcttgcaccaacaactgaaattcctcttctggggttggtcagtgactatttgtaaycaaaccaacagctttttataaaatgtcttcatcagtctttgaatcccttacctctccatccctctcagcaggtgtgacattgctcagctgtgcttttccatctgtctgctttgctggctcttcctcctcccatgctttacaggtcgtctcacccctttgtggtttttctgagctctcctcactcccaaaccttcagctattattcctttatggagtgaatcccagagtcctgacctctatttttctcttttagtcctatacttccagttgccttttgaacatttccacttacagatctct

SEQ ID NO: 142355 - DNA, 601 bp, Human
agttatttccaagttctagaaagccatatctcaagggattagaacagagaccattaaggaggaagagagaacttgaattggcagggaatgtgctatataatggcacttccgtctataatcaacttcagaatgcatactccacaggaaataagagatactatggctcttcaagcaagcaatggtgtgttaaaattaaaaaaaaaaagaaatactgtggggaaaaaagaatgaaggagaataaagatattagagtcaaatataaattccgtattatacctaggctctgggatcaacaccacckccaggctttcctaattcatgtgagcatgggttagcattaaaaaggcactattttactttgaggtgattacattgctttactcaaagaacttggtggaatggctaaagttttaaaaacaaacaaaactaacgatactaagtattagtgaggatgcagggcaaccagaactcacatacactgtttgtaagaatgtaaaaccgtagagttgctctggaaaagcttggccatttcttataaagttaaacatacagttacatgaatcagcaatcccactcctaggtatttacccagaatagatga

SEQ ID NO: 142356 - DNA, 601 bp, Human
attcagtttgacaatataagatgttccaataaggaattaatcaggataataaacaaagtatatgaacaatatgtctagctttctaacaacaaaacaagttatttccaagttctagaaagccatatctcaagggattagaacagagaccattaaggaggaagagagaacttgaattggcagggaatgtgctatataatggcacttccgtctataatcaacttcagaatgcatactccacaggaaataagagatactatggctcttcaagcaagcaatggtgtgttaaaattaaaaaaaaaaagaaatactgtggggaaaaaagaatgaaggagaataaagatattagagtcaaatataaattccgtattatacctaggctctgggatcaacaccacctccaggctttcctaattcatgtgagcatgggttagcattaaaaaggcactattttactttgaggtgattacattgctttactcaaagaacttggtggaatggctaaagttttaaaaacaaacaaaactaacgatactaagtattagtgaggatgcagggcaaccagaactcacatacactgtttgtaagaatgtaaaaccgtaga

SEQ ID NO: 142357 - DNA, 601 bp, Human
tgcccaagatcccacaggtaccaagtggtggagctgagattggaacccaggcagccagactccagagaccttgcacaaaatagtaggttagaattacccctaaacaattagtgttagttttgagcttcagacctcacagcctcacacatgctcagtttccatataatcttaaagagaaatcaaagatactcttatttaggaatcagtcccatccaatatccactactgacctcttcatttttgccttggacttcatagttagacatatgctagctgcaaagaggagaaaaggataggaaaycatgctgccaaaggtaagccctcccagaaaaagcttcaaatcacaaaagatggcaccacaaaacctcaggagcaggcacgaatgcaactcagaagtgcctgtaagctgggtgtggtggctcatgcctataattccagcactttcagaggctgaggcaggaggattgcttgtgtccaggagtttgaaacccgcctgggcaacatagagaaatctcatctctacaaaaaataaacaaaattagccaggctgatggcatgcacccgtagtctcaggtactcggtaggctgaggtaggagaata

SEQ ID NO: 142358 - DNA, 601 bp, Human
cacgcctgtaatcccagcactttgggaggccgaggcaggaggatcacttgagttcgaaaccagcctgagcaacatggtgacaccctgtctctacaaaaagagacaaaaaaaaaaattagctggtgctaggaatagtggcgtgtacctgtagtcccagctacctcagggggctgagatgggaggatcgttggagcccagatgtcaaagctgcagtgagccatgatggtgccacttaactctagtttgggtgacagagcaccagagcaagattttgtctcaaaaaaaaaaaaaaaaaaaaaaagccaagaagggcttttatgggtgtttagcgtgatcacataacacaatctaagggtctcacaggccagtgtacagcaacctcctggaacatttgacaggtaaaaaccatcatcccaagtgctttaatgatgcctttgatcccagtgccagcctatgacagtgtgatcacacagctacaatgaggcctgaatcatcattacattctgatgccttcactatggagagcttactattataaataaaaaacggcttaaggaagaaacttagcatgccagggtgtgcccatcgtttcacagtaatg

SEQ ID NO: 142359 - DNA, 601 bp, Human
acatccaaggaaaagtaccacaaatcaagaatgtttccaaaaataccccatgagaacaattcaacaaatctacattaattttaaaagttaccaacttttcagaggcaaaatgatttgctgctaaaaatttaaagtcctgagttttcatccagagcaacacactctggttcaatgatgtaattcacaggcaaataaaagaatcacattaagtcaccctccagtcatagcatcatttgatttctgaggtcatttggttctcagacaggagccaggtctgatagtaaataaaaatcaactacartagtaagattctacttattagaacttccctgtgtactgtctcataaaaatgaagtaatatgcttttggatttaatgtagacagtttcaattatatttaagaaaagcaaagtaagattaattcgagaaacaggaaaaagaaaacgagtcctcagacactggattctatttaacactcttcactttatcattgcttaaatatttgctttctactttgtcatgctacctctctgcatcacagaagaaaatttgatacctcagtgacagaataatttaagagcaagctaaaaattaatcagcac

SEQ ID NO: 142360 - DNA, 601 bp, Human
taataataataatcagaacagtgcaacaacatttaagtggaaaaggtaaaatgaaattgtctacacatccaggtttctgtgttctcatgcagtacagaggctgtctgctccttgatgttctcttaataaccacattcatttcaggacccaaccatatccaacgtcaggaagcagtaaggacgaacgaaccagagaagacacaaattcagaacgtaacaatgctacagaccagaactgtgttgtccaataaggtggtcacatgtggctatttaactaaaattttgtttctcagttgcactarctatatttcaagctctgcagctgtggctattgtattggacagtgcatatacagaacatttccatcattttccatggaacaaagctggactacaaagtgaatattcctattgttaagatggacccaatgaaaaattcagtcaaagtcaatagtgttattcattgagcataattagagatatccacggttatctggttattttattgaatgtgtcatagagacaattggtgatccacagaaagtttggacatccttatcagcacaggatttttttctcccagtattcctccaatacctaccc

SEQ ID NO: 142361 - DNA, 601 bp, Human
cactggagcacgcatgacccatctatagcatatggtgacagctgctacttagctccagctgatgactgctttgaagaaagaggacaagggtggctgtgtcttccaatttttcaagggaagctgaaatctagattatgaaaaaatcagttcctaaatgttgactcataaacacctgcaggggacaaataaacttagctacagactaaatatggctccaagactcctagtcaagacctctgtttcatgagaagtttatttctaatgggcagatatttccattggaaagatgtcatagtggcasgctatggaggatgggttggaaagaggaaagactgaaagcaggaagaccatgatccacctagagagttatgagtctttcgtcttttgagggagatgataattttgataaaatcaagtaaaagtcatttagagtcaagtctcatgagcaaatttagtattagatctggacatcaatcaggttttatataaaaacaacacaggagtataaagtcaatcagatgactgctttaggcagttcacagaatgggtcaggaggccattacaaagcagaagttgtaaaatgtattgtgtaatagtcatg

SEQ ID NO: 142362 - DNA, 601 bp, Human
tgacctcaagatttcctcctcaaaataaggatctttgataccactgttctaaaatacatttttgcctccctagctgttaaattttacggctaaaaccttttgcctagccctaaaatgccacacataaggacactgggaaaagacaatggtgcaagccttacagaacaaaagagaaaaagaaacaaggagatatatgagaatgattctatagaggcattcatatttcttattctaagacttctcttggaaaacaaaaagattcatgacttagaaaaggacattacagttgctagatcatcasttatctgataggaatataaatggtaaacactagattatatttcgtttggaaaccttaactggaggaaattctacctttacagtggaaaagccaaaagaagagaagtcactgcaggctccagaaatacacattttaacaaagtgggggcgggggagtacagtttctcagaaccactgtgtcccgatctcaaggagaagttgtatttctttacaatttaatctatgattagctaacaaaagggacagaaagcattattaaccttaatattcacaaagtggtcaattaatagcaccttgtaac

SEQ ID NO: 142363 - DNA, 601 bp, Human
caaaccattgctgggcagatagcctgaaaaacaggacctgcattttacagttggcataaatgtcaaataatgctctggtaaacattcaaacaatgccttatgtccatctgtgacacactttgggcctcggcatctgggtctggggtataatggggtatgacttatcttctcaaattggcaaatctagaacataaacttaatataacatatggaaggtgcaacataaagtgggcttttcctaaatgtctagatgatctgagaattaagatggagtctctcagtaaaatcaccttcattgctsttaagtttctgctaaatgaaaaacatagtcaaggtgcctggagccacctggagaatttctgtaacaacgaattaaagttgctcttggagacacacagatgttaatggaaatggacattcaattcaaacccagactataatcttttaataaataatatctaagagttatcagctgggaggctctaagtaaacacttaattgtgtttggttcctatgattggaggagtcagctcttttagctccatcaattatagctctggaaacaggcacacaatttttcagccttttagttttatatagc

SEQ ID NO: 142364 - DNA, 601 bp, Human
tagtgaacgtggtgaaactttcctagtatcctgttttcccactatgtaaactgatatccctgataagggctggttctgaatttctatagttctaaatcggggctcagaggcgacaactggtttgtaagggggtaacttctcttaaagttgcatttttacttagatcttaagctacattatttgggaagtttttaaaaggggctaatagagattccaactctcttccctcctgcccaactccaagacacctcttggtcatgcactcagctggtgaccttgaaagcaatcctattaggagtayggaggtggctcgagcctccatactgttgttccaataatggttttagaatgacaggttctgctgaatcttcgtattttaatatctttttactactttattaggcctgcaactttaatttagaatgaatctagtcccccaaaccatatatattcaagatcaaaactgttaggataatttttctgggtctatactcctgaacttcattcccactccacactggacctgggattgtaaattctttggaatctagaaagattatatgagaatttccttactaacaaaccattgctgggcagatag

SEQ ID NO: 142365 - DNA, 601 bp, Human
gcaaactctgacctgtaccactgactactagtgaacgtggtgaaactttcctagtatcctgttttcccactatgtaaactgatatccctgataagggctggttctgaatttctatagttctaaatcggggctcagaggcgacaactggtttgtaagggggtaacttctcttaaagttgcatttttacttagatcttaagctacattatttgggaagtttttaaaaggggctaatagagattccaactctcttccctcctgcccaactccaagacacctcttggtcatgcactcagctggtraccttgaaagcaatcctattaggagtatggaggtggctcgagcctccatactgttgttccaataatggttttagaatgacaggttctgctgaatcttcgtattttaatatctttttactactttattaggcctgcaactttaatttagaatgaatctagtcccccaaaccatatatattcaagatcaaaactgttaggataatttttctgggtctatactcctgaacttcattcccactccacactggacctgggattgtaaattctttggaatctagaaagattatatgagaatttcct

SEQ ID NO: 142366 - DNA, 601 bp, Human
gatccgctggcatatatatgttcaattatagccgcaaataacatttaatttggtgctttctccatcgtaagtgttcacagcacttacttctgagtgactagagaacaaatcaagactagcacagagaaacaagaagtattgaaagaaaagatggctaaccaaacttagaataagaagtcttggtgctgaaaataagtatgtgaaaataagcctgcaaaaataagcctggatacatttggcatccccagtgtaagcatccataatctcaaccactggcagaaacctgtccattagcataggrcattgccatcaagcaactcacatacatgcacacgagcgcacatgcacaccccacatcagaaggaaaaaaaaacccttgcaaaaaaaaaaaaatccttttgaattggcttttaaaatggcagatgatcactgctactgttccctgattaaggcagatcagagttttccattaatcccaaggaataacaggtacactcccttaatcatatttaaaataacaagtgaggtgatctgacattatggcaatttatttccttcatctaacacaacaaaattacagggtactgcatgagcaatctac

SEQ ID NO: 142367 - DNA, 601 bp, Human
gcatgattatagctcactgcagcctcaatctcccagactcaagcaatcctttcacctcagccttctgagttagctgggaatacatacatgcaccaccatgctgggctattttttaattttgcagagatggagtatcacgatgttgcccacgctggtgttgaactcctgggctcaagaggtcctcctgcctctgcttcccaaagcattggattacaggcgtgagctatggtgccctgcctggaagctaatttaaaacatcctcaatattcatagcaaatattagatgttaagattgaggtayatgctgggcgtggtggctcatgcctgtaatcccagctctttgggaggccgaggcaggtggatcacctgaggtcaggagttcgagaccagcctgagtaatatggtgaaaccctgtctctactaagaatacaaaaattagctaggtgtggtggcgtgtgcctgtagtccctgccactcgggaggctgagacaggagaattgcttgaacacaggaggtggaggttgcagtgagccaagatcgtgccactgtacttccagcctgggcaaaagagtgacatacagtagacaaaatggggtgagca

SEQ ID NO: 142368 - DNA, 601 bp, Human
ttccaatttaaaatttcagagctactcctagtacattaaaacctaacttgcccaatttgcctgttagaaagttggttttcaggctgggtgcagtggtgaacgcctgtaatgccagcactttgggaggctgaggtgggtgaatcgcttcagctcaggagtttgagaccagcctgggcaacatggtgaaactccatctttgcaaagacacgaaaattagcggggcatggtggcgcatgcctgtactctcagctacatgggaggctgaggtgggaggatcgcttgagcctggggaagtggaggytgcagtaagccaagatcacacgactgctctccaacctgggcaacagagtgagacactgtctcaaaaaaaaaagaaagaaaagaaaatttggttttcatcagagaccacagtaacaaagatttgtcacatcattatgagtcctgaagcatcgctgtgattctcagaagagatcttcatcagcatcaggataaagaaattaatttttttatcaaatgttaacttaacagagatcaagcattctgaatttggacaccaatactttttgtgagcctaactgtcccaagctttgtgttgatatac

SEQ ID NO: 142369 - DNA, 601 bp, Human
gactggctccagggtccaagttttaactcctacaccgtatggcctccaagacaccacaacacactgcaagctccctcaattctacaaattctttgacacacattccaatttaaaatttcagagctactcctagtacattaaaacctaacttgcccaatttgcctgttagaaagttggttttcaggctgggtgcagtggtgaacgcctgtaatgccagcactttgggaggctgaggtgggtgaatcgcttcagctcaggagtttgagaccagcctgggcaacatggtgaaactccatctttrcaaagacacgaaaattagcggggcatggtggcgcatgcctgtactctcagctacatgggaggctgaggtgggaggatcgcttgagcctggggaagtggaggctgcagtaagccaagatcacacgactgctctccaacctgggcaacagagtgagacactgtctcaaaaaaaaaagaaagaaaagaaaatttggttttcatcagagaccacagtaacaaagatttgtcacatcattatgagtcctgaagcatcgctgtgattctcagaagagatcttcatcagcatcaggataaagaaatt

SEQ ID NO: 142370 - DNA, 601 bp, Human
gtagtagtatttgccactagattccaaaccaagaactagaaaatgctgagatgcctttttgtgcatttttcaccaacagccaagttagatttatagattttttatgtagcaggggtccaattttgactttaaaattaaatacaccagggcttgtcaaggaatctaccaaaagccattttaaaagtgtaattcatccatttgcaacaatagatccagctcatggcttttgtaccaaggagcagcaaatgaagaatctcttaggaagtgctctgtgtgtgcacacacaaacgcatacacatgstacataatttcctaaagtggtatacacacatagacatcccacacagaattattccctggccagataagtatactacattcctttctttgtgattcgtaataaaatactaaaggctcttacaagttcaaaagtaacctgaattagaaacactcttttgttggcacagtcattaaaggcctgcactaggagtgccttgtggaaccccagtatgggaaacataactgcaaagcataagtagtggagtggcacacagagcaccggcaggaagatgcttccaggatgaatgtggcattcctgcag

SEQ ID NO: 142371 - DNA, 601 bp, Human
gtgcagtagctcacacctgtaattccagcactttgggaggctgaggagggtggatctcttgagggcaggagtttgagaccagcctggccaacaaggtgaaaccccgtctctactaaaaaaaaaaaaaaaaaaaaaaaaaaattagctaggagtggtggcacatgcctgtaattccagctactcgggaggctgaggcagaagaattgcttgagcccaggaggtggaggctgcagtaagcggagatcgcgccactgcactccaacctgggcaacagggcgagactccatctcaaaaaaaaaaataaatgaataaaataaagcccatttgatccataacctaacctataacgtaaagtactgctttctgtgccatcatgtagtgatatttccctgggccagagtttcaacctgagctgccaggaacatatctctctcttgctgtatgaggacagagcttctcctaactccaaagcagcagtgatggctgtcagaaccttgggggtaagaagagaaggccaactcccaaaaggaaggaattgtagaatgactggcttatttaggaaccccttttttggttcctaaataagatggctacaagatga

SEQ ID NO: 142372 - DNA, 601 bp, Human
tgtgtcaaatcctatgcattaaatcagtggacagaatatttccttgagagcctttgaatccaacaatacagagcatgggtgtccatagataccacagatgaaaggttatctcctgtacacacatacacacaaacagagagaaatgagagacagcgtgacacctcattttataacactaaggtcatcactaaaacttcttatacagcagaaccaacctgctcaaaacacaaaatgaggcctagcagaagctctacttggcctctggaattgtactgaccctctttatctttaccattactgkcttctacctatagccagcaccttctatctccgttgaatctctaagaccctgaaagcttgaacatgtagaaaattgatggttcttccaagaagaggagaaagaccttatttaagtccattatctaacttactccgaaaactttcctaaatggtgttaaaactttctccaagagaagaccaggagctctgaatcctctcagaaaaatgcatatccaggtgattgtgtgtggaccgttccaatttggtcatagcttacttaagttcattcttgaactctagtcttccagattctgggtttaaa

SEQ ID NO: 142373 - DNA, 601 bp, Human
gactctcatcctacatcccctccagagctcatcttatcccccaaaaatccctttcccttctccccataatcactcctctttcagatgcagacttcatgctgcaaagactttggcattactgttgttaggactttgtgatgtctttgaacttttttatgaagtcctagaatccatctctactctcctatgtcatttctgcctagaataatgatgcttctgaaagtgaaaggtgttaactatataaattctcacagactattaaacctgtttttaactggtagcatttttttaattaaaaaaygtaaaaattacaccataagagactaacatttgaacaggttttcttcattgtactttgtgttaagctgaacaacatgaaattgtcatgttaggtcaaaaatggacaagtagggcaatttcatataattcaatctaatatctgacccaatttatgccaatgattttaagtgccaggatgagctgtttgtgcaaagacagatgacaaccagcaagcctcttcttcctaggacaaagctgtttatgactagtgacctagatttctcaccctgtggtgcccaaacccagtctgttcaatggcatc

SEQ ID NO: 142374 - DNA, 601 bp, Human
ttattataagattcaggaacatcacacttaaaagccatcaggaagattttcttaagtagctgaataaaatcttaataatataatttagttatgacaaatacaagatccaaggaaaagccacttccatcatacttactatattgttttaatgatacaaatatgccaaacgatgtcattaagatactgtatgatcttagttaaacttagctggttatcatgctctcatattattctcacacctcatcacctgttttttgattcagtacactcttaatgcccttttctcaataattcaagccacaaaggatctgatgagtgttttctcactctaattattaagttgactacaattcaatattatcaaccaacacatgaattgcttctttaggacatttgaattttacttctctagtagcaaagcaaaaatgggatccctcaggtacctgatttcagacgtcagcacatagcatgatctttcagggtgtgagtctgaattcatccttttgggataagtggaagtggaaaaacatatgtgcctgtctccccagctacctacctgtgctgcttggaagatgagccaagctcggcactaaggtatatt

SEQ ID NO: 142375 - DNA, 601 bp, Human
agcctgtgagtttgtaaaaagtaaaaaatccttctatgtctacatgaaaagtcacaatgaaatgctctagccattaagccttcaacaatcacatgctgttattattaaccctgtggttattattaagttctttcaaaatagaagtggcagaagcaacccaaagagccaagaatagaaaatcattattataagattcaggaacatcacacttaaaagccatcaggaagattttcttaagtagctgaataaaatcttaataatataatttagttatgacaaatacaagatccaaggaaaagcyacttccatcatacttactatattgttttaatgatacaaatatgccaaacgatgtcattaagatactgtatgatcttagttaaacttagctggttatcatgctctcatattattctcacacctcatcacctgttttttgattcagtacactcttaatgcccttttctcaataattcaagccacaaaggatctgatgagtgttttctcactctaattattaagttgactacaattcaatattatcaaccaacacatgaattgcttctttaggacatttgaattttacttctctagtagcaaa

SEQ ID NO: 142376 - DNA, 601 bp, Human
ttcttaatcaattgagggttgttttctgtacttgaatatagatatttgttcagtgattcttaaaccgtgaatcataatattgcttaaactgtgattaatcttaaactgtgaatcaaaaatatcataatttttcctttttagacaaggtcctcactctgccacccaggctggagtggagtggtgttatcatagctcactgcagcctcaaactcccaggctcaagtgatcctcctgtttcagcctcccagttaggattacagacaagtaccaggctaggttaatttttatcttttttttgtasagcaagggtcttactatgtttcccaacctggtcttgaactcctggcctcaaatgatctccagcctcagcctcctaaagtgctgggattacaggcatgagccactgtgcccagacccatgttcaacgattcttaagctgtgaatcgtaacattaatattcttaatcacttatttcaaagcttctactgtagctcaggatttaccaagagtgtgctctgatattggaaagttctgatattaaatgtatatgaaaaatggtatgaattgtgtctcttagagaattttaacacatatattaaat

SEQ ID NO: 142377 - DNA, 601 bp, Human
tatatttgtgaccatgctattttaagtgaataaaaagtgaagtatctttcaaaaaaaaaaaaaaaaaagaaaagaaaatgtggtacatatacaccatggaatactatgcagccataaaaaagaacagcatcatgtcctctgcagcaacatggatggagatggaggcagttatcctaagtgaactaatgcaggaacggaaaaccaaatactgcatgttctcactcacattgagtacacatggacaccaagaagggaacaacagacaccagggccttcttgagggtgaagggcgggaggggggtgaggactaaaatactacctattgggtaccatgctttattacctggtgacacaataatctatataccaaaccccgggaacacattatttacctacataacaaacctgcacatgtacccttgatataaaagtattttacaaattaaattaaatttaaaaatatttaaaccaaggccactgaatccctatttattattgatagttaaaaaaaatgaatgcgacatttggctcctttatactcacaggaacattagttaaaatggaaaaaaattgaatgtaaaacataccaaaacaaaacaaa

SEQ ID NO: 142378 - DNA, 601 bp, Human
tccttttgttgtgggtttgttttagttgtatatatatttgtgaccatgctattttaagtgaataaaaagtgaagtatctttcaaaaaaaaaaaaaaaaaagaaaagaaaatgtggtacatatacaccatggaatactatgcagccataaaaaagaacagcatcatgtcctctgcagcaacatggatggagatggaggcagttatcctaagtgaactaatgcaggaacggaaaaccaaatactgcatgttctcactcacattgagtacacatggacaccaagaagggaacaacagacaccarggccttcttgagggtgaagggcgggaggggggtgaggactaaaatactacctattgggtaccatgctttattacctggtgacacaataatctatataccaaaccccgggaacacattatttacctacataacaaacctgcacatgtacccttgatataaaagtattttacaaattaaattaaatttaaaaatatttaaaccaaggccactgaatccctatttattattgatagttaaaaaaaatgaatgcgacatttggctcctttatactcacaggaacattagttaaaatggaaaaaa

SEQ ID NO: 142379 - DNA, 601 bp, Human
gctgacacaattaagaatttctccatcttattcctaacagctccattttatcccattgtacaccttaaaaatatttaagaaaatacatagtcaaggatataattaagaagtatttacgaaaactccaaactccatgttttataactaagagaattctcacttatgtatagctacaattcatgtaaagaaacagcttttgcttagttattgatgatttcacctaatttgaatccaaacaaaaatcctgaatgacatatttaatttttacctcgacaatgactgaaacattattactgaatayttacatatttaaattgtgtatttcacttatgagaaaagtaaaaatacaaatttcaagatctcaaagcaagaaggctcaataaaacattatataaaaatgttgatctttgactattttataactgttatgctaaagagaaacatgaaacctttgcattgttaatattagatcaagtaagtagaaagcttaaatattaacatttaccttccttggtccttcatcgcatgttacttgctattcaggccacatgagtttattgtctgtgatattagaaacacacttatataacctaatgggtta

SEQ ID NO: 142380 - DNA, 601 bp, Human
gaagaattcttcccccatccatcagcgcatctgttcccccacttaaagcatgcctacatacaatgttccaggtactggggacacaacagtggtgttaaaaaaaaaaaaaaaaaagaagaagcaagccaggcacagtggctcaagcccgtaatcccagcactttgggaggccgaggcgggcggatcacgaggtcaggagatcgagaccacggtgaaaccccatctctactaaaaatacaaaaattagccgggcatggtggcgggcgcctgtagtcccagctactggggaggctgaggcaggrgaatggcgtgaacccaggaggcggagctcgcagtgagcagagatcgcaccactacactccagcctgggccacagagcaagactccttcaaacaaacaaacaaacaaacaaacaaaaacgaaaacaaaacaaaaatgtaaggcaatttaaatttaacagagtttaactgagcaaagaacaattcgagaatcgtgcagctccccaaaccagaataagttcagagtgactccgtgctgccatatggttggagatttatgttaataaaaaggaaagtgatgcacagaaaatggggatgaggtgc

SEQ ID NO: 142381 - DNA, 601 bp, Human
tatactgctgaggtcacatctgaacactacagagaaattacttttcagtgttagtattgagaataattgtatttcttccaaataactaattctctttctctttcagcaaagtgagttaaacatctggcaaggcttctcatttgtaactgcagtttgaaagcttagggacagattgtgatccactcacaggactcgcctttggaaaggtgttattatttcctgttccattttatgttccaacttttggtttatctttttttctttctcaaacattcctaatttatgttactgcattatgcttaactgttcttgtaaacacttttagaacaatggagagtatcataaattttttaaaaacttaaacaggaaaaaatgttttaatattatttgaattaagatttatactttatgaaaatacatgttaaactgtaatacttaaggaaaaatttaaagcctcaatgattgtctgaataactgggtgtttttttcaaaataatgtcaagaacctggtaaagttaaaagaaacctcttgtatcaatatcaacttatcctgaaagtcatcacctaaaacttttcttaagcaatgactttcacatgacat

SEQ ID NO: 142382 - DNA, 601 bp, Human
ccctctctcctccccagaagttggggaggtgcaggggggcgctgaaaagccccaaccctctaatcctgccttagtctttcctatgaccagctccaacctgaggctacttaggggctgctggccaccaggaatctcattcacatacaaaaagacacatcactttggagattccaaggatttcagtagttgcatgccagaaaatgggaacaaagaacaaacatatatttcacaatattacaatctgcttttaagggtaatcaccaactttggcatattagacacccatattcgaaaaagtcastgatgtatacattgaggctcagtctgttttcaatgttttattagtcatttctacacagaataacagtcaaggacaaaaacttaaaaaaatttaagcatttatactgtaatgaccaaattcttttcaatgaaaacatctcccccacaaacatttctgggtataaaatttctctcccctgacatcataagtccatgggtaagttacacaacttcatgagcagccactgggatgtgttctatatgcaatgagactatccttttcaatctgtatcatggttttaacaacagcaacctctactga

SEQ ID NO: 142383 - DNA, 601 bp, Human
tcattaaatcatttgccattggtgataaccttcatcccctctctcctccccagaagttggggaggtgcaggggggcgctgaaaagccccaaccctctaatcctgccttagtctttcctatgaccagctccaacctgaggctacttaggggctgctggccaccaggaatctcattcacatacaaaaagacacatcactttggagattccaaggatttcagtagttgcatgccagaaaatgggaacaaagaacaaacatatatttcacaatattacaatctgcttttaagggtaatcaccaaytttggcatattagacacccatattcgaaaaagtcagtgatgtatacattgaggctcagtctgttttcaatgttttattagtcatttctacacagaataacagtcaaggacaaaaacttaaaaaaatttaagcatttatactgtaatgaccaaattcttttcaatgaaaacatctcccccacaaacatttctgggtataaaatttctctcccctgacatcataagtccatgggtaagttacacaacttcatgagcagccactgggatgtgttctatatgcaatgagactatccttttcaat

SEQ ID NO: 142384 - DNA, 601 bp, Human
tattgtttcaaccactttctggacccatatttatctttcaatctatggataggcatttgttataagctaaattatacaaactcaacacaaggcactgatgcttcttcagaatttgatgggaactgaccatggacaatgtcaataggaaccatctctttgtgcatcacttaataattttcagtggtatagaatagtgatgttttccttaacctgttccttataatttgataccacttttggataagctgtaaacaagcccacaatagaacagggaggtaaatattcccttttaaaaaaatayggtcctaccatatgaactaataatttaaacaatggctctgctatctaattattgtcagaaacaagtgttaaagttcaaagcatttggtattccataggtgcttcaagcttttttaaaaatgtcccaggctaaacttacattaatcatgctacttgaagcttcaattctgggcctttcatgcctaaaacttcagcaaatgtctcagtttaaaattattctgaaagaggtctgaccctgctactctctactctgtagaggtgagatgtgtcgactaactgctcaagcctacacctttgttag

SEQ ID NO: 142385 - DNA, 601 bp, Human
acaatattattcgactttattccatgttataccatgtcaaaatttcctcactttttaagtccactgtgtattttaaaaatttattttctaaggtatgtgaaaacaaaaatgtttgaagcctaaccaacatttcacaaagcctgtgagaaatgagcttcggagccatggaggtctatgagcctccttcatcagaaacaccttgggtatttacttaaaatgcagattcctatgccccaactcaatgtatgaaatttgaatctctagggttgggtctgggaatttgcactttgaaacaagcatyatacttgaatctgatgtacaccaaagttgaaaaccactgcactatgctactttactgctttgctgttaagtcttccagacgctattgtttcaaccactttctggacccatatttatctttcaatctatggataggcatttgttataagctaaattatacaaactcaacacaaggcactgatgcttcttcagaatttgatgggaactgaccatggacaatgtcaataggaaccatctctttgtgcatcacttaataattttcagtggtatagaatagtgatgttttccttaacctgttcct

SEQ ID NO: 142386 - DNA, 601 bp, Human
cattaggctcagctgtgtattttaaaatggctccctaaaggattttgatgtacatctctggtttagaaccaccaactcacagaatttaaactagaatcatctcccaggtgctaaagtgatttttcacatttttcattgcttggcaaaacacgaaagttctgggttccctaaactaatggtttaagaggtgttgttgatgggcttcagccatcccctagaccatctgccttcaaactgggatacatatgctcctaagggtatccaagggctttccacaaaagggttttaacagtttttgtgytttggattcctctagcacctggtaaagtcaggctgaatcccttcttaggataatatttttaaatgcataaatcaaaaacagcattagcaagaaaatataaccatactaaggataagtatatttaaatatggttatatttaaatatggttaaaaatttaatgcacatttttatacattaaaatatgtataccctagaattatatgtgctcctttattaacccagtaaatagtaaaatctagggggatgtctaataactgtcatgatttcaaagtaatcagttcaaaccaccttttgagata

SEQ ID NO: 142387 - DNA, 601 bp, Human
atgacagtttcatctcaatttttagggatacagacagaattcagtcatttcataggagcctacaatgaaacatcagctgacaatacattttagtttctattcatctggaaattatcgtaaaccagctttaaaagtttgccaattcttatttcactaggaaaaaaaaaatcttcacccattttacaaaacttgactttaccaaaaagcttaggctgattttaaaagctagaaaaactatcctaatactactcaatgttcaaaatgttggttataaatcttagtaattggttttagattattrtaaacctttatgactacctaaattcatgcttcatattctaactagaagtgtccatgtatgtgctacatccaaatactcattcaactttgcctaggaaggtctacagagagtctactctctctaatatagtatcagattaactccctaagaaaagctccctgagtaaaagaaataactccaccacaccaaaacaccactgaaaacccttaactgatactataaaataggagaagcacagacagctccagctttcaaaggaaaataagacagaactactgtagagaaaaaacatagtaacag

SEQ ID NO: 142388 - DNA, 601 bp, Human
atctgcctaagctatgggccctttgggggtcatgaagagctcagctaacactaagctgacaaataggctcttttcttctaaatacttttagaatgcattttatgtgaccatttcatactttacaacatccacttgggggttggtgcctacaatagtaggagaagccagaaggaggttgagagatattgaatggataaactacatggataccttctcctagaagaaggaaaaaagaagccaacaattactgagtggaggttgggaggaacccagctactctccttgcgtcccagggggcaawgggctgtcacaggcctggcctatctccccattctcttctttattgaaacacctgctcctagataaccagtcctgtttccagaattgtagaggaatcattatcggaaaggaagatgtctaaagaactgtctgagctttctaatcaaatgtgaatagatctcatttcagtctttgagtgccccctcaaactgccacttttcctagatgcattaggagtattctaagtaagtgacatggcaatgtgttttctttttagtttacaaatgatgcatatgccctaaacttcatgacactttttctg

SEQ ID NO: 142389 - DNA, 601 bp, Human
aaaaaaaaaaaagaactcaaacttctagtgactttcacaggtaatttgtgatctgaaaatataattgaatctattaagtaattaaggctatcatcctggagaacaaagaaataggaccaagcaagggctttggtatgcttagcgtaacaagcagagactccatatcaggccaggaaaaagggatttaaatcacaaagcattcctctgactcatgtgggaaagaaaattgagatttaaaacatgttccttttatttttttaaatcatctttctactaggcaaggaattttttttttttttttgagctgttcaatctctaatttgccacatcaatatgtccccaaataagggatctcaaattttggaacctattgaacatctaaatgtagtaacaaaacaaaaacaaaacaaactaatggaaaggatcccagtctgaaaaacaccaaaacaaaagagtggttttacaagctctgccaactctcaaaggcacaaagtgtgctatgtggcaggcgccacaacctggcaaacagtagcaggtcggaggagaggctgactgagtggcccatcagggagcattcatagctgcagagtccacagactgc

SEQ ID NO: 142390 - DNA, 601 bp, Human
tcttcacttctatgttcccgataggttagagaaaagaaaatccccaatttgttaaaatcattaagaaattctgtactcataaattaaaaaaaaaatccctaaactgatacagagatcctactggctacagaataaagtccatgcatcttagccttccaaatgtcttatttcttattcagtaactcttttatttgatccatcatgaatcctatgtagcctaatctgttccaaaagtcagaaagcaaagcaggtcctggttcgttatattaaagcagagcagctttagatttgaaaatagtgrgagaagcaatatcaggagaaaaaatgagtgagagatgccacatcaagttttaataacatttgtaatagaaatcagttccataggaattcaaacgccttagcagccagtggaattctaaaaagaatgtgaaaggttccccgatcaaacccactaacctcatatagctcctgataattcctgagccacaattcttctcaaatacttagtattctaaggtcctatatgaagtgcaactcacaggttggttacagaagggttaaattaccttctctctcaactgttctacaaataaacctttaa

SEQ ID NO: 142391 - DNA, 601 bp, Human
ccacgctatttagcatttgatttcattctatcttgtatcattttcagaatgtatgcttccaaaatttctaaatactgagtcccatgagaggcaaaacaaaaaaatgtgttccacattaaaataaaacaaaaccaaaacataatgggaaatacttgatgtaacatttctctcttggaaatgcatactacaagtttgcatagggaaggggctatatcattccattccatgctggttacccaataaataacaactttttaatgctttatttatttatttatttatttatttatttatttattttattttttgagacggagtcttgctatgtcacccaggctggagtgcagtggtgtgatcttgattcactgtaacctctgcctcctggattcaagtgattctcccgccttagcctcccgagtagctgggactacaggcgcgtgccaccatgcctggctaatttttgaatttttagtagagacggggtttcaccatcttggtaaagctgatcttgaactcctcaccccaggtgatcctcgcacctcggacttccagagtgatgggattacaggcatgagccactgtgcccggccttgatgcttct

SEQ ID NO: 142392 - DNA, 601 bp, Human
ctcaagtaaccactgaacatttaacttaaaggttgtctaaaattatgggccaacgcattctccccatgctgtcctgtgctgcagtcatttctgtatctgtgactgtgttcttttttccctcactagaacaccagcctcatcatctttgcaactgtttacgtctcatctctttttctttcttagagcagttttaggcttacagcacaattgagcagaaagtacagagtttcatatgctgttgcagccctgcgcccccaccgcctatcccaccatcaacatcccacaccagagtggtccaccsgttaccactgatgggctgacactgacacgccatcatcacccgaagtccatagtttacatgaggggccacgcttgacgatgcactttctactggttttcataaatgtataatgacatgtatataccatgtagtaacatgtagaattcaatccatttatagtacaactcgatccatcatagtccaactcaagtccctttcccatgaaatctttttaagctattcctaccaccatcacatttctttctctgacttttactgcactccaatgcaatctgtcccacgctatttagcatttgattt

SEQ ID NO: 142393 - DNA, 601 bp, Human
caaaacataaaaaactaaataggatcatctgataatgatacatatttgagttatacacagcactctccctattctgctgacagaaataattcaattaaaatcttctttttcttgcatttcacacatctatacagaacacaaagttaggatttggtggctatggtagacttcagcagagcatagtaagagtgtggaggctttacaatttggagtagctcattcagcaatgacaatgactgaaagtcactttctgatttctccatctcgtcataatggaaaaaaccttaagatgtatgaccaygatagaaaatgatattaaaccaaaaggaaataaatttgttcaataaagagatagtacaaacccaacaaaagacattgactttataaatacagtccaacatggtgtatagttatatgacacatagggacagaatcttccacaggtatcactccttatttctataactgcactaagacttgaagaatggaactgagacacgcaggtctttgttaataatttatattgaaccacttccaaagagaagttgaggcagttggattgaactgtcaaggtctatacatgagattataaaaaatactg

SEQ ID NO: 142394 - DNA, 601 bp, Human
ttttgaaggtcattttgcagggagtgaagaagataaaatatgggaaactgattgatgttattaatcttttgtagaccctcacttaatggggaagcagctgcttcatggggcatgcctacaggtattgtgtcatggcaatttaagtaactgtcaatgtcaaaaatagtgcagtctcatttgctcttctatacacaccagaataaacccatttcatggtatggtgcaacatccagccacattcaatctgactgacattttgaaacagaaataacaatcatgaaccatttattcactctattgmtcaattcttgttgacaaaacataaaaaactaaataggatcatctgataatgatacatatttgagttatacacagcactctccctattctgctgacagaaataattcaattaaaatcttctttttcttgcatttcacacatctatacagaacacaaagttaggatttggtggctatggtagacttcagcagagcatagtaagagtgtggaggctttacaatttggagtagctcattcagcaatgacaatgactgaaagtcactttctgatttctccatctcgtcataatggaaaaaacctt

SEQ ID NO: 142395 - DNA, 601 bp, Human
aaatgtgttctacatcaaagagatgttctggagccttctaatgagtttaagtatcagaaggtaaaagaggaaagaacatttagctaaaacttactagattaaaagggattctcagaaatcattcagtcaggatgcccatacctggttaggacaatacctaaaatatcccaaaatatataatgaacttttttttttcaagttctagaaaatgaaaattaacaaaatgctttagacagacattcctatgacccgtatcccacaaaaattaaaaggtgttactcaaggccagccctccaacacrtaactcatattgtcctttgaggagactcaggaaaataatgacatggtggttactaaatcaagagccttttatatagcttggcttatctgtatatacaagaaaacagacacagggatgctcaaaaagacacaatcagaagtgaaatgtctccctatttaacttgactttagcaatataaatcaaatgactatatataaggagatggccaataagggtggaagagatttttctggcttctgatctctatacactgtgtgcaatctctcgtcacactggtggttctgtgttagaatgacctat

SEQ ID NO: 142396 - DNA, 601 bp, Human
tgccttctttctcgtttccacccccacttattttcccctgaaacaaaagttagctatagaaaatactttaaaattatgtataggtcagccaggcgcggtgactcacacctgtaatcccagcactttgggaggacgaggcaggcgaatcacttgaggtcaggagttcaagaccagcctgggcaacatggcgaaaccctgtctctactaaaaatacaaaagttagccaggcacagtggtgcatgcctgttatccaagctacttgggaggctgaggcaggagaatcgcttgaacctgggaggcrgaggttgcactgagccaagatcgcaccactgcactccagcatgggtgacaggacgagactacgtctcaaaaaaaaaaaaaaattatatataggtcaggcacagtggctcactcctgtaatcccaacactttgggaggccaaggcaggaggattgcttgagtccaggagtttgagaccagcccaggcctatttgaaaaagggagacctcatctccaccaaaaataaaaaaaattagccaggagtgatggcacatgcttgtggtcccagctactcaggaggctgaggtgacaggatcgcttg

SEQ ID NO: 142397 - DNA, 601 bp, Human
gagactgcaggtgtgcacaaccacaatcagctaattttttttttttttttttttgagacagagtttccttgctcttgctgcccaggctggagtgcagtggcgtgatctcagctcactgcaacctctgcctcctgggtttaagcgattctcctgcctcagcctcccaagtagctgagatgacaggcatgcgccaccaggcccagctattgtatttttagtacagacagggtttcaccatgttggtcaggctggtctcaaactcctgacctcagatgatccatcagcctcccaaagtgctggsattacaagcgtgagccaccatgcccgatctcggctaattaaaaaaattttttttgtagagatgggctctcactatgttgctaagcctggtcttgaactcctgacttcaagcaatcctcctgcctcagcctcccacagtgctgggattacaggcataaactgccgcacccagcctcataaaaacttttatttaattataaaagttgaaaatcaactttgtaaaagccatatgagcacattatggaaagtctgtaaaatagacagtttaattacttttaaaattccactgacaaattctgtt

SEQ ID NO: 142398 - DNA, 601 bp, Human
accactgtgctaatttgttactaaatgggattatacatagtgaagtgtttagaacactgcctggcccatagttagtgctcaataaatactgtttatcattattgctattatttcactgaagattgtagagtaagcaaaatcagcaaatatttattatgtgttttacacttagcactgtgccatgtgttgggatacaaaaaattagagaccacagtcatattctttggaagcttaaaatacacaccagagatacaaaccagagatagaaagtctaaatagataaaaattcagtagtgtataraacagcagtagaatgtgaactaaaatgtgatagttatgcaagatatagtatatagtgaaaggatgataaatttctaaaaggagattttctaggaagcctttaaaacagaaggactggcactaattgtgatacagtgctaggagtataaagaacaacagggcagtaaatgtattagcctgaactaggataatggcagaggcagccaatacaatggcatagactcttacctgaaataagagtctgctagatttctgactaaatggattcagggttagagtatgtcaacttctacctacctac

SEQ ID NO: 142399 - DNA, 601 bp, Human
atctctactaaaaatacaaaaattagctgggcgtggtagcacatgcctgtaatcccagctactcgggaggctgaggcacgagaattgcttgaacctggaaggtggaggttgcagtgagctgagatcatgccactgcactcctgcctaagtgacagagcaagactgtataaaacaaaaacaaaaacaaacaaaacaacaacaacaacaaaagggtaatagggcagaaaaacaaaagggtgtattaacgattccatttttctgagatcctctcagttacttcctttggctaactcatcacaaygtattttaaaaataaagtaagtgacattctattaaaaaacttaccttgccaattatggcacgcccacacaataaaaagtacaaccactgtgctaatttgttactaaatgggattatacatagtgaagtgtttagaacactgcctggcccatagttagtgctcaataaatactgtttatcattattgctattatttcactgaagattgtagagtaagcaaaatcagcaaatatttattatgtgttttacacttagcactgtgccatgtgttgggatacaaaaaattagagaccacagtcat

SEQ ID NO: 142400 - DNA, 601 bp, Human
aaagaagcacagcaagaaagctatgattagaaggcaaaggaagcccgatgaaattatctaggaaaaaaaaaaaaagcccctcacatataatttaaccaaagtttgttcaaaggttaaaactttttatattgtcttattctttctaaaatattgctttatgatatatcttagctttgaacttagctacaaaactcaatatgaatgaaattatagatttgtaagttgacatttttcttcaagagctatgtcagtccatcatacattctctttcatgattttatagaatccccgaaagtaccarttaggaatttgactcttcatataaaaattttggtttcagaaaaagactaaataattacatgtttactgagtgcctagtatgttccaaggcacttaaacaaaacttaaacacaatcaatactccaaacttacttgttattatcttgaaaaagggaagctctgtgtctgctcaagcgtagagtactgtttgtgtgctacacagtccttaaatattctcttgaactttcttgtcgacatattgtagaactattagttttataatatatgaagaggaaaatttaaggcatatcctaatagatta

SEQ ID NO: 142401 - DNA, 601 bp, Human
attcaataaatgcagataatgacagcctttacgataatcaataattcctgtcctattgccacgtagagtgatatggtttggctctgtgttcccacccaaatctcatcttgaattgtactcccataattcccacatgttgtgggagggaccccgtgggacataatttgaattgtgggagtagtttcccccatattgtttttgtggtagtgaataagtctcaagagatctgaaggttttatcaggagtttccactttttcatcttcctcatttgctcttgccaccaccatgtaggaattgccytttgcctcctgctacgattctgaggtctcctcagccacgtggaactttaagtccaattaaacctctttttcttcccagtctcaggtatgtctttaccagcagtgggaaaatggactaatacacacagcatgcagctaacaggaagaaactcaggtagaacagtgaactcagtgcactcatgggttgtgtgcaacactccacatgcccctgtcatcacattcagcaatctagagtccagcctggtccctctgaacaggcttacttctgtatcaggggagcatatattttactgctgtatga

SEQ ID NO: 142402 - DNA, 601 bp, Human
taccgtaaatgggattgctttcttgatttctttttccactggtttgtcactgagttacagaaacactgattttttatgttaattttgtaccttgcaattttactgaattaatttatccatacttagagatttttggcgaagcttttaggggtttttatatataagaccatgttgtctgcaagcagggacaattttacttcctcctttccaatttagatggtctttatttctttctcttgcctaattgctctggctagaatctttttgtgtgtgctctccatagtgcctttcagaacttgamcatatccaagggtcttaataattattttataattcattgggaactacttcctgattcattcacccataactgtttggtcctgggtaaattgcttaacctccctattcctcagttttgtcaggtcaaggtgtgggtaaaaagaggatctttctcataaatttaccataaagattaacaaaataattacacataatatggttagaatacttttctgcaatgtagtaaacattcagtaaatattagctattgttgtttttgtcgtcataatcattataatttcagtttagaaaattaaaggta

SEQ ID NO: 142403 - DNA, 601 bp, Human
tttggtgtaagtcacttattgtcgctgcacttggttttcataagaaggttgtgggaatgcccacgcttgccttcgtgactgtctcccaggggtactatgagatttaggactgagatttattcgctcattgggcactgcagatgaaagacaccataaaaccaccaacaattattacttaaaagcaggctaatgaacatggagaggcttgcaagggcaaagcacttttaaagtgccaaagatgagggctagtagactgtttatataaatacaccaattgtccccaaagatatttgggaaaacytaaatcaactcaccaggagagatccgttacccaaagcctttcttaccaactggatgtaggcttaccgactagatgtaggcttaccgactagatgtaggctccacactaacttctcattaaattaactggctaattcaggtatgttttgcatttcaaaaaagtaggagttataaccaatcatcataactggtactaagcatgtttcatataatttcaaagaatgtaacaaataagcatattacaattagcctactccacaactctgagagttctggaagggtacaattcctagattacata

SEQ ID NO: 142404 - DNA, 601 bp, Human
agagaaaagataatgcaggtcaagtagttgaaatgtagcatagcaaaaagaaaaatggcataatatggtaatacggtactagcatttactgagggcctactatgtgcaggtactagtctaagcattgcatatacattatttaatcctgagctctaataatcacttgtattttgaatgtcccggggaaaaaaagtatagaaaagtcaacccaaagcagtggctgcaaatgagaggtgtgagactgggagttccagttctcaactactgtattgtttgtgcagggagtttgcaatcactctayatcccagggctaaaagtagctgtttaatctgctgatgtaacccagtacaggacatattataggttaccttcttgccaatggcaattaggaatatgatgaggttgagggacaacactaaaatgggaaaacatgaaagaataatcaaggacaatagatgaaaaataaaaatgatggaaaatgtggttttgacaagataatcggaagagatgtttgcatatatacttctaaatgaaaattttaaaaaaccccaggaattttggttcattaaacataagctgtatcgatgaaactggtgacaat

SEQ ID NO: 142405 - DNA, 601 bp, Human
tttcctgaagctatcatggatgtaagccaatatcaccaggcctctggtttattctttattttaatgttgacatgatactaaatatgggttgaaaatatccttaaacctagctagtatagtccatagaaaaacatcctcaaatttagtccaaagaacatcttttggctaaaataaacctaagtttcttgtaaggatattagatttcatggaattcattgctgcactgaatagcaagtactgaaaaacctgaaatcttcaaatcaattatttgaataatcttgcccttcttaagaaataatamcaatatatagttattttttcccagagtacacttcatatcccaaatagttaattaaacatgaacactgtctcacgaaaatgtctttaagaaagtctcccacaatatatgtatttgatcctactcttggtggtaagtatgcattaattgaactcgttcaggattttctatacgaaataatgggtgcagagaaaagataatgcaggtcaagtagttgaaatgtagcatagcaaaaagaaaaatggcataatatggtaatacggtactagcatttactgagggcctactatgtgcaggtactag

SEQ ID NO: 142406 - DNA, 601 bp, Human
aaaattaacattacctcagcccgtaataataagtacaaattatatttttcacttacaaaatcagaatttatagcacagcctaacagccttttacgaattagtgatatagcaaatgactaatgttttcaaaatacttttttgactaaattttaagatcccttgacagggccttgacagggattagccaagcaggataaaaattctttatcttgcttttgagtgaaccacatttagagttcagccagcttctggatatggttgaaataaaatgccaaggcagcagtccaagcccacttccccytcaaaggccatttggttttcctactttcaaaaatgaaagtattctggcattgtacttatgtgtatggacgctccaggagggtagggcgtccactcatacatgcttgaacaaagaacagctttcatcttcaaattcaaatgtttagggagagcaaaatccccaagtgaagaggaagtgaggggacactactgcccagctagccagattcatgatcaatgggaaagatgggatggtggatgtcacggtctccccctcttacgcccacaccacagctcagggtcatgtacagtctgcacagga

SEQ ID NO: 142407 - DNA, 601 bp, Human
acatatgctataataagaatgaaccttgaggacattatgctaagtgaaataagccaggcacaaaaattcaaacactgcatgatttcacttttatgtggtctataaagtagctaaattcataggaacagaaattaaaacagtggctgccagggcctggggggagggggaaatggggagttgtttaatgggtatagagtttgagttttgcaggacttaaaaagttctgggcattggttgcacttcaatatgaatatacttaacactgctgaactttagaatgattaaaatggtaaattttacrttacatgcttttttttttttaacacaactaaatattttttaaaaacttaaaatttagcttgtcagtttcagtagccactttccaagtgctcactgtggccagtcactactgaattccacagtgcagctccagggtataaatgactctgagtcgttttctgttagtatttgcctaaatacttggttgtaaagaggtaaaaagacagctatgtgattaaatagagaaagaggaaggtaataaaaacaaaacaaaacaaggctctggatcatgtgatgacaaatctctcatttaacctgtcag

SEQ ID NO: 142408 - DNA, 601 bp, Human
gttggggattattattatctgtgccttgataatacagggatcagggaatgaacctatataaaggtatataatcctagaattacagtacctttgagccaattctttcttttttaaaagttatctcctttaatcacctaggggtaggtgagcagaggaggaatggtttggaaaaacactcgatacttaacaccctcccaaccagggagtttttttttttctttcttttttaaccctttcagtccttttgttactcttatatccaaccacccatttgggtaccacacatgtaaaggcactcccrattctcatcctgatctgagttaatagcccaccatctatacaatcatctttcctattaatagtttccacaatgctgagggggaacacatactcagcaagtcaatggtctgggcaacatatcagcaggaaaaggactttaattttataattaaggtaggtttagaatacagtataaatatcctccaacagagacgattcactgacagatactttaacgcagtgctgtttaatagaactttctgatatgatgaagatgttctaaatttagccactaaccacatttgcctatttgaatttaaat

SEQ ID NO: 142409 - DNA, 601 bp, Human
atcagatcaatgggtgatgtaaatgggaaaaagactcaagagggacaatttttgatgtggcgtgggggtggttggggattattattatctgtgccttgataatacagggatcagggaatgaacctatataaaggtatataatcctagaattacagtacctttgagccaattctttcttttttaaaagttatctcctttaatcacctaggggtaggtgagcagaggaggaatggtttggaaaaacactcgatacttaacaccctcccaaccagggagtttttttttttctttcttttttaamcctttcagtccttttgttactcttatatccaaccacccatttgggtaccacacatgtaaaggcactcccgattctcatcctgatctgagttaatagcccaccatctatacaatcatctttcctattaatagtttccacaatgctgagggggaacacatactcagcaagtcaatggtctgggcaacatatcagcaggaaaaggactttaattttataattaaggtaggtttagaatacagtataaatatcctccaacagagacgattcactgacagatactttaacgcagtgctgtttaat

SEQ ID NO: 142410 - DNA, 601 bp, Human
tctcctctttcttgccccaccctctatcttcaaattaagtcttaagtagaaaactttggaatgaagacagttttcaactagagatattgaacttcaagctccaggtggttttacatttctaagtagcatctggttaccctggcagaggtgaaaaccagtgggtcttctggaaaaaattctgacttctatcaagcacacaggctacgccaggggtccttaaactccagtatgcacaggaatagtgttgccaggtaattttttacttagcgttgctaagtaaaaaactatttttaagcaatgygaagttaaaatattatacttaaggaaaggtattaaacttaaccttagagtaaaatttccaagtctccaataaaagaagaaaaggaaaacaaaaaaagcttcatcaaaacagtgcgggagaaaaagagagagcacccagaccacaggtgagtttgctcttaccagggccaacttctggttcagcaggtgtccgctcttcaactgtggcttcttctaccttcactaaaggtgctctgccctttagtgagggctcattggcaactttctgaggttccttctcaggatctttcttctcaggctc

SEQ ID NO: 142411 - DNA, 601 bp, Human
ctgacactctgtcaccaagtcttatttttataccagttaaatcagttaacatatattgaatgtgtacaaagcctcatgttagagtctgtggggagttatacactgagcaaaaagaagatgagatcatccatttgtcttttattgcatttgaaaattcctactcttcggtaaccattcattactagagcagcatcctcagcatccatgccatgagtccagattcagcctgggaagatgataccctatgaagaggacccttttgtctccccagagctgtctctaggtctgagatgggaggagstcggggcctctttgggagctggtgctcattctgcttatatatcccaagctgccaagatgcaagatgggagcagaagttctctggccttactcggatttaggaagatgacctagagagctggtgccccagaagccccacactgatgctcacaattctgcaccacagtgagcaaggcaccagcaagtgcaagctctggcccctggctgctccagcccctccttttgagagtcacatttctacttctgcttccacagacttttctcggccatcatgatgctctagcccttctttccttccttt

SEQ ID NO: 142412 - DNA, 601 bp, Human
gctaagggacaaagcgcgaagccacccttagacttcctcccgccttgccagctgcattgctgtccgtgctaaatagaagcaacgtgtaaccaccaatatcttggggagagctggctttttggaaggaatttaactattttttaaaggctctgacttgtttaattcaaataatgtgacttcttagtaatgaatttgaagcaccccagccaaagggaatctttgtaaataaataagggtcacagtgttctgtcacaggacaggaggaagacagccatgtaagctccctgttggagccaagggmaaggcatggccaagatggcggtccagcgagtgcatgagatccttccccagggtacagttgtgttcgtttgaagaacaattatattgacattcgtcttattaggcccagaagatgaccaattaaacaaactgtttctggaatactgcctggcaggcaatcatggggcatgtaaagatcccacctggctaccctccgagaggagttttatctggaaaggagaaaacatgaacccttattatgcagccttaatgtgataattacaaagataaaacggaaacctggagattggagatgtgttaa

SEQ ID NO: 142413 - DNA, 601 bp, Human
tgataaatgaaatttagttttataaactcaaaagaaattcttctaaaagtatatgtatacacatatatgtataagtatatatacatatatgcataaatacatattacataagatgatttaaaatatcaagcaacccattagagtataaacaaacgtgaaaagtaactggtagaaacactagacagttttacataagaggaaggaaggactcgatgacagacccctaagcttctgtgagtctgtaagcactggatcttttttccctccatcaattcctgaatatcttcacccctggagagtyaatttaaacattttatatataaattggtttgagttcattgacagaaatacctgttcctccagtgagagctcccttggctatatcaccgtttctctgatcactggttttctacgaagaagaaaaaaagaggacttttaaaaattagagttacaagtgaaaatgaaaaagataaaagcatacaaaagtagttagaaaacggccatgtcaataccttatctgtagcttctgttctcctggttcttttcataatctcctcaagtcgctataggaaaggaagaattgagcaagaagattagacac

SEQ ID NO: 142414 - DNA, 601 bp, Human
taaatcctcaccattacatttaatgacttgagaaaaaagatatttccactttcttggagtacagaattactagctcaaccaaaaatcaatgaggccccccccaaataataaatcctaatgttaagactttgaaattctggtggagctggtgggtaaaaacagtaatgttttactttaatgaatgtcagtgaaaactcacctctccactgtcacttttgactggtgtgaggtaaccacatgtgggctgccaactggctttccatttcccggagcgtttgttgtacatggaagtgcagacacctctgggcatagtaaaggagacagaacacagggttactaatattcttttcttagacctaacctccaagagccagaatgccttgatttatgtgctggttctgctacttaagtgatgtgagaccttgggcacatcacctaaactctctgtgccttagtttcctcattagtaatagtacctacttcatagattgttagaattaaatgtattaatattaatacatgtaaaggacttagaacagtgtttggcatgttggaagggcaaagtattattatttttccttgcactaaagttacatgaagt

SEQ ID NO: 142415 - DNA, 601 bp, Human
atcatcatcagcagcagttctacacatttaatgatttctgctgcaggcatttttatattcatctgataaagagtaccacttatgaggacctttgcctcaaagatgaggggattataatttggaggggggagtaaatgatttgcacaaagtcacacaactactgagagatagttgaggctaaatgcacgatctcttaatctctggtcctgtgtttttctcattaagccatttcgcacactttctagatattccagcctcctaaagcccttgcataatttcatatgtaaatttttgaagaccratcttcttatctttgccccttaaatctgcctctgacctcatcttgatccttatgaattcatgcttaatatcttggatttatttttgagatatacttaattggccccaaatacttaatcttctatggtttgtcttagattaccactctctgttataggcttattattatgctttacaatgtagccaaataatgcctatgcatcaaatgagtgctaaactaattttaccattcattttatttcattgcagcatatacatatgtgtgcaagcttcaaaacttgttcaatgctcaacaaattaa

SEQ ID NO: 142416 - DNA, 601 bp, Human; identical to SEQ ID NO: 21244

SEQ ID NO: 142417 - DNA, 601 bp, Human; identical to SEQ ID NO: 21245

SEQ ID NO: 142418 - DNA, 601 bp, Human; identical to SEQ ID NO: 21246

SEQ ID NO: 142419 - DNA, 601 bp, Human; identical to SEQ ID NO: 21247

SEQ ID NO: 142420 - DNA, 601 bp, Human
caagacattatcaacattcccgcactggccaggggactcaggtgtctggcctgccacatccattccagccaatgaccaatttctaattcactgcaactctccagctaagctgatttccagctgcttctctggcaggcctgccagatggggctaacatgctcttggagaccgtcccacagaaagcccaggcaacaagcacactggtgctcctctcgcttcatttaagacaagcatccctctttcactaagcactgaccaacacctcttcatccatcgctagcttacaatcacggcaacaagmagttaattctagacatactgacagcttaagttctgggacctcagccaaactttcagagaggagccctttcttctttgtttataataggatatgtgtcctgcaagggagaaaggctctctcctgcccaggacccttgcagtccggaggtggggcaagttacctccaaatcttggaggtttggtagaaatccttgcaggaatctgaagcctggacactatgactcacagtcctgtgcctggagcaggctcgcctgcttggagaaagtgcagtatgcaacccaagttgaagtgttcttaggag

SEQ ID NO: 142421 - DNA, 601 bp, Human
atgagactccaaaaaaaaaaaaaaaatttgtcctcccacaccttcacacaatgtctctgttccctgtcgccatctcattctgcccaggagggctgtaacagagagatagggatagaggaccccgtagagatgtgatctgtgtttctatcatacctgagaggccagcagaagaggtggggcaagcttcctctctctggatagacaggtcttgggaaccatgggtcagtgattctctgatagagtgcagctaagaatcacttggggagtgcgttaagaatacaggtttttcaggctccctccytttcccaggtctagcccaaggcctagaaatctgcattttggggaagtattccaggtgatcctgatgtgggtgatcccaagccgtagtttgagaaacactggtctagacaacccctcctccaggttacagatggggaaagtgaagtcctggggctgaaatggcttactggggatcatatggaataaagcccagaacccaagtgccaccttctttccatgcctgtcacctcctacacacggaacctgcccaaggggccctgtggcccagattctgcgattcttactttgtcagttctcttat

SEQ ID NO: 142422 - DNA, 601 bp, Human
aagaggcagttaagattctcttcccagccagtcatggtggctcacacctgtaatcccaacactttgagaggccgaggtgggcagaacacttgagatcaggagttcgagaccagcctggccatcatggtgaaaccccatctctaataaaaatacagaaattagccgggcgtgatggcacacccctgtaatcccagctacttgggaggctgaggcaggagaatcccttggacccaggaagcagaggttgcagtgagccaagatcacgccactgcactccaccctgggtgagaatgagactccaaaaaaaaaaaaaaaatttgtcctcccacaccttcacacaatgtctctgttccctgtcgccatctcattctgcccaggagggctgtaacagagagatagggatagaggaccccgtagagatgtgatctgtgtttctatcatacctgagaggccagcagaagaggtggggcaagcttcctctctctggatagacaggtcttgggaaccatgggtcagtgattctctgatagagtgcagctaagaatcacttggggagtgcgttaagaatacaggtttttcaggctccctccctttcccaggt

SEQ ID NO: 142423 - DNA, 601 bp, Human
ggttggcgcaccctccaggaggaaggcttgtcatccatgttcttctgccatcccatcgcgtttaagactttgcagatcttgagcaaacaggggttttcatctatttctcaaccagctcacatccaagaagcagcaagccaatatctgatatcatcagggatgaaacaccacgcccattctcagctaacatgatgtgctctcgggtctagctccaatacagtcattctttctggttgctctgttgttttgaacacactagggtttttttttgttttgtttttgggttttttgttttgttttrgtttggtttggttttttcttggggaaggactaaaaaagctatcagagtaaggatgaatctcccagccagctggaactttgtaactcttttattgaatatgaaatatataccgaaaagtgtgtagaccataagcaaacagctggatgaatgctcaaaaactgactgcagcacccacaccaaggacctgaacgtgcccacaacccttcctgcctccttccggtcatcttcatcccccacagggcacatattctgataccttagcaggctggagtttgtccttagctcacatgacaacctgac

SEQ ID NO: 142424 - DNA, 601 bp, Human
ggggctggcctcgcgggtgccctgtggggctgtgataggggttggcgcaccctccaggaggaaggcttgtcatccatgttcttctgccatcccatcgcgtttaagactttgcagatcttgagcaaacaggggttttcatctatttctcaaccagctcacatccaagaagcagcaagccaatatctgatatcatcagggatgaaacaccacgcccattctcagctaacatgatgtgctctcgggtctagctccaatacagtcattctttctggttgctctgttgttttgaacacactagggkttttttttgttttgtttttgggttttttgttttgttttagtttggtttggttttttcttggggaaggactaaaaaagctatcagagtaaggatgaatctcccagccagctggaactttgtaactcttttattgaatatgaaatatataccgaaaagtgtgtagaccataagcaaacagctggatgaatgctcaaaaactgactgcagcacccacaccaaggacctgaacgtgcccacaacccttcctgcctccttccggtcatcttcatcccccacagggcacatattctgataccttag

SEQ ID NO: 142425 - DNA, 601 bp, Human
aaccaaggagtgcagcaaaaggaatgcacagcactgcccggctcacaccgagtcctgccagagccgagggccacgagggctggcctgccgcaacagagaactgggcaggctgacctgtaagcatgtgcggccacagccacagccagccacctggcacccccgtgccaggccaccttctttccaaggtttcctgaacaggatggaggggctggcctcgcgggtgccctgtggggctgtgataggggttggcgcaccctccaggaggaaggcttgtcatccatgttcttctgccatcccatcrcgtttaagactttgcagatcttgagcaaacaggggttttcatctatttctcaaccagctcacatccaagaagcagcaagccaatatctgatatcatcagggatgaaacaccacgcccattctcagctaacatgatgtgctctcgggtctagctccaatacagtcattctttctggttgctctgttgttttgaacacactagggtttttttttgttttgtttttgggttttttgttttgttttagtttggtttggttttttcttggggaaggactaaaaaagctatcagagtaaggatgaa

SEQ ID NO: 142426 - DNA, 601 bp, Human
gagtttgcttcctggcctcctttcatgtgttccatttctagttctgtgtgggaagaggctgagagggtgtctggagccccaagaaagttcattacagaaaataaatatttccgcagatacaggacagaaggcgggtggaggtgtgggcctggaggacttcagggacatgaaaatgaggtttgccccagtggaggatctccccctgatttccaaaggaaattctttaagacggacaatgtattatctgggagaggaaccaaggagtgcagcaaaaggaatgcacagcactgcccggctcacrccgagtcctgccagagccgagggccacgagggctggcctgccgcaacagagaactgggcaggctgacctgtaagcatgtgcggccacagccacagccagccacctggcacccccgtgccaggccaccttctttccaaggtttcctgaacaggatggaggggctggcctcgcgggtgccctgtggggctgtgataggggttggcgcaccctccaggaggaaggcttgtcatccatgttcttctgccatcccatcgcgtttaagactttgcagatcttgagcaaacaggggttttcatctat

SEQ ID NO: 142427 - DNA, 601 bp, Human
ctgtaatcccagctacttgggagtctgaggcaggagaatcgcttgaacctgggaggcggaggttgcagtgagccaagattgcaccactgcactccagtctgggtggcagagcgagactccatctcaaaaaaaaaaagaaaaaaaagaaaaaagaaaaacatgtctggccttttccggctctcctgagagtactttgtgccccttattcatcctcaggatggcagctgggagtcgcgagaagtggctggaatgttttgagatggccaagcctccctccctttgatagagacaagagccctcrgtctattaattgcaggtgctccctgctgttttgagtctcccctgagctctcactgcagcctgctttttatattgcaattcaggtgtgaggtcacacagtgcctttatcactgctgaagaatagaaagtcaagagtttgcttcctggcctcctttcatgtgttccatttctagttctgtgtgggaagaggctgagagggtgtctggagccccaagaaagttcattacagaaaataaatatttccgcagatacaggacagaaggcgggtggaggtgtgggcctggaggacttcagggacatg

SEQ ID NO: 142428 - DNA, 601 bp, Human
atttttataccgttttgcctccactgttttcagtattgttgaaattaatcgtttcagcccctttctgtgtgttcttagcatctaacatggtgcttctctgtattcgtggaatagctatcctatttcattgcttctcaatgcaactgataacaagatatatcccaatttcagagatgctaaaatgtggggaaagtggacatcttaggaccaataaaataggacctttgactgtagcaggtgctatctctctttcttggcctggtggtgtggcccctggaagagactggccatggtgcctgcrctccaccgtggtgcctgcacccttcgcccagcagttgcccctgcgaaggaagagagtaacaggccaggaaggaggcccctgctccttctgagactgcaggatcccgaggaaacattctctgacctattctcttcctcaaggagaaccaggactttctccctcctgcccgcagccaccttcccactcatgctttgaattcagcctttttgcttgaaagatttattttgagcaggttcacagggcagcacactggctcctcttcttaaggggatgcgttgccaaaagctctggccagctctt

SEQ ID NO: 142429 - DNA, 601 bp, Human
ggggaagaaaagcaagtgaacttggcataattcctggcaaatctacactatttactcttcaaaaaaaatccctgcatttcctcaacggcatgaggtgtagtgcagggcacacagtgcctggcataaaacgagcatccaccaatggactgggaaagagcaccgggagggagttaagaggcccaagttctgactctgctcctcaggctgctggagccacctgacagttttgagctttcctggcttcagttgtaaacaggggcagggtttggtgacatgagcttcccctcccctgcctggggcycacctaagcaataacggctgtctgggcacctatttgaatactttgtgaagcccagcagagacgggctttcagccacaatcaggctgctccaggcaattgcaatgttgggtatctacatttctggcccaattatatcaaaaggtcaggacccccatttctcctcccttggtccagatcctctccctttcccctacatccctctggtctcccttcctctggggtttcacactcaatccattctccaccctgcagctgggatgattctcctaaaatgctaatcccagtttgtcagtgttctac

SEQ ID NO: 142430 - DNA, 601 bp, Human
cttctctctttcacttcaccaaaaacaaatctaaggtttcctacatgtctccttttacttctaatgagatgcacatggtgatgtggcatttcctttcaggccagtttcacctctgaaatccgaccatcccagatcaatgtcaccttctctctggtgccttccctgagtcccagagccaaaaattaatagagaaataacccattctttcctcaatcatcaacaagtgtttcctgagcacctcccctgggccaggctatgtgcatctatctgcctatgcagctgctgtggggacgctgacccytaagctgtgcagacacaccctccttctagataactcttcttgagggtaaaaatggctccttggtcaccctctgttcctcttggaagtcctagaacactgctgtgcatgcagcaggctcaagctcaaaagccaccattgattaaacaattcagcagtgataatttgacaagtgataatcagcctttgcaggaaagccaacacctgattattaacccaagaagtacccatgccatcatgggacagttatgtggcaggaaacagttgatgcctataattcttaactttttaccagggcataac

SEQ ID NO: 142431 - DNA, 601 bp, Human
cttaaacctgaagaccttcatcctggctacttctgtctcttctctagagatgcgtgaagtatagtgggaaggtcgagggctttggaggcattcgaccaacctgccaatcacagctctgccaccgactagctatgtgacctagggcacatttctttgcttctctgggcttcacttacaaaatggaagtggcagtacctatctcaccgggtgctgtgctgtgaggaatcactgcgtaagagccatgtctagacaaggtagactcttacgcacgctgggtcccaggccctcctgagttgatttstctcagttctttctttttttcttaggggctggtttccaaccttttagagcaacttctctctttcacttcaccaaaaacaaatctaaggtttcctacatgtctccttttacttctaatgagatgcacatggtgatgtggcatttcctttcaggccagtttcacctctgaaatccgaccatcccagatcaatgtcaccttctctctggtgccttccctgagtcccagagccaaaaattaatagagaaataacccattctttcctcaatcatcaacaagtgtttcctgagcacctcccctggg

SEQ ID NO: 142432 - DNA, 601 bp, Human
gaagttccccaggatgaagcctgaactaaagtgaagattggccgctggacgttgacctgatgctggctcaatgtttcacgtaacagctttcacaataaggatgttctttctgatatcttacctatagcactcttgctattatttaaagttttcctttatagtaaaaaaaccacgaaaacaaaaatcttttgctttttcatagttcttcttaaacctgaagaccttcatcctggctacttctgtctcttctctagagatgcgtgaagtatagtgggaaggtcgagggctttggaggcattcraccaacctgccaatcacagctctgccaccgactagctatgtgacctagggcacatttctttgcttctctgggcttcacttacaaaatggaagtggcagtacctatctcaccgggtgctgtgctgtgaggaatcactgcgtaagagccatgtctagacaaggtagactcttacgcacgctgggtcccaggccctcctgagttgatttgtctcagttctttctttttttcttaggggctggtttccaaccttttagagcaacttctctctttcacttcaccaaaaacaaatctaaggtttcc

SEQ ID NO: 142433 - DNA, 601 bp, Human
atgctgacagcaaataaatcactctttgccctgcagggagatattgtcactatcatctaagactgtttgttacataaacgtcctttaaaagcaagtctggaacaaaacctgtctagtgtctctgttcacagatatgctgaaacatgaaagacccatggagaactgtctcccaacactacccctcaaacattaggctactgagtctctaattgtgccacgtgctctcgcctgctttttagggcctctgttgcctgcaatgggatgccatcctcatccctaaaacactcaccacccatgcacwtaaatactcacatattctccttgccctgctaactcctgtgtgtttccagaattagctcctcaggcaagcctttgctgacagacgcacatgcccccgaattgaggttatttgtcccctctgtgttccacaacaccagcacacgtcatcatagcacttagtgtgcttcattgtaattacctgcttatatgtctacctccccctcacctaccagcccattgaaggtaagggctctgtctctggttccctgtgaccagcccacaaagggattcattaaagactggaggggagaataagcgaatc

SEQ ID NO: 142434 - DNA, 601 bp, Human
tagtttaaatatttgactctagttaaattgctatggattctcttgtgtaaaatagttattgaccgaaataaaatgttggtgtttctcctgtttgagttttagaaaataagctgtgcagagtgctgcaaggcagctggaaggaaaggaagatggagaaaatacagcctggtttccagaaaatgagggcctggggtcaacaaggctattatttgtgacaagctcttgagtgaaaagagaaaacttcaaatgatcatgatcataaagccatattccacacagggtgatgtagcaatgttccccrgcactcacgggaaaccagtgggagagcgaatactgtgggcagaggctgcttttgtgacaggctcctttcctggcagagagagacttgaaaatgtcacaggtgcttttcatcactggtacagctgtctcccctggctgacaaaaaaatgctccctctccccatccgccttcccagcactcatctttgtgaagagtgtgaagcggtaggtgagaagccatgacttgatttggcatttagacagcaggccgggggaaatcggggtatctaatttgaatgtgaccttgaactaactctgagctg

SEQ ID NO: 142435 - DNA, 601 bp, Human
ccattctatggatatatcacaatttggttattcattcataggactgcattttattgtagtttaaatatttgactctagttaaattgctatggattctcttgtgtaaaatagttattgaccgaaataaaatgttggtgtttctcctgtttgagttttagaaaataagctgtgcagagtgctgcaaggcagctggaaggaaaggaagatggagaaaatacagcctggtttccagaaaatgagggcctggggtcaacaaggctattatttgtgacaagctcttgagtgaaaagagaaaacttcraatgatcatgatcataaagccatattccacacagggtgatgtagcaatgttccccggcactcacgggaaaccagtgggagagcgaatactgtgggcagaggctgcttttgtgacaggctcctttcctggcagagagagacttgaaaatgtcacaggtgcttttcatcactggtacagctgtctcccctggctgacaaaaaaatgctccctctccccatccgccttcccagcactcatctttgtgaagagtgtgaagcggtaggtgagaagccatgacttgatttggcatttagacagcag

SEQ ID NO: 142436 - DNA, 601 bp, Human
atatagatcccaaagtattaaaagcagggattcaaagagatacctgtacacctgtgttcatagcagcattatttatattagtcaaaaggtggaaataagtcaattgtccatcaacagatgcatggataaacaaaatgtggcacagacatacaatggaatattgtttagccgtaaaaaggctgatctcattttaatgtaccatttcttttccaagaatctaacccaccagatgcttgagaggagctgggataggtctttttattttcacggcaccctttatggaaccaaacgtatggcagaygctcaatgaatactcactggttgagaaaaactctgtagtttacttggcctagacttgaatagtggttgccagaacttgagtgcacaatcagaatctcctagagggcttgttcccacacagactgctgggccacaccctcagagtttctgattcagtacttcacggacggagccctagcatctgcatttctaacacattcccaggtgatgctgctgctgctgggtccaggaaccacatttggagaatccccagcccagagccatatttctcaaccatggctacatagtggaatctccaaga

SEQ ID NO: 142437 - DNA, 601 bp, Human
ccctcgctggggcagggcaaagggtttccccctcttctgtgctcctatacagcctttgcatttctcttccttgcagcagccacactgatcaaagcaatattgtctgcctttccaccccagtagtccagtggttctcaaagcgtggctccagacaagcattatcatcaccgcctaggaactcattcaaaatgcagagtctcgggccccaccccaggcctaccgaaccggacactctgggggtggcgcccagcatctgccgttggacaaggctgccaggcgatgctgctgcgggctgaggctragaagcgctgcactagactgtcagctcgctttctgcatgcgtgtacacctggctcctgctgcagagcctggcacactgaagtgttcaacaaacagctctcgaactaagcaacaaacaacagcaaaccactaagttaaacaaactgctgacatgctaacaacctaacccctatcatgaaaactagccaggcctgagccccccatcagtgctcaccacatgttatcctccttcatcttccttggcccattcatgtgaggaatcgtgctagatgtgaaagtgttaagtccacagccctgtagc

SEQ ID NO: 142438 - DNA, 601 bp, Human
gcagacacaccaagctgcttcacatctccctgaaacaccctcccctcgctggggcagggcaaagggtttccccctcttctgtgctcctatacagcctttgcatttctcttccttgcagcagccacactgatcaaagcaatattgtctgcctttccaccccagtagtccagtggttctcaaagcgtggctccagacaagcattatcatcaccgcctaggaactcattcaaaatgcagagtctcgggccccaccccaggcctaccgaaccggacactctgggggtggcgcccagcatctgccrttggacaaggctgccaggcgatgctgctgcgggctgaggctgagaagcgctgcactagactgtcagctcgctttctgcatgcgtgtacacctggctcctgctgcagagcctggcacactgaagtgttcaacaaacagctctcgaactaagcaacaaacaacagcaaaccactaagttaaacaaactgctgacatgctaacaacctaacccctatcatgaaaactagccaggcctgagccccccatcagtgctcaccacatgttatcctccttcatcttccttggcccattcatgtgagga

SEQ ID NO: 142439 - DNA, 601 bp, Human
ttagaggatgtgttatggcctagattacagcttgatggtggaatgcctcatcagagaacacctgggccccgctcctccaaggctcaacatctcagagccagcttggtctatcctttgcccttagtgggtcatggactcccatgcttccatgggttaggccctcgccatgtcacactgcaaaggcttcccacaggcaaccagccccagccttccttgttacactgccaggctggctctcctgcagtaaccagatcaatcttgtcatagcctggcttgggtggcaccaccccaccacccatcygtacactccctttctccctagcatgccctgccccaccccaacaagacaaagcacagcctagctgtttttcatggccttgaagtgccccaacctgtcaaagtcttcaaaggcccccacatcccgccccagcctgccccatgcttcagccagctccctgagcctaagaacaggctatgccaacccaccttcacaaatgccgttatgaaaaaatctgctcaaatgccctcttctttcctctgcacctttccaaatttcgtccactcttcaaagtccagctcaggtcctgccaaagctacccca

SEQ ID NO: 142440 - DNA, 601 bp, Human
aaataggtcataaatttttaacagtttgtaaatttcagggttcacatacagtccatatattttttgcaatattgcaattagaggatgtgttatggcctagattacagcttgatggtggaatgcctcatcagagaacacctgggccccgctcctccaaggctcaacatctcagagccagcttggtctatcctttgcccttagtgggtcatggactcccatgcttccatgggttaggccctcgccatgtcacactgcaaaggcttcccacaggcaaccagccccagccttccttgttacactkccaggctggctctcctgcagtaaccagatcaatcttgtcatagcctggcttgggtggcaccaccccaccacccatccgtacactccctttctccctagcatgccctgccccaccccaacaagacaaagcacagcctagctgtttttcatggccttgaagtgccccaacctgtcaaagtcttcaaaggcccccacatcccgccccagcctgccccatgcttcagccagctccctgagcctaagaacaggctatgccaacccaccttcacaaatgccgttatgaaaaaatctgctcaaatgc

SEQ ID NO: 142441 - DNA, 601 bp, Human
agaattcaaatttttccaaataggtcataaatttttaacagtttgtaaatttcagggttcacatacagtccatatattttttgcaatattgcaattagaggatgtgttatggcctagattacagcttgatggtggaatgcctcatcagagaacacctgggccccgctcctccaaggctcaacatctcagagccagcttggtctatcctttgcccttagtgggtcatggactcccatgcttccatgggttaggccctcgccatgtcacactgcaaaggcttcccacaggcaaccagccccarccttccttgttacactgccaggctggctctcctgcagtaaccagatcaatcttgtcatagcctggcttgggtggcaccaccccaccacccatccgtacactccctttctccctagcatgccctgccccaccccaacaagacaaagcacagcctagctgtttttcatggccttgaagtgccccaacctgtcaaagtcttcaaaggcccccacatcccgccccagcctgccccatgcttcagccagctccctgagcctaagaacaggctatgccaacccaccttcacaaatgccgttatgaa

SEQ ID NO: 142442 - DNA, 601 bp, Human
gggaaccagcttcgggaatgagggcacagggcaccggtgctccaggactggctgggatcagacagccatctgcatcaggaacctgccctggtcctggctgccatccacagcggagttcgtccttgggcaccagtcacaggtctgtaggtcagcaaggtcaagaaagccttgtcttcgcctcctcctcctcctcctcattgttattatattgtagtagctttgatccttataactctataaccttacggggtaagcaaggcagaattgcaccattttatgggtgaaaaatagagatttaagmgatttgccggaagtttgactttggctaagtaacagttactttgcttgggtcacaggacttatgtgtccttcagtatttatccaggagattttgtgcacctggaatttcctggcttccccacgctgtccttgaagacaaggaccacggctcatccatcgctgcacttcccacagtgcctggcacagagtgggccctcacatgtttactaagctgaactctcaacacctgtttcatgcttgttcctttcccagggaacgtgcacccaccttaattccctcatgtatttcttctcctcaaaaa

SEQ ID NO: 142443 - DNA, 601 bp, Human
acgctttattggaagttaggaccaaataaggtatttggggggcaggaaagactaaggatattaaaggcagtagagttggtgttggcaaaacctgtcttggaaagagaagcagctatgttggaccaggggagtccagagaatgagattccagcatcagctgtcccaacacttcagtgggttatgttccctgctggagcctccattgcccttcgtgcaaatggtgggggtggtgggcgtagtggtggggatgggatgtgtgtggaagctatgttctggaaggttccttctggctcttaagctytgatatttattaagaatactaggactaagcaccttctccatctgtcaggcaaatttgaatgagtcagagaggttgctcatgtcaaggcagctactgggcatgtgacaaggtgcccaggggaaccagcttcgggaatgagggcacagggcaccggtgctccaggactggctgggatcagacagccatctgcatcaggaacctgccctggtcctggctgccatccacagcggagttcgtccttgggcaccagtcacaggtctgtaggtcagcaaggtcaagaaagccttgtcttcgcctcct

SEQ ID NO: 142444 - DNA, 601 bp, Human
gaaaaagaacagagggcttgggaaaatgtgacttggggaatgtttcctttttctcttgctctaaatacgctttattggaagttaggaccaaataaggtatttggggggcaggaaagactaaggatattaaaggcagtagagttggtgttggcaaaacctgtcttggaaagagaagcagctatgttggaccaggggagtccagagaatgagattccagcatcagctgtcccaacacttcagtgggttatgttccctgctggagcctccattgcccttcgtgcaaatggtgggggtggtgggsgtagtggtggggatgggatgtgtgtggaagctatgttctggaaggttccttctggctcttaagctctgatatttattaagaatactaggactaagcaccttctccatctgtcaggcaaatttgaatgagtcagagaggttgctcatgtcaaggcagctactgggcatgtgacaaggtgcccaggggaaccagcttcgggaatgagggcacagggcaccggtgctccaggactggctgggatcagacagccatctgcatcaggaacctgccctggtcctggctgccatccacagcggagtt

SEQ ID NO: 142445 - DNA, 601 bp, Human
tttcaaggcctcaaaataactcaactacaccaagatggtgactagggaagagggaggctggaggatatcaaagcaggcactccagggccaaactggagtaagacaattattcagctgggggccaaaccgaatgctttaggggcagcggggagcagaatgaagcaaccgtgaggcctcatgtagaaccccagggtcaggaagagacacagcacagggtaagactccctaagtgaggctgccagccttttctgtgctcacaatactgcctgggcccacagccagcagggcggaagctgccagscaggcatgaatgcaaaaaactcaggaagtaaagagatgcatcattgagaagctttctctttgcacacatgactaaagggaactggattagaagggttttcttttcccacagtggaggttcaaaaaggtttcatcaagagggcattttactgatagctaaacgagagcctcgtgaagatagggacccctcatcttcgtctctgtgaacccatattataagtagggtcacgtgcccccatgggcatttaggaaacattttcccaaagagtgaaaaagaacagagggcttgggaaaatgtgac

SEQ ID NO: 142446 - DNA, 601 bp, Human
gctctctaactaggggaccgtatctgagagtgggaagaatccgaagtgatacttggtacccaggttcatttcaaatgctatgaggcgttggtcccaggcttagttagttcttacttctaggtccggacacacacatcggaaccctactgatttttcaggctgtcaaccttaggctatgcattttcagaaatgttacagcatgacggaattgcagaatctccagtccaacctttcactggacaccagtcttctcacttgggcatggcagagtctccgctgagctctactattcttattttcraggcctcaaaataactcaactacaccaagatggtgactagggaagagggaggctggaggatatcaaagcaggcactccagggccaaactggagtaagacaattattcagctgggggccaaaccgaatgctttaggggcagcggggagcagaatgaagcaaccgtgaggcctcatgtagaaccccagggtcaggaagagacacagcacagggtaagactccctaagtgaggctgccagccttttctgtgctcacaatactgcctgggcccacagccagcagggcggaagctgccaggcagg

SEQ ID NO: 142447 - DNA, 601 bp, Human
gccagtacctattatgagccaggaattactctgggtcttggggctgccaggttgaatacaatagagcccctgctcatccaagctggcattctagcggggaagaatttagcaaatctgcggggccaccccaggtgggaaaaattagtgtcttactgaccacagtgccaagtattatcttggtgcaaaaataattgcggtttttgccattcctttcaggcaaaaaccacaactgcttttgcaccaacctaaataggtctttgtggctgctggctttgcaagtatgaccttcctgaagagaaamccctgaggacattgactcttgatacccacatttagagtaactatagaacccaatctgatagggatgattgacaaatgttaaataattataggcctggaatcacagagtgaagtgcagagtttaagctggaaaaaaatatgaccacactataaactaattattacaatataattgacacactatcagtgaagaggaacagactttaaaaaaagaaattcctccagggctcaagcttcttgctaactaccagatagcagttcctcccctggaaatgaaaataaacatgctatgtgcagatga

SEQ ID NO: 142448 - DNA, 601 bp, Human
aggtaaatcttcaaggctcagagtcttggcctccagaatcaggtccagcaaccactcaggaccacctgctcttaagtgatgtggggaaagaaggactagggctgcacaggccagagccagaaggccaccgaactctgctttattttgtacattgttcctgtttgacacacacgtcaagacctgttgactttcagcaattcagcatctgcttagccagtacctattatgagccaggaattactctgggtcttggggctgccaggttgaatacaatagagcccctgctcatccaagctggcawtctagcggggaagaatttagcaaatctgcggggccaccccaggtgggaaaaattagtgtcttactgaccacagtgccaagtattatcttggtgcaaaaataattgcggtttttgccattcctttcaggcaaaaaccacaactgcttttgcaccaacctaaataggtctttgtggctgctggctttgcaagtatgaccttcctgaagagaaacccctgaggacattgactcttgatacccacatttagagtaactatagaacccaatctgatagggatgattgacaaatgttaaataatta

SEQ ID NO: 142449 - DNA, 601 bp, Human; identical to SEQ ID NO: 21248

SEQ ID NO: 142450 - DNA, 601 bp, Human; identical to SEQ ID NO: 21249

SEQ ID NO: 142451 - DNA, 601 bp, Human; identical to SEQ ID NO: 21250

SEQ ID NO: 142452 - DNA, 601 bp, Human; identical to SEQ ID NO: 21251

SEQ ID NO: 142453 - DNA, 601 bp, Human; identical to SEQ ID NO: 21252

SEQ ID NO: 142454 - DNA, 601 bp, Human; identical to SEQ ID NO: 21253

SEQ ID NO: 142455 - DNA, 601 bp, Human; identical to SEQ ID NO: 21254

SEQ ID NO: 142456 - DNA, 601 bp, Human; identical to SEQ ID NO: 21255

SEQ ID NO: 142457 - DNA, 601 bp, Human; identical to SEQ ID NO: 21256

SEQ ID NO: 142458 - DNA, 601 bp, Human; identical to SEQ ID NO: 21257

SEQ ID NO: 142459 - DNA, 601 bp, Human; identical to SEQ ID NO: 21258

SEQ ID NO: 142460 - DNA, 601 bp, Human; identical to SEQ ID NO: 21259

SEQ ID NO: 142461 - DNA, 601 bp, Human
acctggccaggcctaagataggctggctgcagcctttgatgccaagaaagcctagggagggaagttagaagtctgatctcatggaaagggtcctatcctgtgtcttagagaagggatcattgtctggaacagagaagtccccagggaattctctcttacccatctgtgcaagactcccaggcttaaagagtgctctggtccatgtgcctgggggcctcggctttttgcttctctgcaaagactcactgaaggggggaccccagtgagccccacacctagtctcacaaggcgcctggttccygtggcagccagggagctctcagccaacttcttgagggcatcagtgccagagctgcattcacagaagatcccaatgtcttggcaccacactcccgcaccccctccccccagcactgcctctcctcaccttgggagaaggaggtgtataccagcctctcatcgaacttctggacctgccggaagttgttgatcatttctctgggggaagggtcgtccatgtgtgtgcagtacagggctgtctccaaagccagcagctgagggcaagagcagaaatagcccgcaggcagaatgacctcctcac

SEQ ID NO: 142462 - DNA, 601 bp, Human
cactgacaaagtctcacaccgtaaacctgaaacatcatgttacagtctgaggcctgctccgagctgggtaagaaaggcctcgtgaatgcagccccctgggcagatgaggtttgggccttcacccctttgggactgcctcctcattgctccttgggaagcagccgcacttgctgcctgtgtctttgggaagtgaaagggaggggaggagaattctggccaagcttctataatcagcctccagatggacaggttttccttggactgccacagagtctcactcagaggagaaagctggtcccarcctgggcttgtggaagcaccagctctgggcaaaccgtggaggaagagcagtggcaacgctgcatttgggctttgatcttgacgtcctaagctgggagatggtctccagacttctgcttagaggcccctcaagctcccctatccagactgggagaatctactgaagcgcttggctaaaaacctgcctacgctgccccactacaagcagctgcttagacacaagccggtctaagaagatggctaattatccccaatgccatagtccatcgttacaagcgggggttacttttggatgtcagag

SEQ ID NO: 142463 - DNA, 601 bp, Human
acttttctcctggcagaattttctgactctgtagttcttgttaacttccagagaaagccctgagtaagccagaccctaattacaaacatgcctcagtggatgaggctacaatttgagtccaaactgctcaaggttcacactgacaaagtctcacaccgtaaacctgaaacatcatgttacagtctgaggcctgctccgagctgggtaagaaaggcctcgtgaatgcagccccctgggcagatgaggtttgggccttcacccctttgggactgcctcctcattgctccttgggaagcagccscacttgctgcctgtgtctttgggaagtgaaagggaggggaggagaattctggccaagcttctataatcagcctccagatggacaggttttccttggactgccacagagtctcactcagaggagaaagctggtcccaacctgggcttgtggaagcaccagctctgggcaaaccgtggaggaagagcagtggcaacgctgcatttgggctttgatcttgacgtcctaagctgggagatggtctccagacttctgcttagaggcccctcaagctcccctatccagactgggagaatctactga

SEQ ID NO: 142464 - DNA, 601 bp, Human
acccggccatcctagatgattttttaaacatcacttttctcctggcagaattttctgactctgtagttcttgttaacttccagagaaagccctgagtaagccagaccctaattacaaacatgcctcagtggatgaggctacaatttgagtccaaactgctcaaggttcacactgacaaagtctcacaccgtaaacctgaaacatcatgttacagtctgaggcctgctccgagctgggtaagaaaggcctcgtgaatgcagccccctgggcagatgaggtttgggccttcacccctttgggrctgcctcctcattgctccttgggaagcagccgcacttgctgcctgtgtctttgggaagtgaaagggaggggaggagaattctggccaagcttctataatcagcctccagatggacaggttttccttggactgccacagagtctcactcagaggagaaagctggtcccaacctgggcttgtggaagcaccagctctgggcaaaccgtggaggaagagcagtggcaacgctgcatttgggctttgatcttgacgtcctaagctgggagatggtctccagacttctgcttagaggcccctcaa

SEQ ID NO: 142465 - DNA, 601 bp, Human
gctgccaatgctacaacacacaggacaccccccactgtaagaattatcctgcctaagttgtcagtagtgctaaggttgagaaactctgcccccaggctaaggtgtagctggactataaacctcttaaggacagaaatcaggtcctgtaccccttttctaagcacagttgaggaaaatagcagggttaagttaaatgattcggtccaaattgtcccaacctggctaaacttcagatccttccccaaagtccatgtactttctctcatagggaatttttttttaatttttaaattttaattatttaagagacagggtctcactctgtcacccaagctggagtgcagtggtgtgatcatggctcactgcagcctcaaactcttgggctaatgtgatcctcccacctcagcctcccaaagtgctgggattacaagcatgagccaccacacccggccatcctagatgattttttaaacatcacttttctcctggcagaattttctgactctgtagttcttgttaacttccagagaaagccctgagtaagccagaccctaattacaaacatgcctcagtggatgaggctacaatttgagtccaaact

SEQ ID NO: 142466 - DNA, 601 bp, Human
acggtgctgccaatgctacaacacacaggacaccccccactgtaagaattatcctgcctaagttgtcagtagtgctaaggttgagaaactctgcccccaggctaaggtgtagctggactataaacctcttaaggacagaaatcaggtcctgtaccccttttctaagcacagttgaggaaaatagcagggttaagttaaatgattcggtccaaattgtcccaacctggctaaacttcagatccttccccaaagtccatgtactttctctcatagggaatttttttttaatttttaaattttaattatttaagagacagggtctcactctgtcacccaagctggagtgcagtggtgtgatcatggctcactgcagcctcaaactcttgggctaatgtgatcctcccacctcagcctcccaaagtgctgggattacaagcatgagccaccacacccggccatcctagatgattttttaaacatcacttttctcctggcagaattttctgactctgtagttcttgttaacttccagagaaagccctgagtaagccagaccctaattacaaacatgcctcagtggatgaggctacaatttgagtcc

SEQ ID NO: 142467 - DNA, 601 bp, Human
tgcccctcctgcctgcacagagttggcaatgtctggaaacagttttgcctgttaaaactggggaggggcaactggcatctactgggtagagaccaacggtgctgccaatgctacaacacacaggacaccccccactgtaagaattatcctgcctaagttgtcagtagtgctaaggttgagaaactctgcccccaggctaaggtgtagctggactataaacctcttaaggacagaaatcaggtcctgtaccccttttctaagcacagttgaggaaaatagcagggttaagttaaatgattcrgtccaaattgtcccaacctggctaaacttcagatccttccccaaagtccatgtactttctctcatagggaatttttttttaatttttaaattttaattatttaagagacagggtctcactctgtcacccaagctggagtgcagtggtgtgatcatggctcactgcagcctcaaactcttgggctaatgtgatcctcccacctcagcctcccaaagtgctgggattacaagcatgagccaccacacccggccatcctagatgattttttaaacatcacttttctcctggcagaattttctg

SEQ ID NO: 142468 - DNA, 601 bp, Human
actgaaatgttcatgccataaaacaatgaagaccagggcatgtgatataaaactccagactcctatgacatcagtgaaaacaatgagttctgggccgcagaaaccctggggcagtggttttccatcaggggaaaacttgcccctcctgcctgcacagagttggcaatgtctggaaacagttttgcctgttaaaactggggaggggcaactggcatctactgggtagagaccaacggtgctgccaatgctacaacacacaggacaccccccactgtaagaattatcctgcctaagttgtcartagtgctaaggttgagaaactctgcccccaggctaaggtgtagctggactataaacctcttaaggacagaaatcaggtcctgtaccccttttctaagcacagttgaggaaaatagcagggttaagttaaatgattcggtccaaattgtcccaacctggctaaacttcagatccttccccaaagtccatgtactttctctcatagggaatttttttttaatttttaaattttaattatttaagagacagggtctcactctgtcacccaagctggagtgcagtggtgtgatcatggctcact

SEQ ID NO: 142469 - DNA, 601 bp, Human
ttggtcttacccaatcatataaaaaagaatctatacttgaattctaaaggaagatggggaacaaggtctctcttgggttggtttgttctgcctcagtaacttcagccttactgtttcagggataaccatcatcacactgaaatgttcatgccataaaacaatgaagaccagggcatgtgatataaaactccagactcctatgacatcagtgaaaacaatgagttctgggccgcagaaaccctggggcagtggttttccatcaggggaaaacttgcccctcctgcctgcacagagttggcartgtctggaaacagttttgcctgttaaaactggggaggggcaactggcatctactgggtagagaccaacggtgctgccaatgctacaacacacaggacaccccccactgtaagaattatcctgcctaagttgtcagtagtgctaaggttgagaaactctgcccccaggctaaggtgtagctggactataaacctcttaaggacagaaatcaggtcctgtaccccttttctaagcacagttgaggaaaatagcagggttaagttaaatgattcggtccaaattgtcccaacctggctaaact

SEQ ID NO: 142470 - DNA, 601 bp, Human
gacccagaccagcgactgaaggtggaaatgatgctggctaatcatttggatcctttgggagaatcgatgatattctttcagctaatagcttttacttataaatggaaactttaagaaatacaaggtcaataatgataacacatgcattctagcctcaaaaaattagataattagccatcttagccatgtctgatttccttctccctccttttaaggtttcataaaattgcccaggtctaggcttaagcagatcctaattgcaggactatagatttgcccttgcggtttgctgcctggcacscttgtctgagtgtgccatagctgctctggtgggtgacatgcagttgcttagagcaagcccactaatgatgtgattatagaaacttcttggcttccttttgtccctcaagtttccatggccctgacatgttgagcacagggctagatggtgttagcatttttgtctgatgggctcttgcttcattacccagcatctgggcccagtgttggtgccactggctaggaggaggtgaactcaaaggaaccaagaaccaggccaaagccctaagcctgagcccctgtgatgtccccctgcctctgc

SEQ ID NO: 142471 - DNA, 601 bp, Human
ttaaacaaatggttgatttttaacattgttagcaaatggagaccacagaaaaacaagacaataaaacgaaaaggtgacaactggccaggcttatgtgtaaatcattctgcagagaagacactgaggaggggagggaactggagatgggtcagggacattctttcaacaagcttatattgagcaccaggcaccatgccaggcataaaaatgagtaacacgtcagtcatccctggccttaaggagcttgtagtatgtgtataatatgtacgtattgttctttttctattcgtctttgctgtgkggtaataattactctatggtgtgtcaagtaacataacagagatggagacgtggttctggctgcactgagggagattaagtcacctttagagggatggggaggacttccaggaggacgtgattagagttgggtcttgaaagaattttccagatggaggagggagggggcatcccagacatcaagtgtgtgtacttgaaagcatctgccctacagttttgggggctgaggctaagagggcagggatggggctgtggggagatgatgtggaaggatcggctagggccccatcaccaagggtgg

SEQ ID NO: 142472 - DNA, 601 bp, Human
agctacagaaggcacaacagcatctctaggcaacttcctcccagaccttcaaaactgacagctaagttctgatcgttaatctctcttaaacaaatggttgatttttaacattgttagcaaatggagaccacagaaaaacaagacaataaaacgaaaaggtgacaactggccaggcttatgtgtaaatcattctgcagagaagacactgaggaggggagggaactggagatgggtcagggacattctttcaacaagcttatattgagcaccaggcaccatgccaggcataaaaatgagtaayacgtcagtcatccctggccttaaggagcttgtagtatgtgtataatatgtacgtattgttctttttctattcgtctttgctgtgtggtaataattactctatggtgtgtcaagtaacataacagagatggagacgtggttctggctgcactgagggagattaagtcacctttagagggatggggaggacttccaggaggacgtgattagagttgggtcttgaaagaattttccagatggaggagggagggggcatcccagacatcaagtgtgtgtacttgaaagcatctgccctacagtt

SEQ ID NO: 142473 - DNA, 601 bp, Human
caaaaacgaagcagcttgactgagccaacatcataagctgttaaggaagaggaatgccggcgagggtgtcacccgatagttccaccacctcaggaagcccagggcaggaaggtgttgttggaatgctgtccctgccaatcgagacagcaccaaccatcatggaggctcagcttctttgcagaaatgggcttgagtcccattggaggcagatgccaaaacatctgttatctgatgggagagagaaagtcagcgagactttcgggacacagggagaactgtcagggcaaccagagaactagarcctgagtgcgaagccaaagcctgtttcccagcagagcctcggctgggtgagagcgaagcctctaggcactgtagagaacaggcatcaaagatggtacagggaggggcagaactagagaaattcactttcaggttaaagaaatggtttgtttctgaataggaaagaagggaggcgattcccacggaagaacaatgggacagacagtagaaatggagacaggctaggtcacagaggtggcccacgagaggcatcgagtggcagcccaacagaaggagctctggggctggctggtaagagggt

SEQ ID NO: 142474 - DNA, 601 bp, Human
ctctaccatttgtttggtcttaggctgacagacctctagggatgtccacccttggctcagggattgcctgatgaagtacaggaaattgcccatctagggaattcatactgcaatccctccttccgatgctcctttttttttttttttttgagatggaatctcgctctgccgcccaggctggaatgcagtggtgcgatcttggctcacttcaacctccgcctcctgggttcaagcaattctctgcctcagtctcccaagtagctgggattacaagcacctgccaccacacccagctaatttytggatttttagtagagacagggtttcaccatcttggccaggctggtcttgaactcctgacctcattatccacctgccttggccttccaaagtgttgggattataggcgtgagcccctgcgcccggccccgatgctcctttatcacaacagtttcctggctagggcaagacttcacttgagtttttgtttgtttgtttgtttgtgttttttttgagacagagtctcgctctgtcacacatgctggagtgcagtggcacaatcttggctcactgcaacctccacctcctgggttcaagcaat

SEQ ID NO: 142475 - DNA, 601 bp, Human; identical to SEQ ID NO: 21260

SEQ ID NO: 142476 - DNA, 601 bp, Human; identical to SEQ ID NO: 21261

SEQ ID NO: 142477 - DNA, 601 bp, Human; identical to SEQ ID NO: 21262

SEQ ID NO: 142478 - DNA, 601 bp, Human; identical to SEQ ID NO: 30123

SEQ ID NO: 142479 - DNA, 601 bp, Human; identical to SEQ ID NO: 30124

SEQ ID NO: 142480 - DNA, 601 bp, Human; identical to SEQ ID NO: 30125

SEQ ID NO: 142481 - DNA, 601 bp, Human; identical to SEQ ID NO: 30126

SEQ ID NO: 142482 - DNA, 601 bp, Human
gttttatataagttaaaaagagacactagtaacataactttataatttattttcatgaaacctagaaacagaatatctatcaatcttgaaggtccatatgacatagttttaaatatttagccacataatgctaggaaagaaaaaaaacggttttataaaacaaagaaaaaagtttactaattcatacatgattgtttcaaaacatgcaattggtgtactataataattaaaactttactttggcccactttcacaaaaatgtggtcattttggtacttagtccaaaaaaaaaaaaaaaaaacacacacctttctcagaagtaaccacagagattttgtaagtgaaatttgaaaattttgtattaaagttatagtatttatataagataattctaaaagtttgtaaatatattcgtttatgccctgcctgtcactagagctcttattcacagccctcttaacctcctatttactgctactcaagggcccagacaatatgggtttaaaaacaggaggaatggcatctcattaaatcctgttaaatgtcacctcagtcttgccaggctatatgtccaactacccagactcctctctaaactcca

SEQ ID NO: 142483 - DNA, 601 bp, Human
aaattgaggtttatttttcatgataaatatatctatttactgtggtttaagactgcttttcttactaaattctataattagaagcataaaactcaaacagctcctgttcacattttcttatgaataaatgtggaaatcacattttcttaacaaataaatgagttaaattatacaaagtgaaacaactgccacaaaaacccgtaatcttctttaaaacctttaaaacacagggcctttaatgttatttcctatcttttctcagataaatttaattgtgtacttttatatgtatttctacttygttatttttcccattttaattgtgtaaaagttttaagttcctttttcatatcaatcaagttctgcataatattgaaactgctcctttcatagctaaagtgcaataatgttcctaaaattttttgtaacagttactgctgaatccaccatcactttcaagtaactgttaacctcctgtcaacaggaacgctgcctttcattgaattgattagttcactgagaatatttctctacttacccagtggaatagcattttgcctacaagcagggataaatcttcatcagtttctgatttccacat

SEQ ID NO: 142484 - DNA, 601 bp, Human
attgagctattttttcagtcatgaagaaaagcttttacatcaactcatcaaacctacaatcagttttttatagttatttatatttcatattgtcttctagcaaacatcacaatgggctgctacttcaaaatgtgcccagataaacttgcctttaagtggctaaccactctcatttggctagggactcactagcatcctctcccaaacacattagttttcctcaatataggactggaatttgttttcaaactcttaacaggatcattgaaaggaaacaggaagaatactataaaggcaagcytggagtgattccagaggcaagtactcttgcagcaatgcattggaattatgccaaggagggaagtgtttttgcaaatgaacatagttccatggttaagtagaaggtatttaattcttttgtcaacatcaccaaggctaaaaattaagaaagttatgtcataagcaatttacttgacttataacaacgcacacatattctttcgattaaaccataaggcagcatcttgcctcctttaaccgtgtatttttatttttaattaaatgttactataatattaatacctaatttcaagtattcaaa

SEQ ID NO: 142485 - DNA, 601 bp, Human
ccatattttggagatacaattcaagttgtctttatataagctacctggttacttagaacttaaaattatagtgtacaaaaataaaagttaatgttcaagatgttttgaattatagacagaacaaaagatcacccacaatcccactacatggatacattcattgttagactaccatctactctttttcctatgtatattttgcataattctaaatgtcattttatacaaatttttgtttttcattcaaaattattaatagaaattcaaaattcctttataatatcattgatattctatagastaagttcaatcaaggtgatacaccttaactttggacatttaggttattatcaataattaaaattgcatacactgctggtggaaaaaaagggttatgtaaaatattttttaattgaaatgccttcttagataaattaacaggtgtgaaattacttgcttaaaggatatttaactatttgtggcctgtgagatacatgttcatttgttcatcaccatgaggtttctttacttagcaaattccttgttttattattaatgataagcattcattgattatttgctatgtcccacatgctatttt

SEQ ID NO: 142486 - DNA, 601 bp, Human
gtagaagatattatgaaacattttaaaaatccattaggtttatttaacctatatattaggttaatgtcattaagtaagctaatgccatttggtattattttctatatgagaactagtttagcaaataatgatagtaaactactattaaaataaacagggaacatataaatcactggaaatatagaattgcacagtgaattactaatctttcatttatttttctcagaataagcttttattttatcaagcaactccacatatacaagtgttttttagatgtgttctatccctccacacctawccattcacccctaatccctctcctggtccaactctcttttagaaagaatgattcctgccctgcttttttgtttgttttgtttagaaacaaggtctaactgtcaccctggctggggtgcagtggtaccattatcactcactgctcactgtgacctcaacctcctgggttggagtaatcctcccaactcagcctcctgagtagctaagactacagacacacaccactacacctgaataacttttccaatttttgcagagctggggtctcactacgttgctcaggctggtctcaaacgtctgg

SEQ ID NO: 142487 - DNA, 601 bp, Human
ttcctggcagcaaaaactatttctatatattatttgtatattcttatttgttattggtctccatttctctttctcaaattgaaacacaccataacagaactacttcagctttcagaaaaaataaagattaagaactttaactgattaagtactcttataaacatcttggctgagttcctttacagtattgattgagagtggtaattctggaattatacaagtcaccgtccaaatgttacaaaagagactataaccttcagcattgatcaaagtgtgatttattttcttagctctataaaaraggccagaattcaaattatgaaaatgtgccataccgtatgatttgtaatttttattttgaaattactatttatctttccattaaaggaatagtgtagaattttctcaaagataaatgaacatttaatgccagtgtctaaaacactataagagaagatggagaaggaaaaaaaaagaaatcagatggaacagggattgaaaagaagagacactttattataatgaaggatgaggcatattagaggatgaatacatacacagtgatgtcctagtaaataatcttgaaaatcaacaagagagc

SEQ ID NO: 142488 - DNA, 601 bp, Human
cactcttacctcttcacccttaatctatcttcctggcagcaaaaactatttctatatattatttgtatattcttatttgttattggtctccatttctctttctcaaattgaaacacaccataacagaactacttcagctttcagaaaaaataaagattaagaactttaactgattaagtactcttataaacatcttggctgagttcctttacagtattgattgagagtggtaattctggaattatacaagtcaccgtccaaatgttacaaaagagactataaccttcagcattgatcaaastgtgatttattttcttagctctataaaagaggccagaattcaaattatgaaaatgtgccataccgtatgatttgtaatttttattttgaaattactatttatctttccattaaaggaatagtgtagaattttctcaaagataaatgaacatttaatgccagtgtctaaaacactataagagaagatggagaaggaaaaaaaaagaaatcagatggaacagggattgaaaagaagagacactttattataatgaaggatgaggcatattagaggatgaatacatacacagtgatgtcctag

SEQ ID NO: 142489 - DNA, 601 bp, Human
gcaccaggaacccagtttttctttaaatcaaataaatcattactcttaattgataaatatggtcctaaaactctaaattaatcttaattatatgaattctgaagaatatgcaatgttttttaagaataaagaaaaatagcaagatttatcacccccaaagatgggtccaggatagtgttatgtgttcaactgacctaagcagtctacctacgaatattctcatgcgtatgtccatcaatcgatgtcaacattccattggattccagtctgactggcaagcgatactcagttatctattaayattaatgaataataaccgtgccctttaggtttatatgaatataatgtacattgttttctgtgtaaattaccctatattcaaaagcagacttggttttgttattttctttcatattatacactacaaagtggtttttaaaaaaggaagaaaaagaaagtggctgcaataaaaaagtgtgcttaatgtgaactctggtatgtatcagtgttttgtttttctagtcaactttatcccagcttgtaacatataagcttaaatgagttgtattcacaggttcctgaatatgtatgttcttttaca

SEQ ID NO: 142490 - DNA, 601 bp, Human
ctagtaattcagaattgtcttggaaatttacagcttttattagtagaaactgaatcttctctttctgtaactaggcactgcatttagagacagaagaaagccaaacgagcttgttctgcagcacagtcaagctctgcatgtaaaatgtcatgacatgtaaacaaaaataatacaaacttaaatttctgtcaaaatggtaaaactgtggttattgtgaaagtcaactaaaaatataaagtggataaggatatatctttacttatttcacacacacacacacacacacacacacacacacacctctgtccgtcactcactttttgaagtgtcagataacattatttctcaaatgacacatagggcttcatttgctatgcataaggtcagtgaatattagcttcatttacacttggctgagaatcggttggtgtcaacagaagaggcttagttcctccactaaatagggttagaatctgacagaaagctgccactgaagaagatggatgatcctccttgctgacccttctcctctgaaagtgtcatagtttgggtctctttctatctctacaacaaagaccctctctgagcttcccagtggcct

SEQ ID NO: 142491 - DNA, 601 bp, Human
ttcaggaacaatgccaggaggaaactatgtaagatctcatctgattttagatacttgtcaaaaaagaactaagaagagaatatcttactgatgagatgctgtctttttaagtttggtagaacaaaaagcaagttcacttctttaataagtacaaataaacaagactgatgaggtgaacaaaaatcaatccacagattccaaaaattttacaactgtttattttcagttcaaacatgattgatgtcaattagatgcagatctgtcctggtgattctcaggaaatctaccgtgtcagataatyaccttccgtgaaactcagaaaatccagtgctatgctttaacctatcttttccccaaatccttaaattccatacattctttaaaattatttaatttttatcactatttttcatttctgctaatattaatattttacttacaaaatacagcaaatacttaatattttttatgtacagcatttttcttattactggcatattttaaactttattttttgtgagaattttttttacagtactatggaaaatccttccaaacaagaaatgcataatatgcaatttaaaatataatccttagtaag

SEQ ID NO: 142492 - DNA, 601 bp, Human
tctctaagctcccagggcaaaggggtagaaacttacttgacagcagcatgaaatgccactttgctttctaaacctcagtgttactaatctaatatgacttctgcagatcataaagtacaattggccctttcaatttagattcgaacacctggctaaatccattaaccagtgattccatgaagccaaatccactgccttttagccaaatcatatttttcccctcttttatggaaactctttgaatgaggtttctgaaaaaaaagtccatcacaaattaatgtaaaaaatgcacagcaaattrtatctgtactccagacagctttttcataaatttttacgagtagagttaaactagactgtgtagatcacttatacaaattatctccataataagaggctcctgtcatttctgagtgtatgtgtttgcatgtaattgtgtccatcggatttatcttgactttttagacaaactattgcaattctaaagatttgaaaattagctcaatttaatccaccaccacaaccaccattacaactactaacaataacaaaacttctcaagttattctttgttatcgtactacttcaaaaataatggctt

SEQ ID NO: 142493 - DNA, 601 bp, Human
atctctaagctcccagggcaaaggggtagaaacttacttgacagcagcatgaaatgccactttgctttctaaacctcagtgttactaatctaatatgacttctgcagatcataaagtacaattggccctttcaatttagattcgaacacctggctaaatccattaaccagtgattccatgaagccaaatccactgccttttagccaaatcatatttttcccctcttttatggaaactctttgaatgaggtttctgaaaaaaaagtccatcacaaattaatgtaaaaaatgcacagcaaatkgtatctgtactccagacagctttttcataaatttttacgagtagagttaaactagactgtgtagatcacttatacaaattatctccataataagaggctcctgtcatttctgagtgtatgtgtttgcatgtaattgtgtccatcggatttatcttgactttttagacaaactattgcaattctaaagatttgaaaattagctcaatttaatccaccaccacaaccaccattacaactactaacaataacaaaacttctcaagttattctttgttatcgtactacttcaaaaataatggct

SEQ ID NO: 142494 - DNA, 601 bp, Human
tcaataagatttctgtatcatttccagccacatttaccaaaatacaaacccagaaagcaattcttagaataacaattgtagctaacatttattgatatcttaccatgagttagacagtgtgttaaatgctttacaagcatcatctcatttttatgcatatttattgtccattttctatgtgctagtactttgtgtgtattacatcacttgttccatacacaacctcttgaaatagatactgctaatatttcccactttgaaagtaggagacaaaggtcttgagagattaaatagctttcgytttcacacagctaatcacgtggtgggttctggactggcacctctgtctattcgtctggaagaaatattcttgataattatttacttactttaatagggttatgctgtcaatctaatctgaaatatgtctcaaaaagtctcctgaaaatggaatacttatttacgcattacaaaagatgcataaaagtaaagtatcattaaattcttgtcagaggaaaaataagcaagtaaaaatagaacaaacgttggaataaattagctataatttcaatcctaaaaattatgaactgccacaaaagta

SEQ ID NO: 142495 - DNA, 601 bp, Human
tacataaaatggcacatttactattagaactcatgctacccatttgcatgttgttctataaatgaaattcattcccacaaaacaatgtaactgattgcaaatgtataatggtttattagtaacagcaatagctcaagaactagtattaatagaagagaaaaaatatatgtgtacgcatatgaatatataatagatatttacatattatgtaatacagtgtgtctaaataatccacctctatgtcatctagcagtcagaaaggaataataaaaatcaaacgctttcatacttttaactccckcaaaacttgttttccttctacatttatagtagtatattaaataaattggtccagattgcattttttaatttatactggaatattcttgaaaataaaaaaccctatatttattaactacaatggtatctcatatttttatttaacaacaaccaaaaaagtacttgcaccccacttattaatgagactgaagaatgagacaatgatgggtaattttgtcttgttctactcccatgaggctttttctttgtaaaattatatataaatatattagatatacatagagatggtgatgtgtggatg

SEQ ID NO: 142496 - DNA, 601 bp, Human
gatattagttttgatcataaaaatcagagagggcttcctggaggagtaatagttgaggtttttctttttctttttttatagacaatgtcttgttgtcacccagtttactgcagtagtaccatcatagctaactgtagcctcgaactcctgggctcaagccatctgcccacttcagctttcatagtagctgaggctacaggagtgtcagtgtgcctggttaattttttgtacagacaaggtcttgctttgttgcccaggctgatctcaaactcctagcttcaagggatcctcctgcctcagycccgcaaagtgctggtattacagatatgagcaaccatgcatggccaacatgagtttttggaggacatataatatataaaccttttatgaggagatggaagaaaatcagtatcaggaaagtaaaataagcacactcaaaaatattaaaattattgaccaagttagtttggctgaagtgaatttggcttaaaaagaatagttaaaaaataaactcagaaacctaatgtcatgtgttacccttaatacatctcattgttttactaaacactagttctacctccataatgtgtccctaacacat

SEQ ID NO: 142497 - DNA, 601 bp, Human
attctaagaaaaactacttgactttctgaatgaccaaggagattttagggaaagtgagtatttgaaactgcttccgtctctttgtccactgaacccaatcaacaagtctttatcctgttttaagagcccgatgttaagagagcttaatttgatggacccatcatttaaaagaaaatctccattccccactcccttaaatattctaaataattcaaacataaactctcatgctacccaataattaacacttaccaagcatttattttgttccaaggacattacactgtagtgtgtgtgtgtrtatatatatacatatatacatacacatatacatatatataaaatatacaatgacttatattggaactcgtgtgtgtgtgtgtgtgtgtgtgtgtgtgtacaatgacttatatcagaactcattttgtgtgtgtgtgtgtgtgtgtataatttaatgttaataataatcttggatgtcactcaatgcatagattctatcatggttcctcagtttaacgtgaggaaacttaaagttatgtgagattaagtagctcgcccaaggtcacagctggtaagtggtagagtaaacgctggtccctga

SEQ ID NO: 142498 - DNA, 601 bp, Human
ataaccacttacagtatataatacaaaagcaatatgcgacaataaaagcattccaccatggtaccaggcattttaatccatttttataaagaacaagaggtataaagagttgaacagaattttttaagatgtccggagaaagaaatatccattagtaagtggcattctcactgggattgcatttcgtgaatattctccatcaaaaagatgagaatatcagtttttacacattagttcaggaaagtgatagtctgaaattagagctgctaaaaacaggcaggtactgtgaaattcaaggaawtgctgcagcaaatagctaagggaatgaaaaaaggataaaattctccttatccttacaaaattggcacattattccaagtgaggtaacaggcagaacctcacagtagattaaagggaatttgaggacaaatgtttcattcaataggcctttctatatagcagataactttccacccagtaaagaagagccttgtcttttattaactccatttgaaggtttgtgttactattaaaaaccctgttttttcacttattcatgaatgtattggcaagtacctctgcatcactcataaaattcaac

SEQ ID NO: 142499 - DNA, 601 bp, Human
ttcttgcctcagtgacaaaacagatttcattctccagcaacatttttaaaaaatccattattaatccatttaaccctttcaatctgtaggagcagtacccaattatcttagaaaagcaaagagtaaagaccaaacacatcaaatctaataatatctctcataattcctgcgctccagttctaaactgccacaagacaaatactttgggagggggaaacgaaaatatagtttaactcaaactgttaaaggcatgaaatgtgaacaataaccacttacagtatataatacaaaagcaatatgygacaataaaagcattccaccatggtaccaggcattttaatccatttttataaagaacaagaggtataaagagttgaacagaattttttaagatgtccggagaaagaaatatccattagtaagtggcattctcactgggattgcatttcgtgaatattctccatcaaaaagatgagaatatcagtttttacacattagttcaggaaagtgatagtctgaaattagagctgctaaaaacaggcaggtactgtgaaattcaaggaaatgctgcagcaaatagctaagggaatgaaaaaaggat

SEQ ID NO: 142500 - DNA, 601 bp, Human
tggtggctcacacctgtaatcccagcactttgggaggccaaggtgggcagatggcttgagctcaggagtttgagaaaagcccaggaaacatggtgaaactctctttctaaaaaaaaataaaaataaaaaaaatagtgagatggcatgtgcctgtagttccagctactcgagaggctgatgcaggaggatcacttaggcctgggacacagaagttacagtgagcctagcagagagaccttgactcaaaaaacaaacaaaaaaaaaactccaagatttggaagcctgaattaaaaaaaaaaaacaaactcctaataggcagctagtatagataaaaaattcactaatcaaaaaagtaatgaaaaaagaatagagttctgtgaaaatataacttacatttgaagtcagttcatgctttttctttgctaccctaaacagtgatgtaagtctctatacacaatttgctgttaatctgcttcccacctaacctaaggaatctgacaatttttcttctaaaggcaactaagaaaaacaaaagctcccattttcctcattcatgatcacaaaaggaaaatattttagaatttcttccattgttatttct

SEQ ID NO: 142501 - DNA, 601 bp, Human
aattttattaaaataatcacaaattctactttattgcttcaatatcaaaagggaaaaattacaaagttaacagacatctccaagagcaataattcttgaccttttcttaaaatctaaatgttctgtgtaaagtaattgttcaataacttggtcatgtgaaaaaaagacttgagtcaagaacagaagccctgacttcttagaaatggtgaattccataaggcaggtcagggaaacttgcgtgtaatttagtacttttacactgcatttcttatattcaatatcatttgtgaaaattgtatgsaataggttctcactcttgccattgacttctactcatgattctctggaatctgatatttcatggttttgccagttgtttaccatataggattatcacacagtattatgtgagacagtttaattagagagcttagatgatggtatcaagattagtagtatttttagctctcatgattcaccaatatctccaaagctatttctgtagaatgacaaaggtttatgctctatttgtcactcttcttttttttttctggtgtattctctttcgaataatcacaagcttaacataagtgtgccattt

SEQ ID NO: 142502 - DNA, 601 bp, Human
gttgatgaaatgtgttgagtgactaactcaaaagcattgtgcttgcagctataacagcctaagtgctattcaatatggttaaacattccacttttcacatgaaaaatataatagttaagtttatacattggctttgccttaatatctatatcatgatttcattaattttttagtaaattacttcttccactacctttttaaacaaaattatactaaaaggagatggagaattctgaaaatgtagtacttccttctgaattatggtatatactcttacaatttagagtgcatatgtcttcarcaattgtcaaaatagttgtctggattaaaatacatacattttctgttcaaatatttaattgtgatacatgattatataacagaagatatatttgtattttgacatatagtcaataattatagtaatatatctttggaattaacagctagaaaccactagttctctttatattatatttaattttattaaaataatcacaaattctactttattgcttcaatatcaaaagggaaaaattacaaagttaacagacatctccaagagcaataattcttgaccttttcttaaaatctaaatgtt

SEQ ID NO: 142503 - DNA, 601 bp, Human
acaatatttttagaatcaattttttttcaacatttaagttaaattacccttttgggtaaatgttcaaaagactgataagaaaactagttttacatgcatctaaataaacagaatatctaaaagctaaggggtgaatgatttatctttatattacttaggaataatcaagcattgtataagaacttattaaataaacatttgtgagtggatgaacaccaatgataaaggaggtatctgatgcttgaacatttcctttatgctttcatttcatttcaccataatgagcatactacctatggcrcagcaaaacaaagggtaatacttgccaaatatcagcaattacagaaaggggagttacaaccttataagagtatgactattccttttgccatttttcaacatgattattttgcagtttaagttagcagctgtttaaataagaggctagaaagtgaatcttctcatgctacagatgttaaaagataatgtctagacatagaatcaataaggttttaaggtttttgattttcccagactgaaatcctactcttatcatatattagtgttgaatgctataaaatatttcacaaagttagaattt

SEQ ID NO: 142504 - DNA, 601 bp, Human
aaccctgtctctacgaaaaatacaaaaaaaaaaaaaagaaaaaaaaacttagccagccgtggcggcgggagcctgtagtcccagctactcaggaggctgaggcaggagaatgctgtgaacccaggaggcggagcttgcagtgagcccagatcgcgccactgcactccagcctgggcgacagagtgagactctgtctcaaaaagaaaaaaaaaaagaaaaagcacagtcagctctctgtatccactggttctgcatccatggattaacccaaccatggataataaatatttggggaaaaaaataacaaaaaataatgcaacaatacaaaaatacaaattttaaaaacaacacaatataacaactacatgcctagaatttacactgtattagatattgtaagtaatctagagattatttaaagtatagaaaaggatgtgtatagtttatatgcaaatactatatatgccattttatataagggacttaagcatctgtggatgctggtatccaaggggatcctgtaactcaccccccttgatactgagaggcaactgtaatgacaagcgctacaaagtattagactcaacacctatgtgtgcat

SEQ ID NO: 142505 - DNA, 601 bp, Human
atggaggggcacgacaaaactaaaggtgaaaacttatttatatgtacatatactactttacatttttcaagttataaactaggcaaaactgtaaagtaccttaatattcagagtgaactcagaaaaagcacagtcggcaaggcgcggtggctcacgcctgtaatcccagcactttgggaagccgaggcaggtggatcacgaggtcaggagatcgagaccatcctggctaacatggtgaaaccctgtctctacgaaaaatacaaaaaaaaaaaaaagaaaaaaaaacttagccagccgtggyggcgggagcctgtagtcccagctactcaggaggctgaggcaggagaatgctgtgaacccaggaggcggagcttgcagtgagcccagatcgcgccactgcactccagcctgggcgacagagtgagactctgtctcaaaaagaaaaaaaaaaagaaaaagcacagtcagctctctgtatccactggttctgcatccatggattaacccaaccatggataataaatatttggggaaaaaaataacaaaaaataatgcaacaatacaaaaatacaaattttaaaaacaacacaatataacaact

SEQ ID NO: 142506 - DNA, 601 bp, Human
tgtgtcatattaatatctatgtttctataaggcaaaggggaaagcacagcttatagaaatagtactcccactgctcaaagaactgacctcatctgggatggacagatccagaatctgtgttttaatcctattgactatgcctcagtgggaataattacaaaagtctgcctaaaatacagacctcctgtcactaatattctatgatttttcacgttgagaatgaacagcgagcagggaggataaaaacaacatgatgtaatgagtacattatggtttgtggaacaacatccctatcaccctrgaactaacatgcaagagtttagaaaagacagcatgcagaatataaagtttttcataacaggtacttaagtgctcgatgataacatggggatttttaaaactaacaagaaaaactcatttcaaggcattttacgtgtgtgtttgttattaatttgtgttatttaattatttgatgttttattaataacatatagtggaaaagaaaaacatgtaaaataagaagctttaaaaagtttcgtttctaaagtttagaatgtaaaatgaaataaaacaaagcattatgtgaacacatctttactta

SEQ ID NO: 142507 - DNA, 601 bp, Human
tagccaaaaccttagaacatttaattccgatatataattcaaatttaacttggatttcaacataattaactgtttgttggtctgcattagaacacttcaagttatgttttcttaatataatatagctttaaactaacttttgacatgttgatttggttcatgttgaaaaacattaatgtaactttaattaccagactagaaataaataactatgtaaaatttttcacctgaaaatgatagaaatatattttcccaaattttcaggaaactccaagatagaatttcaaccaatttaagttayaaggcaggctggtttccactaagtgaacttctttgttactaaaaataatgaaatcctatgaataggagatggctgcaccaccagaaacaaggggaaagccatcaacggcaagtagattatggccctgtttgtcctctgccgagagagggttagggtgcaatcacactaacacagcaacttttctcagcaacgaacagagatggacagcgagcatttctgccacctcctaatgaagttgctcttattcatttagattctataattaaatccagtaacagtgtaccatttaatatcactgga

SEQ ID NO: 142508 - DNA, 601 bp, Human; identical to SEQ ID NO: 30127

SEQ ID NO: 142509 - DNA, 601 bp, Human; identical to SEQ ID NO: 30128

SEQ ID NO: 142510 - DNA, 601 bp, Human; identical to SEQ ID NO: 30129

SEQ ID NO: 142511 - DNA, 601 bp, Human
acgctaatctccatataagtatttgcttcctggggagcccaacttgagaaactatccctaacctctttcaagaggtttcagttttcatcctaattccttccagatgctttccagagcgttaaaatagttatcactctcattaagaactgtagtatatgtacagtatcactcacctattaatagtgtacagtgaatagtgtagcatagtgatacgtttgtactctatactgagttactactttatttatttagttataaatatatgtggaggtctgagaggtcttatgtcccaaatctctcmgttgcctatggggaaaatatgaggccaaaaaaggtgactcaactttgacactcttttcatgcacattttacatttcaaaaagtaccaggaacatagtaagtgttcaataaatagtaatattttaattactgctcttataattgtttcaggacagtaacacacctttttattctaataaatgtacctggaattaagctatttgctcaatttttacaatatgacgagtcaaatagtgtaccacttgaggagaaaattctagtataaagaggtgaagtaacttgtctaaaatcatgtaattat

SEQ ID NO: 142512 - DNA, 601 bp, Human
agagacctttgaagatagttgagatgtctccacaccctgatggcagattctttgaagctttcttatattttcagaaactgtatgttttgcacattttttccacagtaacactaggcaggaatttttttttttaacaaacgactatatgtaatatgtgaaatgtactgcggaagatacacaaaagtttaagttaaaccagggtcaatctgttactttcctgttcaaaaacactccggtttccccgctgtctatcagaaaagattcttttcctaaaaataaaaattccccagtaatctttccyacaaatctttattcatccagttcataccattattccataatcacactctgaatgctgccactcttattcttttgcataatttaaccctctataatggatattgtaatgggctgcccacattctccttagaaaagcactgaagaaattatttgcccagctgccgagatatttgccagaaaacaggcctcagttccctgcctcatttagaatttcctttctgaaaagtaacaccttgctcactcctaggaaaaactgcaacccatgtctggacaacatagacgtataaaactgtcacctagg

SEQ ID NO: 142513 - DNA, 601 bp, Human
atggtaagattgcataaacaataattttgaggtaagaagtgtatttgattgcaatcatttgggtcatcactatataatttaccgtgtgacctttgtaaagtcattcgaaccctcaaaattttacttttaaaatgatatcagttcttgtcttaacaactccacaaatttagttcaaattttaatataatctgagtgagtgtcatatagatcattcatccatacacaacaaaattgatgatggggataaaacataattctttttgagagactctaaagagacctttgaagatagttgagatgyctccacaccctgatggcagattctttgaagctttcttatattttcagaaactgtatgttttgcacattttttccacagtaacactaggcaggaatttttttttttaacaaacgactatatgtaatatgtgaaatgtactgcggaagatacacaaaagtttaagttaaaccagggtcaatctgttactttcctgttcaaaaacactccggtttccccgctgtctatcagaaaagattcttttcctaaaaataaaaattccccagtaatctttcccacaaatctttattcatccagttcata

SEQ ID NO: 142514 - DNA, 601 bp, Human
caatttctcgtgtaatggattatggagctacatttttaaagatagcactctatggtaagattgcataaacaataattttgaggtaagaagtgtatttgattgcaatcatttgggtcatcactatataatttaccgtgtgacctttgtaaagtcattcgaaccctcaaaattttacttttaaaatgatatcagttcttgtcttaacaactccacaaatttagttcaaattttaatataatctgagtgagtgtcatatagatcattcatccatacacaacaaaattgatgatggggataaaayataattctttttgagagactctaaagagacctttgaagatagttgagatgtctccacaccctgatggcagattctttgaagctttcttatattttcagaaactgtatgttttgcacattttttccacagtaacactaggcaggaatttttttttttaacaaacgactatatgtaatatgtgaaatgtactgcggaagatacacaaaagtttaagttaaaccagggtcaatctgttactttcctgttcaaaaacactccggtttccccgctgtctatcagaaaagattcttttcctaaaaa

SEQ ID NO: 142515 - DNA, 601 bp, Human
tttgttgctataagaaaataccacagactgaggggcttaaattgaaatttgttttctcacagttctgagggctagaagtcccaagtcaaggtccaacagatttcagtttctgctgaagcctctctttctggcttggggatggccatcttcttgctatgtgctcacatggcctttctcagtgtgtgtggaggaaagtatacagttacattgggggttagggcttcagcataggaattttgaggggacacaattccatcacagcagtagaataactgggttattgcaaaaaatgaactcttgyttcccaagtatgtaaacatcattatttacaaagtagcaattcaaagatcaaataatttaagaaaagataaagaagcattaaattggaaatatgagacgcaacttaaaacactctatactaggattttttcaagagtctactaagagcatgtccattaaacagtatgcagatcaacttgtcaccataacctcaacataagcctatttcattacaaatattaaccatatcagaaaaggatagttttgacaactcagaaagatactgggactggagatcagggagttgaggtggcaagattag

SEQ ID NO: 142516 - DNA, 601 bp, Human
tattattttagtagatgaatattcagcttacttacaatgtctactacataaactcgcaattgcaaaataaacgatcttctattaagggcaatgcatgtaataagaattactttacataattccatcattatggactattccaggataatgatcctaatgggaagtcatattttttgaagaggatgcttaaatttagcaaattacaaatttgtatctccaaaatatagagctataaacactttttcctaagaaaatcctgaaatggtactgacttcttaatcttgtagaaattattaggttraaattgccaagaatttgacaaacttacccaagcttcaaaacttgggaacaaaatttattataacttttatattggatgttctgttaccatcaatgtatcaccttctaaaatttattagatgattaactggctctgttaaaaaataaaaacctgtcttggacattgaaaataaaacattactattggtcattttctgctacttacaaaggtactgcactaaacaagttaagggttttttggaggggaaaaatcataaaaatgcataaaatttctaccactgtcatttcttgtcccataaat

SEQ ID NO: 142517 - DNA, 601 bp, Human
atgcagcttattgatttcttgctcttaaatgaaatttttctgaaactgcgtctgtctccacaatgctaccgcttcaataacacttagagaaatgggcacgatagctagctacataaaaactaattcatgactcatggaacaaaacctgtttgtaccatagaaccaagcaaatcaggtaactggtttcagtcaaggaaggattaaccaaaaacacttctttagtcaatgtatattggaaacctattacaaatgtgttagtttgtattcttggcagggtattactaaaatataacatatttgwtattttttatgatttataattgtttactatctccagaaaaagagactgtattcaatatatatttacctaaggttatgccctgaaaaactgtgcatattttatttaagttcctcctgttaacttgctttttgtatttttcccctaaaagtaaagagcatgtggtccagttagtcacattttacttaaaacagattttctatatatcacttgaacaaacttctttactctaaagtggctatttatttgcaaatattattttagtagatgaatattcagcttacaaacttctttactctaaag

SEQ ID NO: 142518 - DNA, 601 bp, Human
cttccatcctaactatttgttttctcaaaacttttttgtcacacttttaaattatacctccactcctcttccccggagaggccactcattaactcaccatctataggcaaaagattcctaaagctgtaacatttaagccctaccaccattcgaatgcccattctcttaggaatatatatgtactcataaaatgtatgaggttaaagaacatatgtttattactgtctatacatgtctatacacataaatacatcagttcacagtgttatagtctgacgtaactagagttaagggtgctgartttaagagtattagcagtatttgaataatacaatagtgatatggcttaaccagttttgtttttatcatcatatacaatttccattatggatgctatgctcagacaacgttctgcatctttctatatgctgaagttaatgacgaaatattaaaaattaagacactaattatctgatgtcaacacgctatggataattaagaactgcatgctttaaagctatgctaattgtttttcacaaatcttcctctgtagtccttgtgtcttaaacaaggcaagcagctacatgactgtatgtacatc

SEQ ID NO: 142519 - DNA, 601 bp, Human
tttaaaatctactggagaaagaagagatatatgtctatctatctatctatcatctatcatctatctagcataacacagtctctgtattagatgtgtataaacagtcctttgatgttatagcatttaatattaatgatactatcttagatgacagatagttataaatgcatagtttatctttgtacaattaacatctttctttttatgacctttatttctgagattatcaggttctcaacaatgaaatttgtgtgaggctatatttgggttcttggtgatgtcagggatgtgagaaaatagsatgagatgtcaaaacaaggagaaaacaaggttatgataatgtattagaaaagaacaaaggcagtaattttttccaaacataattcagactcattctctgtcttaaagtctttaccagtctgataaatgttgtatgaaatcagcataaaaagtaatctattacaattcaattcagccatcattgagctgaatactctactacgtatgccatagtgtcaggctttgcttttgaccatggtaaacatcattatgatagtttctacctcaagttatcagtaaaaactgtttctcatggttccaa

SEQ ID NO: 142520 - DNA, 601 bp, Human
aaagatttatcagtattaacaaatactgcacatagcaaaaataaaatttccaaatttttaggtggttatactttttatattggcaagtacatgatatgggacatataatttaaaatctactggagaaagaagagatatatgtctatctatctatctatcatctatcatctatctagcataacacagtctctgtattagatgtgtataaacagtcctttgatgttatagcatttaatattaatgatactatcttagatgacagatagttataaatgcatagtttatctttgtacaattaacwtctttctttttatgacctttatttctgagattatcaggttctcaacaatgaaatttgtgtgaggctatatttgggttcttggtgatgtcagggatgtgagaaaataggatgagatgtcaaaacaaggagaaaacaaggttatgataatgtattagaaaagaacaaaggcagtaattttttccaaacataattcagactcattctctgtcttaaagtctttaccagtctgataaatgttgtatgaaatcagcataaaaagtaatctattacaattcaattcagccatcattgagctgaata

SEQ ID NO: 142521 - DNA, 601 bp, Human
gtgtttaatgcagcaagtgtaccagaagtcacttacaaattatattaatatctgacgtttgttgaaataagataatggctttctgttctttgtttatataattttcaaagataaaggaaatgtgtctaaaaataaaagatttatcagtattaacaaatactgcacatagcaaaaataaaatttccaaatttttaggtggttatactttttatattggcaagtacatgatatgggacatataatttaaaatctactggagaaagaagagatatatgtctatctatctatctatcatctatcatctatctagcataacacagtctctgtattagatgtgtataaacagtcctttgatgttatagcatttaatattaatgatactatcttagatgacagatagttataaatgcatagtttatctttgtacaattaacatctttctttttatgacctttatttctgagattatcaggttctcaacaatgaaatttgtgtgaggctatatttgggttcttggtgatgtcagggatgtgagaaaataggatgagatgtcaaaacaaggagaaaacaaggttatgataatgtattagaaaagaacaaa

SEQ ID NO: 142522 - DNA, 601 bp, Human
tggcacaagaagtattttacattgtcattattaaataaagtcctcctggatgtgctgttaattctttattgccagtacatttatttacagtgtaagaacaataaaaaatactgttttataaggatggcagggtaatttcagttacctagaaggatactaaatctaatttctatattgagttatcgtatatatgtttattatgcatctaagagaagaaagatgaaacaaaatatccaattaaatgacagttattagaaaatatggctttacatgttattcatttgcctactctaactaatgmacacgtctttactgatatgtgtaaagaaaacacatattgtctgcaagaacaaacttcatgctgaacaagaaaatcgtgtcatccagcagatggcatatggaattcacaaaaaaatcaattactattagaagaaataataataacctaagcataaaagttgaacactttttgttctttggaaaactttgaataatactgatctacaacagttactacaaaccctcaaatagtcatttgacttttccaaaactttatactttttaatttaaacttgaaaaacatccaaaatttgaactcaaa

SEQ ID NO: 142523 - DNA, 601 bp, Human
agcacacataattctgaaggtctgtctgccagcaataaaggccgaaattggatacttggtgagattaattacctagatagggcttgataatgcaagtcaaatgggaatgtaattaaagtgcaccttccatgaaaattattcattgctgatggatcaggtgacagataaatcaaaaggcattttttaaaaagcctacaggttaacttgaagcaagtctttcctctttttaaaactctgtaattgcaggtgtggaattcactcttgctgtcctatcctcatcatgataccataagacaaaaaagtagattgtaatgtaatctattagaaatagaagccaatagaaaaaccattaggaccatagttacaaacaaaaggtcacctagactggaaccagttggctggcagctttcagaagagagtatcactctatgctcatactataatggagattgcaaccataaaaaatgacaagtgatgaattaataagttgactagtccctagggtgcaattcttacagataaaggcatgctggagtaatcaaatagagttataaattagataaatagaatggcacaagaagtattttacattgtcattatt

SEQ ID NO: 142524 - DNA, 601 bp, Human
aatttattcacaatatctaagagaaaaaattcataggcatactttcaagatttggaaggcctcagatctctttcagggcctgcctggtgaaaaaggcccaagacccactcaagcacacataattctgaaggtctgtctgccagcaataaaggccgaaattggatacttggtgagattaattacctagatagggcttgataatgcaagtcaaatgggaatgtaattaaagtgcaccttccatgaaaattattcattgctgatggatcaggtgacagataaatcaaaaggcattttttaaaamgcctacaggttaacttgaagcaagtctttcctctttttaaaactctgtaattgcaggtgtggaattcactcttgctgtcctatcctcatcatgataccataagacaaaaaagtagattgtaatgtaatctattagaaatagaagccaatagaaaaaccattaggaccatagttacaaacaaaaggtcacctagactggaaccagttggctggcagctttcagaagagagtatcactctatgctcatactataatggagattgcaaccataaaaaatgacaagtgatgaattaataagttg

SEQ ID NO: 142525 - DNA, 601 bp, Human
gcacaggtcctctacatacaaaatgacatgcagattggttatacctagaagtgaaaggtgactcaattttaatatcattttcatgattataataatctataggtttctttgattatggaagtatatttgtgatgccaaatataatttaatttattcacaatatctaagagaaaaaattcataggcatactttcaagatttggaaggcctcagatctctttcagggcctgcctggtgaaaaaggcccaagacccactcaagcacacataattctgaaggtctgtctgccagcaataaaggcygaaattggatacttggtgagattaattacctagatagggcttgataatgcaagtcaaatgggaatgtaattaaagtgcaccttccatgaaaattattcattgctgatggatcaggtgacagataaatcaaaaggcattttttaaaaagcctacaggttaacttgaagcaagtctttcctctttttaaaactctgtaattgcaggtgtggaattcactcttgctgtcctatcctcatcatgataccataagacaaaaaagtagattgtaatgtaatctattagaaatagaagccaatagaa

SEQ ID NO: 142526 - DNA, 601 bp, Human
ctccctttatctatataagtcagatcaattatattcgccatattccaattcaaaatggtgttacagggaacaataacaattactgagaaatataaattctcatgattcctaggttccaaagggaaataaacatagggacagatgttaataagccacaaactctttgtttagctatatatgcctgattattacaggaagtatgtcaatactatataaacaaaacaatttctttaaaaatgtaaaatatgaattcatatatattcaaacaggatatatacatatctgagtgtgtatgtatacrtgtgtatatgtgtatgtgcatacataaactttactacagaattcacaatagtaaatcattcagtaatgaatcttcttgaccaatttaaattctgagttaacctactgtgtggtttgtaaacaattatcatgaatgtatctaatgaaaacattattaaattatcacatcttcattctagaaatattatggatacaggtttagaatacccgatctgaaaatttaaaatccaaaatgctccaaagttaaaaagaattttgagcaccgaaatgatgctcaaaggaaatgctcattcaatcattt

SEQ ID NO: 142527 - DNA, 601 bp, Human
ctcagaaagagaagtaagtatcacaggatggaaaaagcagcagcatcctggaagcaaataaatgaattctcaggaacagcttgctctttgttcaccgtttatatgactcttgtgacactggaataatgatttcatattgtagcatgctttttcctctgtacatagttccttaccaccaaaacaaacaggaaggaagaaatggagtgaggatggagggaggtgaggaaaagagggaaggagacaaagaaaaggagggagggaagaagaagcattgggagggagagaacaaaagggagataaytcatcaaacagtacaaaagtcttgaacagaaagcctaagaatatcatcatgttgcccccaaatccccaccaacagcctctgggagtagaaatgtaaaagaaaaaacaattttctgcggttaaggaaagtctgggactgctgtcattcatatgcaattccatccaaattcagagtgcttgaggaaatcacatgcttctctcttctctctcttttcttgtgttttacattcttcagcttcctaattcttgctttttacatttaatagtttgaaatagtctaagcagggtgtatgtgttagtg

SEQ ID NO: 142528 - DNA, 601 bp, Human
gctattttttttatttttagtagagacggggtttcactgtgttagccaggatggtcttgatctcctgaccttgtgatctgcccgccttggcctcccaaagtgctgggattacagtcatgagccaccctgcccagctccttttacccttttaagaacagaagtgaatagttcatccccaataccagttccaatagcagccactgctcaagtaaccaagagtaacctcttgctttgaatggcatccttcttccaacttaacaattttaccataaatttgaaggatcagtggagtaatataaaytggatagtttacaaagtattatttttgtaaaaaaaaaaaaggaaaaacaaagaagcttttatcagccaacctattccttttgtttgccctctataggggtggcagtttgaagtagttagaaaaaagacataaaaaggaagtatcaatgactaattaaaagtggctgctggttttgttttactgtgtttggctgaatgcacagtcagtacagtgagaatcttcacagaaaataccttaaacaacagaagagaatattgctgctgtgttttcaaatccgcaattcaaagttccacttttctc

SEQ ID NO: 142529 - DNA, 601 bp, Human
ccttttacactttgttgttgttgttgttttgagatgaagtctcattatgttgcccaggctggagtgcagtggcacgatcttggctcactgtaaccactgcctcctgggttcaagtgattctcctgcctcagcctcccgagtagctgggactacaggcacgtgccaccacgcctagctattttttttatttttagtagagacggggtttcactgtgttagccaggatggtcttgatctcctgaccttgtgatctgcccgccttggcctcccaaagtgctgggattacagtcatgagccaccstgcccagctccttttacccttttaagaacagaagtgaatagttcatccccaataccagttccaatagcagccactgctcaagtaaccaagagtaacctcttgctttgaatggcatccttcttccaacttaacaattttaccataaatttgaaggatcagtggagtaatataaattggatagtttacaaagtattatttttgtaaaaaaaaaaaaggaaaaacaaagaagcttttatcagccaacctattccttttgtttgccctctataggggtggcagtttgaagtagttagaaaaaag

SEQ ID NO: 142530 - DNA, 601 bp, Human
attggtttcaaagtgtatttacagtgaagctcaattgcttgtcagcatcatggctaagattaagtgtagtacagtggagctcagtggacccggtggaaggtgacaaggagaactgaataaagcaagcaaaaaataaacaaaaaaacttgagaaaagcaataatttgataaaaatgttaataaaataaaataagtacaataatggtaactataactcttttcaccccaactcaggcaaattatatttctagtaagtactataaataatgaacagttatctacagaacatgagctttgtatayttgtaatcttttatctgatacatacttatattacaaattccatctctctctttgctaagtggcttatatatttttatatgcaatttataggaactcaattataatgttaaatttaatttttgtgctatatggtaatatatatgtgcatgacaaaagtaaacaagtttataaaaacattgtttattgtgcacattggattaatacatctcaaattctgaagacaaaagcaagagctatttcagaaaatgccttaaaatttcaatacaattaagtaaaaaatatgatttagagtatttttga

SEQ ID NO: 142531 - DNA, 601 bp, Human
gacttttttgttgttcactgatatcacgggaaacaggtacttgacttttgataagacttttagtaatagcacttgtttaaaaatattctcacagaattggtttcaaagtgtatttacagtgaagctcaattgcttgtcagcatcatggctaagattaagtgtagtacagtggagctcagtggacccggtggaaggtgacaaggagaactgaataaagcaagcaaaaaataaacaaaaaaacttgagaaaagcaataatttgataaaaatgttaataaaataaaataagtacaataatggtractataactcttttcaccccaactcaggcaaattatatttctagtaagtactataaataatgaacagttatctacagaacatgagctttgtatacttgtaatcttttatctgatacatacttatattacaaattccatctctctctttgctaagtggcttatatatttttatatgcaatttataggaactcaattataatgttaaatttaatttttgtgctatatggtaatatatatgtgcatgacaaaagtaaacaagtttataaaaacattgtttattgtgcacattggattaataca

SEQ ID NO: 142532 - DNA, 601 bp, Human
tttttaaaaaaggagacattgcttaaagaatacattgtatccattatagagtatgactgactaaataaacttagtaacttcattgattttctcaaataatcttattgtctcaaatattttaaattatattttgtataaatacttttgttatacatatgttctactttatacaaggagactgcggcagaactggaaagtgaaaacaagtctcttgcttcacagcccatcttctttccattacactcatcagctgaagtgaaattaaaaaaaacaaaaacaacaaagactcattcttggagcwgaagatactgaacaagaatactaattaattattagcaatgtaaactctcacctaaagtataagcaggtttatctttttacactagttagaagaaaaactatattttggaggaattgagaaaaatgccacagtcagtggaatgagagaaggagataactaaagaatttgaaataattcttgttatacaatgtcaaacatagcaattaaattgttttcaaacagtacacaaaatggtaatcataggatgaaagtgactctttttaattgacacataataattttacatgtttatgaggtaca

SEQ ID NO: 142533 - DNA, 601 bp, Human
acacagctattctttgtatactttttttaaaaaaggagacattgcttaaagaatacattgtatccattatagagtatgactgactaaataaacttagtaacttcattgattttctcaaataatcttattgtctcaaatattttaaattatattttgtataaatacttttgttatacatatgttctactttatacaaggagactgcggcagaactggaaagtgaaaacaagtctcttgcttcacagcccatcttctttccattacactcatcagctgaagtgaaattaaaaaaaacaaaaamaacaaagactcattcttggagcagaagatactgaacaagaatactaattaattattagcaatgtaaactctcacctaaagtataagcaggtttatctttttacactagttagaagaaaaactatattttggaggaattgagaaaaatgccacagtcagtggaatgagagaaggagataactaaagaatttgaaataattcttgttatacaatgtcaaacatagcaattaaattgttttcaaacagtacacaaaatggtaatcataggatgaaagtgactctttttaattgacacataata

SEQ ID NO: 142534 - DNA, 601 bp, Human
aagaacatgagtgctatgccatgaactgtgtatgaatcctgacatctttgatttttcaaatacttttccaacacagctattctttgtatactttttttaaaaaaggagacattgcttaaagaatacattgtatccattatagagtatgactgactaaataaacttagtaacttcattgattttctcaaataatcttattgtctcaaatattttaaattatattttgtataaatacttttgttatacatatgttctactttatacaaggagactgcggcagaactggaaagtgaaaacaagwctcttgcttcacagcccatcttctttccattacactcatcagctgaagtgaaattaaaaaaaacaaaaacaacaaagactcattcttggagcagaagatactgaacaagaatactaattaattattagcaatgtaaactctcacctaaagtataagcaggtttatctttttacactagttagaagaaaaactatattttggaggaattgagaaaaatgccacagtcagtggaatgagagaaggagataactaaagaatttgaaataattcttgttatacaatgtcaaacatagcaattaa

SEQ ID NO: 142535 - DNA, 601 bp, Human
tttagttcatgactttaaattccatgtcgatgctgaaaactccagatttacataattaaccccaatatcacacataaactagaggcaactgtagcatcttaaacatagcatgacagaaactgagttcctaaacttcttcaaacctgtctctcccacaaatttttctgtctagagttactagttatttcatcttttcaaaagttgcataggtttaaaatactcaaggcttcccttggccactgtctttctgtcatattccacattcagtgtgctaatcttgttgactctgtattcaaaatgkattcagaattcactactccctaccattccattgctaccaccctagtgaaagccaccttctagattattgcaatagcctcctaaactaatctcttgctcctgagaacccctcttagctattcttaacacagcagcgagattgttaatgagatggttatgaaagtatattcatgtcattcttccgtttaaatccctccaatggctttcagtcttcatctaaagccagtggttataatgacttgcaaggtctaacacagtgtgtccttgcaactctgttaacacccaacttccatttattcta

SEQ ID NO: 142536 - DNA, 601 bp, Human
tatttatactcacttccttttatctcatttagttcatgactttaaattccatgtcgatgctgaaaactccagatttacataattaaccccaatatcacacataaactagaggcaactgtagcatcttaaacatagcatgacagaaactgagttcctaaacttcttcaaacctgtctctcccacaaatttttctgtctagagttactagttatttcatcttttcaaaagttgcataggtttaaaatactcaaggcttcccttggccactgtctttctgtcatattccacattcagtgtgctmatcttgttgactctgtattcaaaatgtattcagaattcactactccctaccattccattgctaccaccctagtgaaagccaccttctagattattgcaatagcctcctaaactaatctcttgctcctgagaacccctcttagctattcttaacacagcagcgagattgttaatgagatggttatgaaagtatattcatgtcattcttccgtttaaatccctccaatggctttcagtcttcatctaaagccagtggttataatgacttgcaaggtctaacacagtgtgtccttgcaactct

SEQ ID NO: 142537 - DNA, 601 bp, Human
tctgtgaacagaggaatcttgtctatttcatactaacacacatccagcggtgagcagaatgactcatgacaggtgcttaatatttattaagcacatcaatgaatgggcagaaacaacagaaagacatattgtaactgaatataagaaagaactttctaagatataaagctgcaaatttttattgttgtatcttcttagttttctccaacttagccaaacccattctttcaactggtatccatcttacatgattgtgagttacctcatatttcccatcactttaaaatacatttgtatgacrgttaatctgtgctatctagaattgggcacaatattcccagttggaagtggcatgtgccgagcagagctgagtatcagccacctttactctataaatcagtgcagtctaagacacatgagatgttctgatggccactagactcatactgaattgattatatccaaagttcagttctcactcctcaccttgcagagctatcaacatttgggacagatcattgcctcctccttgaaataactttctttgctttctgagcatcaaattgaatttttctattatctcaatggccattcattctct

SEQ ID NO: 142538 - DNA, 601 bp, Human
ctacaactgaaatattaaaatcttaactccaggagaccctccattacatatttcacatgtattaaatcatgaatacaaaactacctccaagtattatcagtggtctgctttccgttgccagaagttatcttaaaccatccatgaaggggcagacagactcttttgagcacaacaaatatttttgagatttttcacctaaggcagaagtattgctactgtcttttgatgtgtttccttacaaaaatactgcaaaattactgttaatggatagactgattttttaaaaatctgcattaagttwgtcctgggataacttcctttaccaacatatgagtatattaactaacataaaatatgcctctaattaaatcctcataatattcatcagaatctttttaattgagctctgattatacaagagtggcaaagaaaatctcaggtaatttaaaaaagtttctatctgaaaataaaattgatcctcataaacatcagtgccactagattttctagcttggggaagtcatctataaaccgttattagatttttgtaaacccaagggcagatgaaaggcatgaaatacaataatctagcaggattggc

SEQ ID NO: 142539 - DNA, 601 bp, Human
gactgtattaatcaattaaatgtaaaggctctaaaatttaggagtaaacacatgattccttgctaagctggccttttatccacctcagtggggacttaaatactggaatccaatggggtaaaacgttttcgagtgcatttaggactcttgtcattcttccacgaattctttccttctttctcttaatattctactcgattaccatccaccacttcttacagtttagctcaagaaaccaaaataatgataccaaatatacagaatataaagttctgggaaatgtgcatgtttattgtacacrtacaaatatatactattcattaggtactaagttttaacacacaaagtagcatgtttttcctggcctactagaatcaagattttggaaaggcagatgtttgacaattttatttacattttctcagattttatttttaaaattaaaaattccatctggattaaaatgtatttctacaaggttaggaaatcaaaaatgaaaggactctacccttaactgatcatactggctttcatacagtgctgctctttagcatctttcagtttgatatcatttttggatgtagctaaatgccagataccc

SEQ ID NO: 142540 - DNA, 601 bp, Human
atactggagttttgcagaggcatactcttcattaattaatttctaagtctggatttactaaatcatgctcctaaggaacatgctcttcccagctttagtttttggtaagggaatattttaaagcagtgcacgtagctcaggttatatcaatgactgaattagagaggcatactagtgactatttaactctgattataccttcaaaattaggacccattttcatgaactcattgtatcaaatagggattaaatattctctttggatttagtgattcaaataaatccctgagggaagccttcyaaaagtcacctacagatacttttactcactatggtaagcagttttacagattcagggagcatactgtcccccatctgtgctttacgtgtgtgtgtgttttactagcactatgaatgaatatgtcaattatcactttttgagggtcacatagaatagcagttaatcaagttgggcattttcagtggacttaatttaaaagtttgaatgaagattttattaatatggtattcaaaggggaaacaaaaaaaagatgtgaaaactttttggttttgctcaattgctttcaattaaaataaacaa

SEQ ID NO: 142541 - DNA, 601 bp, Human
atatatgaattagtatttatatatgtctcttttaaatcagtacatctcaatatgtggcatatgcattaaaatcattagaattacctgcatacttataaaaatgtatataactggtctccaccaagtttgtctacagaatcaaaacttcctgagtgtggttctcagtatttgcattgtaacaagcacctaatatcaactttgagaagatattttgagaatagaagaatcaaacagtaggcaacagtaatatattatttgttgattatgtatatatcaatcacaataggtgagtcattgatcycaggagcattccccaataaaattcctgcatatgtatctctgtctcagagtctgtttatccttggaactcaatctccaatgtctggatatgactgagctcactaattagtgctcttcttatttcttctctctatatttgttttgttagacacaattaaggtggtgtttgtttattaagtttaattacaagacaaaaattataatatctgaaatttcactgacaaatttagatttctgactagacttctggaattgacatttctgaccccactgggcacttacgcatcttcagcaagaacag

SEQ ID NO: 142542 - DNA, 601 bp, Human
actgtctagcatgtattttgtgctagtattaatgggctgctcattgaaggaggagaaatcactgatccatttcattgattagctaacctccttgtgaaactgtagaaattgtatctgatattatattttcatgcctggttttattttactcagaagtgctttaataaatgtcatattttaatattaagaagtttcagcatgttggaatattctgcagatttaacaaaagcttagcaaagcattttaatatataagtacatttcgaataaagattcagtatattagtttttcattccaaaayagaactctttaaaattaacattacattacaatgataggcaaagtgattagagaccaaatatgctttgctattttaaaagaatacaatcattagcagaaaatgatttgtagtgcaattttacttcacttgggagaaaaacaattccctttcatatttactaaatttacttaagaatgtagctagaaaaaacaagttctgtagaagtataatgcttagtattctctttcatggttttaaaagatgctattagacacaggtcagaggtgcaattaaagctaagggaagtatatttcataataa

SEQ ID NO: 142543 - DNA, 601 bp, Human
tcaataagatttcctgaaagattacatatattcataatcaaatattataccctttatttaataattgataactgacaattataaattcacatgaaaaataatatctatacagcaataaaagttgattttatatatcttttcaatttctgtggtaagctgaaaaatattctatgctgaggctccctcttactagtacagatttactagatatttagggataaattggataaaatattataataagaaagtatgatagataattaaagatgtgactcagtggtgaactgtctagcatgtattktgtgctagtattaatgggctgctcattgaaggaggagaaatcactgatccatttcattgattagctaacctccttgtgaaactgtagaaattgtatctgatattatattttcatgcctggttttattttactcagaagtgctttaataaatgtcatattttaatattaagaagtttcagcatgttggaatattctgcagatttaacaaaagcttagcaaagcattttaatatataagtacatttcgaataaagattcagtatattagtttttcattccaaaacagaactctttaaaatta

SEQ ID NO: 142544 - DNA, 601 bp, Human
atgctgggggctacatagctgtggaagtgaagaaagtggtcatattccatatacacatgttttacaaatatttggaaggtagattcaataagatttcctgaaagattacatatattcataatcaaatattataccctttatttaataattgataactgacaattataaattcacatgaaaaataatatctatacagcaataaaagttgattttatatatcttttcaatttctgtggtaagctgaaaaatattctatgctgaggctccctcttactagtacagatttactagatatttaggkataaattggataaaatattataataagaaagtatgatagataattaaagatgtgactcagtggtgaactgtctagcatgtattttgtgctagtattaatgggctgctcattgaaggaggagaaatcactgatccatttcattgattagctaacctccttgtgaaactgtagaaattgtatctgatattatattttcatgcctggttttattttactcagaagtgctttaataaatgtcatattttaatattaagaagtttcagcatgttggaatattctgcagatttaacaaaagcttag

SEQ ID NO: 142545 - DNA, 601 bp, Human
ctttatggtgtggaagttgcaaaatactctagaaagagtagggttagggggtcaaaaatgttaagaagttacaagttgttatattaagtaaggttgtttgcacactgtcattgagcatgcagggtttgaacaatgatttgatagagatgagtttggtagccaaacagatatccaggagaagataattttaagggagcaggaacagctagaacaaaggcccaaagacaggaacacttctggtgtgttttaaggattagtaaagagactagcatgcctggaatacatgaatgagggggttagkggtaagagctgagaccacagacgctgaggaggtgggataggcagcagatcacataaagcctggcagacttctactcttgctcagagtgagatgtggactcacagcagctttctgagcagaggaacaaaatggtctatgctttaaaaaggatgtaactgctgtgattgagaactggatgtagagtcaagtatagaacaacgaagacctactaggaagttttgcagtaatccagataggaaatgctgggggctacatagctgtggaagtgaagaaagtggtcatattccatatacacatgtt

SEQ ID NO: 142546 - DNA, 601 bp, Human
aaactttatggtgtggaagttgcaaaatactctagaaagagtagggttagggggtcaaaaatgttaagaagttacaagttgttatattaagtaaggttgtttgcacactgtcattgagcatgcagggtttgaacaatgatttgatagagatgagtttggtagccaaacagatatccaggagaagataattttaagggagcaggaacagctagaacaaaggcccaaagacaggaacacttctggtgtgttttaaggattagtaaagagactagcatgcctggaatacatgaatgagggggtwagtggtaagagctgagaccacagacgctgaggaggtgggataggcagcagatcacataaagcctggcagacttctactcttgctcagagtgagatgtggactcacagcagctttctgagcagaggaacaaaatggtctatgctttaaaaaggatgtaactgctgtgattgagaactggatgtagagtcaagtatagaacaacgaagacctactaggaagttttgcagtaatccagataggaaatgctgggggctacatagctgtggaagtgaagaaagtggtcatattccatatacacat

SEQ ID NO: 142547 - DNA, 601 bp, Human
tacttaacaaatatttattaagggcctcacatgttcacatcactcttataagcgtttaggaagtaatatcaaggaaaagaaatatctctatcctagtaaaacatatattttccccaaaaagatggacaataaatttaacaactaaggaaactttatggtgtggaagttgcaaaatactctagaaagagtagggttagggggtcaaaaatgttaagaagttacaagttgttatattaagtaaggttgtttgcacactgtcattgagcatgcagggtttgaacaatgatttgatagagatgastttggtagccaaacagatatccaggagaagataattttaagggagcaggaacagctagaacaaaggcccaaagacaggaacacttctggtgtgttttaaggattagtaaagagactagcatgcctggaatacatgaatgagggggttagtggtaagagctgagaccacagacgctgaggaggtgggataggcagcagatcacataaagcctggcagacttctactcttgctcagagtgagatgtggactcacagcagctttctgagcagaggaacaaaatggtctatgctttaaaaagga

SEQ ID NO: 142548 - DNA, 601 bp, Human
attcttaaataaaaatgatatgcattcaataatttatcttcctcctaatgtcacaaactagaattcaattcaattctacttaacaaatatttattaagggcctcacatgttcacatcactcttataagcgtttaggaagtaatatcaaggaaaagaaatatctctatcctagtaaaacatatattttccccaaaaagatggacaataaatttaacaactaaggaaactttatggtgtggaagttgcaaaatactctagaaagagtagggttagggggtcaaaaatgttaagaagttacaarttgttatattaagtaaggttgtttgcacactgtcattgagcatgcagggtttgaacaatgatttgatagagatgagtttggtagccaaacagatatccaggagaagataattttaagggagcaggaacagctagaacaaaggcccaaagacaggaacacttctggtgtgttttaaggattagtaaagagactagcatgcctggaatacatgaatgagggggttagtggtaagagctgagaccacagacgctgaggaggtgggataggcagcagatcacataaagcctggcagacttctac

SEQ ID NO: 142549 - DNA, 601 bp, Human
aaccaatggtcaagtctatttttttgtatttgaaaaatctctgtaacattagtgttactcttgtagatgaataagtgatttggcttctgctgcatatttttcaaagtgctcatcactgaattctaaaatcaacagattcactctctgctgatcttttcttgttcaactttttacctaagaagtactgtgttttgtcttatcaatttcatggcctatgaaactaatcttctcacagtgtgttattttacttatgctaaaagtactaataattcactctcagtgtttgatcctctctttaggratccacagtttatgttctattttaagaacctagttgtaggactagaccccctggaatatgcaccctaaactatatagatggaaaaaagttgatttcattgttcctgttgtagaaactaaagttcctctaagtcaaagaaatggctcagctaagctcctatgtttttgaaagtgataagagggtacaatgagaacatattattggaaagaaagcaaatgaaatagctgtgctaacataggaagggcctgcactgctgtagttataataataacagtgaagctaacagatccttaaaatgag

SEQ ID NO: 142550 - DNA, 601 bp, Human
ttgtgacacagagacacaacgtaagcacatgctgttggaaaactgatgctgatagactagctcaatgcaggactgctacagccttcaattcgtaaaaaatgcgatatctgcaaaacagaataaaaccaggtatgtctgtagtggtagagagttggagactatctaaatatccttcagatattaatattataaaaacactggtggtaatgttttcaaaaagatttcatttcatgagaaaatgatgctatgtggtattgaggaaaaagtagcatataagatgaaatatatactatagatgaaragttgggaaaattttaatagctggtgattattttctttcttgtctttctattttgcatatctggatttcccattttcttcaggaaacacttaactgcttttatagccagaaacaatatatgttttaaaagaatctcattcatatagcaaaatatccttatttggtataaaaaagatacaaacaaaattaaatatggataactaagcagaataaaatacattctattttcaaaacaattactaaataaaaaattaagattgttaaattagacccaaggcattttttcatatgatttctgat

SEQ ID NO: 142551 - DNA, 601 bp, Human
tttttaattttgactttttaaaatggcaaataaagaaagtgagatcagaagcatggagaattaatttttaagaggtggattttaatcactttagtcattttagatttggttcacagtccttaatttcttgacagtttaattgctttatcaggcatctagcaagtacattttaaaagaatgaagactaaaaagaggtatgtttttgaacagtcttcaataaaaatgaattatttaaattaacttaattttcatggtgctaaaaggttttggaataaattacttggcctatgacatgagtcargttcatagaaactttggttatgacttcaatggagaaagttgtacggccacccccaacaagtgatttttcagttatattgtgatacgcactgaaaattaaataaaaataagcaatggaaaaatcccccaatagatgacatcaatgtttttacacaatgtttcactttatagtttcacaaaacttaaaaaacaaaacaaaggctgggtgcggtggctcacgcctgtaatcctagcactttgggagtccaagttgcgtggatgatgaggtctggagttcaagaccagcctggccaagatggtg

SEQ ID NO: 142552 - DNA, 601 bp, Human
gtatctgttgcccaataaggctaattaaaatatctttattacatatgctattgaaataaatctattttttgaatttcataaactgtgatcctatataattcaagataattatataagaaaataaattcatacccattcaaatataccattataaaatattttatcataaaacattctatacttaagatcaacatatgtgaagaacaaaatgaatattcacagagactagcaagtaaaagcattaacataacttctgatgttaaaggccatgagtagttgcacaattaaatgaacaatatcrttaagtattctgttaatgctctaatatcagaaaataacattttttaattttgactttttaaaatggcaaataaagaaagtgagatcagaagcatggagaattaatttttaagaggtggattttaatcactttagtcattttagatttggttcacagtccttaatttcttgacagtttaattgctttatcaggcatctagcaagtacattttaaaagaatgaagactaaaaagaggtatgtttttgaacagtcttcaataaaaatgaattatttaaattaacttaattttcatggtgctaa

SEQ ID NO: 142553 - DNA, 601 bp, Human
cagggtgtaggctgggagaaatgctagtgtgcagaaaaagctaacaataatcagtcaccgaaaactggcactgtccaaacagaaagcatattctttgtatctcatgagatgctgaccatttttaatcttttgaggtttaatcactcgagtgacatgcttacatgataattcaaactgtctcaggctctaactgtcagcatcccctcttgctcgggatactaggattttttctctgtggtttgatgattggagtacacaggcttttcaacacctgctctggctactgtagaatagattacawtataccaaaggaaaatatatcttattattttttgctgttacaattagaagcactactttatttatttactttttttagagtttgatctaaaagccattaggaatgatatctttaaacatgtggtgtgtatgtaggactgggaaatgttggacctaaatttctctgctgtaagattcacttaatatgttagtatatccctttctgagatgtacacagaaaggaaacaacatcttacttacgtgtttattttcaaagaaaagatatatttgaaatttatttgttaaaagatgtttgaattat

SEQ ID NO: 142554 - DNA, 601 bp, Human
tatctgtggaaacctttcttctattacctgactagcacttaatatgcttctcacatgctgcaagacataaatgtctgagaaatgaataggagaaaggtgcttttgcatctgttgttaaagacagccttcactgcactcaaacgaagaggacattggacatttctctgactaaatcacaggatctgctaaaacaaattgtaaaggaatagtaggcattctagaatggattggctgtcatgaataattactatacttgtagtatagtaattatactacaagtatatacttgtagtatacatttagcaagtatatacttgtagtatacactgagcaagtgtacacttgctcagattttgaaagacaatacagatgaacttgattatttgtgatttattctcagttctagattgaagacaggaaggcagcttctattggactgtttgtatttacaaggtaaactaacggagttgtgcagaaaagatttctggagctgccaatgctggcagcaatgcttattttatctgttctgctccagcctcccaaaccaaatcaataattctctactgagtgccactataccacctactttattctagatgct

SEQ ID NO: 142555 - DNA, 601 bp, Human
gtattatctgtggaaacctttcttctattacctgactagcacttaatatgcttctcacatgctgcaagacataaatgtctgagaaatgaataggagaaaggtgcttttgcatctgttgttaaagacagccttcactgcactcaaacgaagaggacattggacatttctctgactaaatcacaggatctgctaaaacaaattgtaaaggaatagtaggcattctagaatggattggctgtcatgaataattactatacttgtagtatagtaattatactacaagtatatacttgtagtatatattgagcaagtatatacttgtagtatacactgagcaagtgtacacttgctcagattttgaaagacaatacagatgaacttgattatttgtgatttattctcagttctagattgaagacaggaaggcagcttctattggactgtttgtatttacaaggtaaactaacggagttgtgcagaaaagatttctggagctgccaatgctggcagcaatgcttattttatctgttctgctccagcctcccaaaccaaatcaataattctctactgagtgccactataccacctactttattctaga

SEQ ID NO: 142556 - DNA, 601 bp, Human
cttcatctttacatttgctcagaccagagaatgtgaagttatactgaacactcctctgtctattacaccaaatcctgctggctcaatattcaaaatacagccagtgttaagcacttctcactacattaaaagacagcactgtaccttctcatagcttgctaacctatctccttacttctgtgtttgcctgtttcagtctcgttccagaagagtctaagaagcttacattctaataggggtgggaagggggtagatagaaaataaggcaaataaataaaatatatgctctgttaatagtaasaagtgctaaagagaaaaaaaatcaagctggatgtagagatgggaatgtttgttgatggctgcatttttagatctagcatacatattaccttaaggagtacatcttaccatacattcatttctaagaaacaacatggaaataaattaagacaaaggcatacacacaatcatatggatcagcatagtatctgctctgcgttttaaaattaaattaattaagcttttacttgaggtcttaaatgtaatttcatcggtagataggtgatttatgatgctataaaatgataggtgaagttatatt

SEQ ID NO: 142557 - DNA, 601 bp, Human
gcaaggttgcagaaaaaagagaacatttatacactgttggtaggagtataaattagttcaaccattgtggaaagcagtgtggtgattcctcaaagagctaaaaacagaactaccattcgacacaacaatctcattactgggtaggtacccagaggaatataaatctttctaccataaagacaaatgcccactgcagcactattcacaatagcaaagatatggaatcaacttaaatgcccatcaatgaaagactggataaagaaaacgtggtacatatacaccatggaatactatgcagccrtaaaaaagaatgagatcacgtcttttgcaggaacttggatggagctggaggactttatccttagcaaagtagcagaggaacagaaaagtgaatactacatgttctcacttgtaagtgggagctaaaggatgggaactcatggacacaaataggggaacagaagactctggagcctacttgaagatggatggtgggaagaggaagaggaacagaataaataactactgggtagtaggcttagtatctgggtgatgaaataatctgtacaacaaacccctgtcacacacgagtttatctaca

SEQ ID NO: 142558 - DNA, 601 bp, Human
aagagttcacagccatatttgatgaatagtagagcatcctaatttttaaatcagtaaagaggcctaaagagacactgatacacactacatacactgccaataaggatatgaaaaatactaagccttaaaccaagtagtaatccctttttaaatgagaaattattttgcctatcacattggcaaagattgaaaaccaaaagacaatgctcagttttgataagggctcttggtagttaaatatttctggaggtcagtttggctatccacaataaaattccaatactttctacctaaataagtytatttctgaaaattgattatcaaaataatcaaagacaggtatagtgatttctaactgtgtttatttggatcttctctcttttctgctttattagtggaatatccagcattcataaggaacttaaacaaatttacaagagaaaaaaacattaaaaagtgggcacaggaaatgaacagacgtttttcaaaagacatacatatggccaacaagcttatgaaaaaaagctcagccgggcgcggtggctcaagcctgtaatcccagcactttgggaggccgaggcgggcggatcaagaggtcagg

SEQ ID NO: 142559 - DNA, 601 bp, Human
cagccgtttatgaaattttccattttttgtgtgtttgggatgacctttaatatgctgctatatttttagttaatattttacacttcttaattatgtcttaagtaatttttcattgctctccattttggtagtttctgtaattttgtgtatttagtagacattctttttccttcagtttcacacattgtgattagattgcttgtctctgtcttacggttttgtggttttctttttaaataaatatataatagatatttctttatctaattatacttaaatacatatgacaaatatatatgaygttttcttccactgtgtgtcttatatttttatttttatagtcaattttatcaagattttctttatagacagggctttctggaattccttctctaatcaaaggtcattaagatagtctatattttctttgaaagtgtttatttattttccctacataattgtctttactctatggaactgattttatctatcatgtatactactatctatttttgtcacctctgttatatatatttccattgtttgatatttctgtcctatttatgccacttatctttctgctgacaatgcattttctgaa

SEQ ID NO: 142560 - DNA, 601 bp, Human
ctggagaaatatattttttgatgggtaactaccctgatttttattaaggggaatgttccttaacacatttttttaagaagaaaaaaatagtccatatgtctagtttttctttttaacaaatagaacaatgtcataaattggtagttaaatgttgttttatttcaaagaatatataacatgtataatcatataaagctacagttgtattaattataacatgccagctctcaaaattaactaatatatctgtttatttttacatgctcagcttaaatccaactttttcaatgcatacattaayagatatagattcacatatggcattgataagtcacaatgttggagggttatagaaagtagaataaaatcagtactttttctttgcttgtatatattttactgaatttatctgaaatatgtaatagttatattaaaaccagattggcttgtttaatggtcttctcaaagattaatattgaaaagttttgaattgactttttctaagaaaaatttccaaatcatacagtgtgtttactttttgaaactgaggggggaagggaggaagatgaaaagggagagagagaaagagataaagagaacg

SEQ ID NO: 142561 - DNA, 601 bp, Human
aattgaatttcttgctgctatctactcagtcacaagaagatgtcaacctcaaggatgttagctatggaaaaagtcttaatacactatgattttgaatgtgaagatgacaacatagcctgggttttaactacggactctgaatagaatatactaaaataaattctttttcatgtaataaggattcttcttgcccttaaatgggcagtgtatcagggatgatgtgacaaggtagtctaaatttaagtcccatgactattacggttaaaatgtctattgtgatgtttcaaaaagctgaatttawatataactactgatatactaaacctgaagatgaatatttactggagaaatatattttttgatgggtaactaccctgatttttattaaggggaatgttccttaacacatttttttaagaagaaaaaaatagtccatatgtctagtttttctttttaacaaatagaacaatgtcataaattggtagttaaatgttgttttatttcaaagaatatataacatgtataatcatataaagctacagttgtattaattataacatgccagctctcaaaattaactaatatatctgtttatttttac

SEQ ID NO: 142562 - DNA, 601 bp, Human
ttctatgaatactagagagaaaggcaaacaacccattgaactacaggtgataagactggaagatagtgatagagagaggtattcaagataaatctgcgctcctgccaagtgctccatttctaattgtttgcactcattttggagaaggtataaactctttaaattcatgctgatctgtgggcacaaagagggtaagaaagatgttattcttttaagttagaagatgctagtaaatgatagagatgagaaatagtttgaggccttgtacaattgaaaagaaatgataaattcttttttctartattaagttaaagattttttaaaaatattgacaaaatcatacacatttaagaattagattattaaaaatcaggtaatacatagaaaagactatgtaaacccatatatatatatataattttttgttattcataatttagtttgcaaaatattcaatctatcatttaatcttatttaggtatttttaaaatttaaaacaatcaaattttagtgataatttaagaattatgtttcagaatatttaggtatttagtattaagaattattaatgaattctgaaatattttcctttggttttaaa

SEQ ID NO: 142563 - DNA, 601 bp, Human
ctaaaattttattttgaatgcaatgttccttatgcaatgttttaaaataagaacttttgaatttaacagaattctaaggcttttacggtttttgtttttttagtcaaagaccaaagagaattatcattaagcgtctaatcacacaggcaaataaaatatttgacaaaagctgcaaaattgattaaacttccatcactaaacaacagataaaaaatacttttctgggccgggcgcggtggctcacgcctgtaatcccagcactttgggaggccgaggcgggcggatcacgaggtcaggagawcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagctggcagtgagccgagatcccgccactgcactccagcctgggcgacagagcgagactccgtctcaaaaaaaaaaaaaaaaaaaatacttttctggaaccagattaccaggttatgtgtacaaaaacaagaattatttgtcagttgcttcccaatgattca

SEQ ID NO: 142564 - DNA, 601 bp, Human
ctagcattttaagatttgtggcccagcaaaagtcacacaaatgactctttaaagggaattctatctaatagttaatataaactggattctgcatttcatcatcatcatcataaagcaaacaaaaaatacagctgcaaacaatgaatacaacattgaaatagatcccagtagtttatgttgcaaatactactctgtagatgttcacttactatttgcaaatcactgaccaagaaatccgaatttttctttaaaatgagtaaattttatattttgatagtaataaaatttgttcagtagtgcrtgtctctgaaaacccccttatggatacatccctgatttctgtcctaaactgtcttggatggcaagcaaaagcaattgtgtaacatattttgtttataaagtactacatatcaatgagaaataaaaggaatactctctacagtttgtacttactaaaattttattttgaatgcaatgttccttatgcaatgttttaaaataagaacttttgaatttaacagaattctaaggcttttacggtttttgtttttttagtcaaagaccaaagagaattatcattaagcgtctaatcacacaggca

SEQ ID NO: 142565 - DNA, 601 bp, Human
aatttgccaggtctaattcagagagactggaattagtccctagaagtctgataactttcagttatctaaaatcttcctctggaatagaagtaatttctcctttctttcctctctctctcctttaattttagctttaggttaattattcagttttagatctcttttgcttaaaccattagattatatacaaactataaccaaggtttggcagtaatgtttgcttgctgagatgtgaagcaacacagggtatgagtaccttccattacaggacttctcactaaacataacagcgaggctcttmcgaatgcccagtgtcctagcattttaagatttgtggcccagcaaaagtcacacaaatgactctttaaagggaattctatctaatagttaatataaactggattctgcatttcatcatcatcatcataaagcaaacaaaaaatacagctgcaaacaatgaatacaacattgaaatagatcccagtagtttatgttgcaaatactactctgtagatgttcacttactatttgcaaatcactgaccaagaaatccgaatttttctttaaaatgagtaaattttatattttgatagtaataaaa

SEQ ID NO: 142566 - DNA, 601 bp, Human
tctatatataataattgtacaagattgataaggtttcagctctccattcaaatgataggtaatacatacaaaatggcattggaaatttcttcaactcttagcaatttgccaggtctaattcagagagactggaattagtccctagaagtctgataactttcagttatctaaaatcttcctctggaatagaagtaatttctcctttctttcctctctctctcctttaattttagctttaggttaattattcagttttagatctcttttgcttaaaccattagattatatacaaactataacyaaggtttggcagtaatgtttgcttgctgagatgtgaagcaacacagggtatgagtaccttccattacaggacttctcactaaacataacagcgaggctcttacgaatgcccagtgtcctagcattttaagatttgtggcccagcaaaagtcacacaaatgactctttaaagggaattctatctaatagttaatataaactggattctgcatttcatcatcatcatcataaagcaaacaaaaaatacagctgcaaacaatgaatacaacattgaaatagatcccagtagtttatgttgcaa

SEQ ID NO: 142567 - DNA, 601 bp, Human
gtaccttcttggaaatatttctcatttaatataatgctgtcatggaaactgtattggctcatattctctaaaaatgaattctatatataataattgtacaagattgataaggtttcagctctccattcaaatgataggtaatacatacaaaatggcattggaaatttcttcaactcttagcaatttgccaggtctaattcagagagactggaattagtccctagaagtctgataactttcagttatctaaaatcttcctctggaatagaagtaatttctcctttctttcctctctctctcytttaattttagctttaggttaattattcagttttagatctcttttgcttaaaccattagattatatacaaactataaccaaggtttggcagtaatgtttgcttgctgagatgtgaagcaacacagggtatgagtaccttccattacaggacttctcactaaacataacagcgaggctcttacgaatgcccagtgtcctagcattttaagatttgtggcccagcaaaagtcacacaaatgactctttaaagggaattctatctaatagttaatataaactggattctgcatttcatcatca

SEQ ID NO: 142568 - DNA, 601 bp, Human
gtgcttgcaatgtatattgcaattctctaagagggaaacatcattaactctcaaatgacagagaagcaaattagtgataccatgtatagttagaataacaacttgaaagtcagcaataatttttttgataatttttaatatatcactaagaaattttgataacaatgaattacaactattaattcatagtttataaacagatagcttttaaaagtatgtagatcctggctaacatggtgaaatcccgtctctactaaaaatacaaaaaaaaaaattagctgggagtggtggcgagcacctktagtcccagctacttgggagactgaggcaggagaatggcgtgaacctgggaggtggggcttgcattgggccaagatcgcgccactgcactggagcctgggtgacagtgcaagactccatctcaaaaaaataaaaaaataaaaaaataagaaagtatgtagaataattttgttaaaagtaatcttaaggtttaccttattttaaacaaatattccaaatgcaaccaagttctctcattacattttgtctgcatgcctaaacaggaatttggagattaagtaggacatataaaatcattggt

SEQ ID NO: 142569 - DNA, 601 bp, Human
accttcactcttttatataagccagtgtcttcctatctattggattcttcctgaaagattttgtgtaaactctcccatgaaaataaaattgtttctcaagcctataactctttccacctgctggggaatctcttttcttcactgtatagccaaatatgaaaaaaattgtccatattctttttctccatttctcaactcctttcatgtttcaaccttctttagtctggcttcggtccacctcattccattaaatgagttattgataaggttactcacactgaagtgcttttctcaatccctrcttttcttggactctcagtagcattaatatttttaatctctctgtccttttctccttggcttttgtggcacattctcttctagtttttctcctgtctggttgattctttttttttttttaacttttatttttagttcaagggtacctgtgcaggtatgttatataggtaaactcgtgtcatgggggtttgttgtacagattatttcatcaccaagatattaagcctagtacccattagttatttttcctgatcctctccctccttccaccctccaacctccgaaatgccccagtatgtgt

SEQ ID NO: 142570 - DNA, 601 bp, Human
ccaaaggaattgattcagatttcctaagtgaaggcaccagatcatggataaaaataatgtttttaaactggggcttggaagactatatatgatagcattaaaccttcatttgtcaggtttaaaaggtagcaggtgagaaaaatattttttgcttgtatctgggagttttcaggtgaagcttttccctccaggaccagacagctgtggagaccctgaacagggcaaaggttgcgtctgaaacagtcacatccggtgatttaaacatatttccagtgacagaagtcatttactagatggcatrtataatatgttaactagcatgaatatagtactttttaaaagactttcaataacatttaatttctctgttttataattgagaaatatttatttgaaaaagtctcaaattgattcacagtactaacaaggaatactccaccatgcatatttttggcacttagtatatgctaaataaacgaataatggtgtgacactacaaattaccttcactcttttatataagccagtgtcttcctatctattggattcttcctgaaagattttgtgtaaactctcccatgaaaataaaattgtttctcaa

SEQ ID NO: 142571 - DNA, 601 bp, Human
atcagaaatagcagattgctaggccagccaacaaacatgtatttgacccagaatgttcttaaactattgtaaatttgcacagataagaaatcgaaaacaattctgttttaatattattaactatgcaaaagagaaaaaccaagacaaagaataaaatgtgtttgctatttctactgatgcagttgcttcaattacaggaatgaagatctccctgaattctccccatattctgatatctcttagccaaggacagaaacttttgcttgttgtctgcctgtctccttctcttgccacatatgawgttccggctttattcctaaataatctccagccagcaagaaataacgaactcaaaaactaactaggatataaatataaagtagatgatgtactgactttcatcttttttcagttagagctggggtctgtggcccatgggccatatctggctagccacttgtttttgtaaataaggtttcattggaacacagcggcacccttttttacatattccctctggctgcttctgtgccaaaatgtgagtgctggggaattctaacacagaaaacatggcctgcaggatgtgaaatatttattacct

SEQ ID NO: 142572 - DNA, 601 bp, Human
attctcagaaaactaacacaagaacagaaacccaaacacctcatgttctcactcgtaagtgggagttgaacaatgagaacacatggacacagggaggggaacatcacacaccagggcctgttggggggtggggggctaggggagggatagcattaggagaaatacgtaatgtagatgatgggttgatgggtgcagcaaaccaccatggcgtgtgtatacctatgtaacaaacctgcacattctgcacatgtatcccagaacttaaagtataattaaaaaaaagtacagttaaaaaacttaycatttcaattgctccaggtactctgaatacattgtatctcaaaagtgcataaacttaagaaattcatattgcttaataagttctcaatattagtcaagatttaccactttattgcaagaatctgttacaaactgagcacttaagtttaatattttctgctaaatacattttgattagctttgcaacttctattttaaagttgttgttttacaaagcagcattaatttactatataatattttagtaccaagagaaaattaacgcagctaattaatacccaagaatcactgcactgggaag

SEQ ID NO: 142573 - DNA, 601 bp, Human
ccagcgcgagttcccggtgggcgtgggctcggcgggcccctcactcagagccgcgggacctgccagccccgagcagtgaggggcttagcacctgggccagcagctgctgtggtcgatttctcccccggccttagctgcctccctgcagggcagggctcaggacctgcaccctgccatgcctgagcctcctccgtccccctccccatgggttcctgcatggccagagcctccccgaggagcgctgcccccttctccaccgtgcctagtcccatcgaccacccaagggctgaggagtgcaggmgcagggcgcgggactggcaggcagctccacctgcggccccggtgcgggatccattgggtgaagccagctgggctcctgagtctagtggggacttggagaacctttatgtctagctaagggattgtgaatgcaccaatcggcactctgtatctagctcaaggtttgtaaatacaccaatcagcactctgtgtctagctcagggtttgtaaatacaccaattgacactctgtatctagctaatctagtggggacatggagaacttttgtgtctagctcagggattgtaaacacaccaatcag

SEQ ID NO: 142574 - DNA, 601 bp, Human
aagagattaagctgagcagagattttttaaatggaaaatgtgtgtatatgcgacaaaattcaaaaatactaaagcgtgaaaactgacactccctcccaacctgtccccatgtaactaaggtacttttccctgaagcaaccactcttagcaatttatttggtatccttccagaaattgtctaggtaaacacaaatatgtgcatgttttacatgaatgatattttttgatttatgctgtattttataacatatcatttaacacatatagatctgcatcactcttttatcagctctgttgtatyccattatacatatgcaccatgatttatttgaccagacacttatcaataagcatggtcctttcccacctctttttcttactaattatgatccaatgaaactgctggcaaactggtatctaattaattaatcctataagaagagtaaaatatttcaaagtggtctagtgcccacaggtgaaaagaggtaggcaaagttacatggactgaataggcaaaatgtggcaattgttaaaactcctttagaggttttgctttagaaaagaaaatgagcaatttatttggttattattatttaaaata

SEQ ID NO: 142575 - DNA, 601 bp, Human
ctgctaatagtagaatgatgctctttcatggaacgcttttcctattgtacgttatcagcaagaaattcatttttagcaatccttgaaataacaaatgcgtgtgttactatgagcttagtattttaaaatatacaacttttagctttctcactcttccccacaggtgttcatctttgtactataggaaaaacacataaaaatacatacaaatttgcttaaataatgaaatacttggccataattatacatgcagtgcagtgtatcatgtaacacagcaattctatttctagagtatgtagayatacataaaaaatgctaaacacataatttcacaacatttcaatttcttggctttggaaaaacagggtggctaataatattaagaatgatacatatgcaattttagctaaaaaaataagtacaggaactaagggtaattgaacctgtagcaattatgagctattcttttgtgatagacgtctgtcaaattatctttggctggagagaagcatgatctgtagttaaaaccaacataaattttcattctataataagtatttgaaaaaatcggtggaagagaaatgatgttttttcaaaatta

SEQ ID NO: 142576 - DNA, 601 bp, Human
ttatgaaattatgaaaacaggctagtgattgcatatttaaataacgtgatattaaattgtatgttgaaatagcatggaatcaaggaatattgaccttgattaagacccaaaacacaatgtttcacagaaaagaacttaaccaagataatgaatttcactttggatttaaaaagtcatttatttataccattcattttttctacatttacatgtttctaactgaatttaaacaaagaatggatggaaaaatatacctgtatttttcaacagtacaatgaggtaagatgggtcaacaagcatraaatgatctttcagcaaatatatcaagtttttaaatccactgaaatttgttagatatccattaggtaaatacaaaaaggaaaaataaagatatctctggaatacagtcaagggaaaacctgctaatagtagaatgatgctctttcatggaacgcttttcctattgtacgttatcagcaagaaattcatttttagcaatccttgaaataacaaatgcgtgtgttactatgagcttagtattttaaaatatacaacttttagctttctcactcttccccacaggtgttcatctttgtactat

SEQ ID NO: 142577 - DNA, 601 bp, Human
cagcttttaggatcagactggccctgattgaccagtacagaaatcaataattcagtcctatcagagcaaagaatttgaattcttccaacaacaggaatgagcttggaagtggatcttccccagagttttcaagtaagagccaagaccagccgataacttgatttcagcctgtgaggctggtagttgaaccttgctgtgcccagacttgtgacccacagaactgtgagataataaatgagtgttttaaattgttcactgtttgtggtaatctgttatggcagcaatagaaaatgaatacatrtagtaaaaaaagcagacctactgaaatttttatgaaattatgaaaacaggctagtgattgcatatttaaataacgtgatattaaattgtatgttgaaatagcatggaatcaaggaatattgaccttgattaagacccaaaacacaatgtttcacagaaaagaacttaaccaagataatgaatttcactttggatttaaaaagtcatttatttataccattcattttttctacatttacatgtttctaactgaatttaaacaaagaatggatggaaaaatatacctgtatttttcaacagt

SEQ ID NO: 142578 - DNA, 601 bp, Human
attaacgttattgtaacaatctcactaaaaatgtgctcactcttacaccaaaatattcaattaactacaatctaaagttcatttctgaaaagaaaataacagtatacaaatgaattatacaaatgaaatatacaagtgacaatatacaaatgaatatacaaatgaattaaatgcttcaagaaccaatttggtgttataacatttaaattataattttcataattatcaaaatgaaattagacatgttgtaattggaattatgtgaagataataaatagtaaccaacaacaataaagttccraattgaaagatgtaggagaaaacaaatactgtatataacagagctttttgaacataaatttttagtaggttttctaacaaataattaacagattcattttcactagagtttctagaagtattcaaaaataaaaattaaattcaactgaaaaaacagatggaacttcctttgcccttaaagatcttcaagtcttatcagggatataagatataacaaataaataaaatataaaacagactaagccatgaagcaaattattaatcatatttggaatcttcacaaatgacaatgacagaagac

SEQ ID NO: 142579 - DNA, 601 bp, Human
aatacacagaaatcacatttataatgataagccagagattcacagagatggttattataaatggctaaaattaactacgaagtttgaagtagctccaaattgttggcataatgaccaactttagtctacaatacagtaggatgacatgagacacacagcacattgtacatttcagttgctcttagcacttactttctcgtaatacttgatttcatattctgtgatgactccattgggatgctctggttcctgccaggaaagctcgacactccgctgcagtactctctccttcattactccrctcacttgcgagggagctgtttggacaagatgtgtcaataaacaatgagaaaattcactggatgcctcaaatcaaatgtcacaactgatcagtcccatgctgtgccagtttcattaaggtaaaagaaagcaccttttcatagctcacaattcagaagctaatgaatattcaaacaggaccttattactgttcataaaccttaatagaaatttaaattaaagtgcaaacagcagaagatagcattgttcaagttagtgaaaaatggaaatgatggggctgagaatgacaattaagcaaatg

SEQ ID NO: 142580 - DNA, 601 bp, Human; identical to SEQ ID NO: 30130

SEQ ID NO: 142581 - DNA, 601 bp, Human; identical to SEQ ID NO: 30131

SEQ ID NO: 142582 - DNA, 601 bp, Human; identical to SEQ ID NO: 30132

SEQ ID NO: 142583 - DNA, 601 bp, Human; identical to SEQ ID NO: 30133

SEQ ID NO: 142584 - DNA, 601 bp, Human; identical to SEQ ID NO: 30134

SEQ ID NO: 142585 - DNA, 601 bp, Human; identical to SEQ ID NO: 30135

SEQ ID NO: 142586 - DNA, 601 bp, Human; identical to SEQ ID NO: 30136

SEQ ID NO: 142587 - DNA, 601 bp, Human; identical to SEQ ID NO: 30137

SEQ ID NO: 142588 - DNA, 601 bp, Human; identical to SEQ ID NO: 30138

SEQ ID NO: 142589 - DNA, 601 bp, Human; identical to SEQ ID NO: 30139

SEQ ID NO: 142590 - DNA, 601 bp, Human; identical to SEQ ID NO: 30140

SEQ ID NO: 142591 - DNA, 601 bp, Human; identical to SEQ ID NO: 30141

SEQ ID NO: 142592 - DNA, 601 bp, Human; identical to SEQ ID NO: 30142

SEQ ID NO: 142593 - DNA, 601 bp, Human; identical to SEQ ID NO: 30143

SEQ ID NO: 142594 - DNA, 601 bp, Human; identical to SEQ ID NO: 30144

SEQ ID NO: 142595 - DNA, 601 bp, Human; identical to SEQ ID NO: 30145

SEQ ID NO: 142596 - DNA, 601 bp, Human; identical to SEQ ID NO: 30146

SEQ ID NO: 142597 - DNA, 601 bp, Human; identical to SEQ ID NO: 30147

SEQ ID NO: 142598 - DNA, 601 bp, Human; identical to SEQ ID NO: 30148

SEQ ID NO: 142599 - DNA, 601 bp, Human; identical to SEQ ID NO: 30149

SEQ ID NO: 142600 - DNA, 601 bp, Human; identical to SEQ ID NO: 30150

SEQ ID NO: 142601 - DNA, 601 bp, Human; identical to SEQ ID NO: 30151

SEQ ID NO: 142602 - DNA, 601 bp, Human; identical to SEQ ID NO: 30152

SEQ ID NO: 142603 - DNA, 601 bp, Human; identical to SEQ ID NO: 30153

SEQ ID NO: 142604 - DNA, 601 bp, Human; identical to SEQ ID NO: 30154

SEQ ID NO: 142605 - DNA, 601 bp, Human; identical to SEQ ID NO: 30155

SEQ ID NO: 142606 - DNA, 601 bp, Human; identical to SEQ ID NO: 30156

SEQ ID NO: 142607 - DNA, 601 bp, Human; identical to SEQ ID NO: 30157

SEQ ID NO: 142608 - DNA, 601 bp, Human; identical to SEQ ID NO: 30158

SEQ ID NO: 142609 - DNA, 601 bp, Human; identical to SEQ ID NO: 30159

SEQ ID NO: 142610 - DNA, 601 bp, Human; identical to SEQ ID NO: 30160

SEQ ID NO: 142611 - DNA, 601 bp, Human; identical to SEQ ID NO: 30161

SEQ ID NO: 142612 - DNA, 601 bp, Human; identical to SEQ ID NO: 30162

SEQ ID NO: 142613 - DNA, 601 bp, Human
tctgcctcactccaattttagacaaggtaatcactcaaggcctcactgagaaaggtgacattttagtgatgatttagagaaatacttgggagtgtttggtgtggctggtgtatagtggaggaagggaagagtgattgtaaggtaaggctggagggacaggcagaggttggatcctgaacggctctacctaccataaaaaggagtttgaatttcagtctaagtgcaatgtgaaggaactgaaaaaattcaaggaagtaaggatggtatgtgacattaaacaaaatcattatagctcttaaaraaaggattgtagggaagctaggatatgtaaatagagacccattaggaagccattacagcagtccaaacaagcaacaatagctacgagggcaaggtcaatggtagtgcagaaactgggcagatctgggaaatgttttagaagtagagtcaatagggtttgctgatgctctgcatccaggcaggacaggtgtagaggaaaagagctgaatcaaggaaaacacctagactggacaacagtttactgagggataagaatgatgcagatttttttttaataactcagagtttggttttagtcata

SEQ ID NO: 142614 - DNA, 601 bp, Human
gacaggatctaaagttataataaagaaaggtgaagatgtccaaggttgtactgacctgaaatacaggatagaaataataactgctgtgaattcaaaggagtgagattataagcacagtcaatacttaaagaattaagtttgtgtgtatcaaaaatgacttcccatttttaaaaatagcataaaggtagatacactggggatgagaagaaaaaatatatataaagaatggacccctgccttcatggaatgaaagtgcggtagagaagaaatttaagactaaataatagtacttaaaaacttktaaacacttaccagctgaagagagccaaaggtaagggctaatgatgaaggctaataaactcctccctcccccttttcaggatagggttagggtagggattcaacagcaaaaaagactcatacccttctcttctcacttagatccctaagagcaggcatcctcacagcatgtgctctgcaaacaccagaagcttcaaaggagtaaggattgtggcaaggaagacagaccaagggaggccctaacccgggttccctcagccccagtagaacacgtaagggataaagaaaagctcttgtgaag

SEQ ID NO: 142615 - DNA, 601 bp, Human
ccaaggctatatagctagcaagtgttaaagtgcagtctgatgccaggtagtctaacacgggaatgttaccagtcctaatttgtaacatatataaagccccatgtcgggaagtagaagttagtatcttcccttggaggaacttttactttagacttacatgaacaaattcctggcacaaaactcttctataacaaagttgactataactaggttgatcaaatgagttattatctaactgagggcactttggagatcaaaaaaagggcattaataataataatattaggacactagttgtaawctgcgatgtgtatgaccactctagccatagcttaaattccacttcatgtatcaataaggcagaatgaacatttaccatgttgttcaatgtctaaagctactcaaatggttaacatttattgaatgtttactatgtgccaggtactattctatgtgcttctcatacattaacacatttaatcctcttccatttaaaagggaggcaaatggagtcacatggttgtaacttgcccaagattggatggtcagaaaatattcagagaagccagaatttgaagcctagagcacctaatgatgaaca

SEQ ID NO: 142616 - DNA, 601 bp, Human
tgaccatgaaaaagtaacaaacttactggattcaagcaggctccataaagctttacaatattaggatggttcacacgggataactgccgaagctgttaagaaattaaggtttcttttaaaaagtgataacttttgaagtactgatttcacagtatcattaaaatcttactgttgtacaaaacatttgtttaaatcattcaacaatcactatttactatgtaacaggcattgtaatcatagtcactgaaaataccaagtgactgcccagaatggcacagaatccctgttctccagctcatasagtttagctggagagatagacatctaaacaaataattaaatcaatgtgcaaagtgctataacaggagttatgaacaaggcacgatgagtatatagaataagaagagatgaactctgccaagaaatgttaggatatgatcccagagatggtactgagctgcattatccaaaccagacgtcatgctatcattgttatcatcttcatagctatagttgaacagtctagctactctgcgtggggccctaatgtgcactttatagatattgtataattatcacaactccgcaaggtaggtattat

SEQ ID NO: 142617 - DNA, 601 bp, Human
actgaagactatactgatttcctaagggaaacctcttctgtaaagactaatgtgctggggtgggagcttggggggagggtaaagaagatacgtggagactatttttactgtgtcacaggtgcataaaagaaaaaaaaagagagaaaaggaaacaatatgttttatgtgtatgttttctttaactgaatacctatacaaacaaaacccccaaagttttagtcttttaaaatacttatctaaggaatttataagttttttaaagtcccaagtattcacattatgaagaatccagaatattttmaatttctacccagatgccaagaaatgcccttttactttcctctgaaagagcaagtaataacaactctgcaaatttctgtagaatgtttatgtgctaggtgttagggacacagcaagaaaaacgtcagacctatctctgcccccaaggaattgtctaacagcaacattatatactgcaggcacaaaatgagatttttataggctaacagattctagaagtatgctaatctaaggtagaggttaccaaaaataaaaatcccactaaagacaacatctaaaatacaagcttagataaatgact

SEQ ID NO: 142618 - DNA, 601 bp, Human
aactgaagactatactgatttcctaagggaaacctcttctgtaaagactaatgtgctggggtgggagcttggggggagggtaaagaagatacgtggagactatttttactgtgtcacaggtgcataaaagaaaaaaaaagagagaaaaggaaacaatatgttttatgtgtatgttttctttaactgaatacctatacaaacaaaacccccaaagttttagtcttttaaaatacttatctaaggaatttataagttttttaaagtcccaagtattcacattatgaagaatccagaatatttwcaatttctacccagatgccaagaaatgcccttttactttcctctgaaagagcaagtaataacaactctgcaaatttctgtagaatgtttatgtgctaggtgttagggacacagcaagaaaaacgtcagacctatctctgcccccaaggaattgtctaacagcaacattatatactgcaggcacaaaatgagatttttataggctaacagattctagaagtatgctaatctaaggtagaggttaccaaaaataaaaatcccactaaagacaacatctaaaatacaagcttagataaatgac

SEQ ID NO: 142619 - DNA, 601 bp, Human
aaataataataataataaaaataattaaaaaataaagatatagcaggtattcatgtatgtccaattatatataaaatcatagccattccaaagaatttcttttacccagtactttctgaactagaatcaattctgattctaaagtccaacttgtataccaggggctccaaagacgatttgcaagatgaatccaatcatggagaggcctggaataaatgacctagaccagaccttctgtaaatatgttaatggtatttactagcaaaaggagaatctctatctacaaatgattttagaaggwtatatctggtctaactaggttgattaaataaacctaaaattcatggggtgtagttggatgaagattagggatagtcatttaaaccatgtaattagtgcaatgtaaaagatgttagaaaatggaaatgacttccttttgtaagatatttctccatatattgttcaataactaatcatttattccaaagccaaaacatactgtaacgaggagaaaagggatacttttgggtgttgcatcagatgcgttcagactcttttaggaaaagaatgctttggctgtatctgatgcttgcctatatcc

SEQ ID NO: 142620 - DNA, 601 bp, Human
agacagcactactctgctatcaaagcagaagaactttctaatttagtgttacagttttttcctcaatatatggtgaagggaaattcttaatttataaacttaaacattacgttgtaagtaacgaaaattatggataacctgagttacacagcaaaatttacaaactaagtaggtggttgaatcagccagcacaataagcacccgtcataatctcccaaaaacaaacaaacactcaactcactgtaagaatgaacaattattatagctatagctttacatgctaagcagtacactgtaatayagcactacaaccatgctacagtctaatttgggctacaggttgactgacatctttcagaaatgaagaaacttacacagcctaacagtctgcattttgttgctctagacaattaagggttgtctagagcaataaaattaatcttttgtataaacaaatctttttgctctccacatacagtaacattgggtcattttaactcacataaaggtatattaaataagtaaataattttaaaacaatgtcaaatgtatacattctgtatatgaaacaggaggcattatttaatcttgtgtaatataa

SEQ ID NO: 142621 - DNA, 601 bp, Human
actaatcttgtgaccttaagcaagttatttaacctctctaggcctcagtttcctaatctgtaaaatgaggcaacagtactcaccttctaagggtgggtgagaatataaacaggaaaaatatgtgaagcattattattctttgcttcttctccttgatgaggcccttgcttcttcaggagaaaagggctataactctccagttatattaaccatgtcagagattttatgtatgtatttttttattttttccatgatccagcctgatgcttctccctaagagagagccaactgtctaggttgygtactgatggcctttccctaatcagcggagccagtgaacatcctcagccgcatgtgtagaccaggactactctcaatcctgctctgctggactctggggcagggacagggcagagtctgataatagcaaagcagtctcttaacaaagaattgtacattttaatgttagagataaatgatattctttagggaaggggacaggagtagtcttccaagtagaaaacacaaaaagtacttttaagaaaaatttctttttacgaaccattatgaacagcccacatgattcggaaagctgggccac

SEQ ID NO: 142622 - DNA, 601 bp, Human
tcttacagtagtgatgtaaacttccagtgactgttagtctgaagactgagactagtataccatagaataattgttagaacattttaaatattaagaggatagattatgaatgtctttctacaaactggaggcataatactcaaagtatctgctggacaaaaatgttagaatttagagaaaaaaaggaaacgtattctcctcaaattagacaaggaacagagaagcaaaattacaactgcaataacttatatatcctaaagttttaagtaatctgactacagagactaagttgttttcttaygcacacacctttaaggcctaggcttctatatatgactggtatccaaatacgatggtaaacttttagtagattagttcaagctgctttgcgtaagaaattttcaatagattgaataaacaacgttttaccatttaggaaattacttagtctatatttaaggagattgtaagattcttctactgaacaaactgtttcaaaattcaggcactttcatagatatttgaactttttaaagccaagataccacttcacagtttttgttaatgtaccaaaaaccagaggcgtaaaatattccaaata

SEQ ID NO: 142623 - DNA, 601 bp, Human
tagtagtatcactgaaaatccccaaaatattctggttttggcagaatttcaatttctcacttagactttcaactcatgtttgagcagaaagaattacatttgataaaatctgtaaatgaggaaggcatactttctcatccaaataattttacaagtcataccttccttatttggaatttgagataaatgcataaactattgctagtaacttagaaaaatatattgtaaacctacttcctatttaaaaaaaaatataagacacacacaaaaaacctttgacaactgaaactaccatggccawaaaggcttatatacattttcactcttcagacttgtagttcctttttacctgtggttgcggcgatcctagcttctatttcagacatgtcagcactcatcctcttgccctcagaggttgggggcaagctctccacactgctcccacgggaggctcccaagcttaaacgtccagattcactctgttaaaattacaggtcaatctgaattactgaagttctttagatttagcaatcttaggcaacctaaaaggaggaagatggcaaatgggattctgatagatcctgttctgctctgaaaggag

SEQ ID NO: 142624 - DNA, 601 bp, Human
aattgtttttgtgctgaccagttcttccatgattaataattttaagaactgaacaatggaatttaaatgctagctttttcaagatctaataaaattatgatattttattttacaattaaaaaaattaaccacaaccagcttagctattattttgtcactggaatgaagaagcagatagaaggtcaaatcatacatggatctggaatacatttttctgttaaatttgaaacaaaatatttgctattatttgagttcagcacaaaaatctagtagtatcactgaaaatccccaaaatattctsgttttggcagaatttcaatttctcacttagactttcaactcatgtttgagcagaaagaattacatttgataaaatctgtaaatgaggaaggcatactttctcatccaaataattttacaagtcataccttccttatttggaatttgagataaatgcataaactattgctagtaacttagaaaaatatattgtaaacctacttcctatttaaaaaaaaatataagacacacacaaaaaacctttgacaactgaaactaccatggccaaaaaggcttatatacattttcactcttcagactt

SEQ ID NO: 142625 - DNA, 601 bp, Human
aatgtgtgtggttatccttctagcaaagtcatttctgtaaataataataaaaaaccagtgcttgactagaaatatgatactagcgaagacatgaaaccattattataacaattttcagttttgagacagcaattagtatgtggcagatctatcctgaacaacatccctgaagtgaaaagggttcctcaaagcatgagggtatgtcccggtgagtagggttcatctgacactacagtgagacaaccctgctccaaagaaatacttgtgactcatggagactcatgggcttgtcagtggctgrtgacttctactcaacttgatagtttctgaagacccatctgtggcagacacagctatcttctgccagtttccactcttcccttctgttttagcaatagtactctgattttatttaggacagaaaagtcatcagataaaagagggcagatctcctcttcccttggagctacgtgtagccattcgaccatgttactttgaccaatgatgtgtggatgttgttaagagaggcatctgggaatgttccttcaaagaacttggatgtctatttgccctgcccccatgtcttccttcctattgcctg

SEQ ID NO: 142626 - DNA, 601 bp, Human
tagttttcagtttagtagaggagaaaataaccattaggtattcaactagaattatcaacactgctaaaaacacaatcacaggcaaaggacagcatgctgaagaattcatccaactcgcactcatgaacgtgtgtggaaaatatgtatttccttatcaagattttgggtaaagaggtagagaaaagcctaaagggataaataaatgataattttgataatacattaatcaatactgaaggtcaatatgccatttaagtttctattaaaaatggtaacatattcctctatgaaatgatcaccrtaagaaataaagcagtttaccaattttagacactaaagtaccatgtgtaagttaggtataaaaacatgtaatttatgagattctcctgataatacacaaaaatcagaattgaccaactattttacatgattctttggcaagataccctgcaaaacagcacatctcatttagctttactttttgttttccaggttaaggcaaaatgctatttagcaactctcttctctcaacttcacattcacttgctaccaacagaaagaggttaggacagaaagtctagaggggacccaaaaagcagta

SEQ ID NO: 142627 - DNA, 601 bp, Human
tagtctggaggaaatatttaataacttacatgcttccagttaaagaaaggtttacaaacattagttatcgaccggctcttgaaccaaatatactattaaaaaagtgatattttcatcctggtggagaaagcaaaatagtgctcaggtgtccttgaaaagcatctctgcttccagttgtttaagcattctataaagccctccccacctagataatttatttgccaatacctgacatttgaaacttctgaaggagggcaacaagatacaagtattagaagcctaactactcatctatttttcrgttaaaatgtttgggcctctctacattctacttactccaatttactacttatcatactgttagtaaaaaaccaatatacaatagagctaaacgtccttgactgaaattaaaagcgaatacgcgttttttattcagttaagagatctaaatgcggctgaaatcataaggacacctaaggtttctttttagctttaagaatgatataacaaacaataaatatcaattaagttcaggttcttcaggaaactaggcaaaaatcttatctatttcagtaagatctgactcaaaaacatttgtata

SEQ ID NO: 142628 - DNA, 601 bp, Human
tagaagttctcataactggaatatcagtggcaatagtaaacagagtttaaaaggctgagctcatcaaacctccaaagaatcaaagcaaatagcagatgtcaaactatctgttactaaatgggctgattaaaacttttaagtatctgagggggagaaaacgggaaacttcagccaaaagttctggggtcttacaaaaacagatgcactgaaaaaaactatcactaaataatgaaatcaagatttagagtcactagtatcacaaaacataataaattaatgtgtctatatagattttatttayatatgtgtttataagcattttgtgaaataaacatatttccagatataaatgaagatcaaggatattcaccacttaaatatttgaagtggtttttggtaagttggttgatgggtataaaagacttttttattaatgactacaaaggatctcccaaattttaagtatattatacaaatgatataataataaaatacctttttaggatgacaagtactaatacatattatcataaattacaacagattgtttataatatataaacgctaaaattttacaaaaatatgggtcacgatgtaataa

SEQ ID NO: 142629 - DNA, 601 bp, Human
atggcaacacttttattctagagtctacagaaaagctttcaaactagtagctgctcctgacatgtcttaggacaagcttctcattcctagtcaaacagttggctagaagttctcataactggaatatcagtggcaatagtaaacagagtttaaaaggctgagctcatcaaacctccaaagaatcaaagcaaatagcagatgtcaaactatctgttactaaatgggctgattaaaacttttaagtatctgagggggagaaaacgggaaacttcagccaaaagttctggggtcttacaaaaamagatgcactgaaaaaaactatcactaaataatgaaatcaagatttagagtcactagtatcacaaaacataataaattaatgtgtctatatagattttatttacatatgtgtttataagcattttgtgaaataaacatatttccagatataaatgaagatcaaggatattcaccacttaaatatttgaagtggtttttggtaagttggttgatgggtataaaagacttttttattaatgactacaaaggatctcccaaattttaagtatattatacaaatgatataataataaaatacctt

SEQ ID NO: 142630 - DNA, 601 bp, Human
gataacaggattaacattctgataatgtatactaagagcctatctggcacaaagtcagtgcacaacaaatggaagctgttattactttagttttctaattgatttgggcataagtctgatctctccaaatgaggtccttgcggaataggctttattggtattgtcaaagccctctagccaaagactgccaggaacacaccaatagtggaaagagttgggtttaatatttattgcagtgaaggagaatgcttaccatggggcagcatggggtgtctcagtaagagggttttagaaaaagaawgtattataggatttaggctttggttgagtgattttggggaaactcaaaggaaggaggggttcgttccagattggccgctgtcagaaagcaagggcaattccacagggagggcagtccagagtgaggaccaagctgtaattggtaaagaagcagcagtcactcttaatagctgggagaggacaatgttaggtattttgtgggtggcacagtgaccttgtttttgtctgtgcttagaaaacattccgaagtagtcttgttttgtctccttttatcacggtctcagcattatcttgtctgata

SEQ ID NO: 142631 - DNA, 601 bp, Human
aactaagaaatataaggcttgcacttttaatgcaagtttcaaaactgtttttagaccagcacagttagatttaaatccattaactaataaataaatctttatattttaagaaatgtgtatctcaataaataaaaatatgctaatatgtttgtataaaaaaactaaggaaatatttaaaaacaaggcataactgtagtttttgagtatgtgaataatacaaggcataaataagaggaacacataacatctgacaatcaatgaaaaaactcaaactagtttgtggctgaatttatgttactgyttgtaaccaactactgaagaagtttttacagtacttattttttaaaatcactggtaaaattctgagggtcacaaatgctctcaaactattaaaactcatttaagttgctccttcctctaagacatttaaaattacttattctatccccacattaattgcaaagtttaagagatataggcaaacttgacttaccaaaagaactggatatgaaagtcacaagagtatagaaacgtgacacagcaatttaaggcagcaaaagaatactaagccaaatttaaacctcaggggcagattaccatc

SEQ ID NO: 142632 - DNA, 601 bp, Human
tgtgaatgagaaaaagtagtagcagtaagaagttgggtgttggagacaagacagcccagagtttgactgtgctctgccatttctaactagtacagctttgggtaacttatttaacctctaagactcaataggaaaataaggacagtattatctatctataaggttataaaaattaaatgaaatgatgtacatgaaatgtcttcacacgagatttttttcttctttgaattttggctgtatagtcagttcctacttcaacttgtgcccgaaattatagtagtctcaaagttttactcctctycaaaagtattataacctcttaagggcagagaccatgcgtactttttatattgtacttcccaggatctgggaaattgctgaatatataataaacacataatagatactcattgaataaaatgagaacacaagctattagcactcagatacaagattggtgcttaagcttatttacctttagtatataagaataacaacgacatacaccaaagaaaaccagtgatgaaatgtttcactcttacttttaggatacttttacccttgacaaagcaagtatagacattatgaaattattcctgag

SEQ ID NO: 142633 - DNA, 601 bp, Human
tcatgttggtttggttaaattaaggcaaactctcttttctgacccctcaaacacaacacttgttactatctcatattctttgagtatgcattcccttcagtggaatgctgccttctcctttctgctttatggctaaagaaaagtctcatcattttatgaaaaggccagagactatgccaagtcttgttgaactgatttctcttacaactatcaaaacactcagcttgtactataaatttagtaagttattatatagtataagtttatttttaatgtgtcagtattatgactctaaccagamtgcaaggaatgggccatgtcttacactttatattaatacatgtttgcaaagtactaagcaaaggtgaaaattctttagtgagtttccccctctgcggctccctctactgcgtctagatctctctctcactagatcctctcagtatgtgtgtctttttgaatacccattatattataaataggaactgaagagcgcttattatcggctatgattattaaattgttatgctctttagctttctctgaaaatatacaaaaacctctcaaattaaaaaaatttaattaggtcactttaacttac

SEQ ID NO: 142634 - DNA, 601 bp, Human
gtgtgtgtgtgtgtgtgtgtttcaattgctaatcaaatctaattgcttctcctgaatgtcaaagctcatgttggtttggttaaattaaggcaaactctcttttctgacccctcaaacacaacacttgttactatctcatattctttgagtatgcattcccttcagtggaatgctgccttctcctttctgctttatggctaaagaaaagtctcatcattttatgaaaaggccagagactatgccaagtcttgttgaactgatttctcttacaactatcaaaacactcagcttgtactataartttagtaagttattatatagtataagtttatttttaatgtgtcagtattatgactctaaccagactgcaaggaatgggccatgtcttacactttatattaatacatgtttgcaaagtactaagcaaaggtgaaaattctttagtgagtttccccctctgcggctccctctactgcgtctagatctctctctcactagatcctctcagtatgtgtgtctttttgaatacccattatattataaataggaactgaagagcgcttattatcggctatgattattaaattgttatgctctttag

SEQ ID NO: 142635 - DNA, 601 bp, Human
atatacttaatttgttatttctctgaccaactcttctcccaccccaacagtggtttcaaactacgctcccacataaacactgctttccacaaaactaaaactgattaaaaatgactgatttcctcctgatttactagaaaaatttaagtgtcttgaaaaagtttcaatttaagatttccattcctattattctttcttaaatcactgatacattatatatctcattatatcagcaccctgtatctgatatgtattttagaattaagcttaatacatcagtgttgcgtggtattctgggagyagaaaaaaagtccaaggattgtgttattcaaataattaaagcccttgtatggtggggaacttaaggtccttcattgaatttcatcttctctctaaaaaaagaagtgggatttcactttctcactttacactaaattgatattgaacttccaatctctactagcaataattggtcacagatcggaagattatttaatgaaagttttttgcgtgtgtgtgtgtgtgtgtgtgtgtttcaattgctaatcaaatctaattgcttctcctgaatgtcaaagctcatgttggtttggttaaatta

SEQ ID NO: 142636 - DNA, 601 bp, Human
attataagtcagaatatgtttgtaggctatcaatatttggtttagtgtttaaatattcactttgttgtttttggaatcaggaacctgtacagtagctaaaataaagtactttttagtttatcagccctaacttctcttatttatgaaagtgttgataatctaggacatgagatggcaaacttttcctgtgaagggctggatagtctcttgtcataactactcagatctgctgttgtagggaaaaaaaagtagcctggataatttagaaacaaatgagcatggctgtgttctaataaaactrttcatggacactagaatttgaatttcctgcaattttcacatatcacaagatgttattacattttttatcaaccatttaaaaatgtaaaacaatcgtgagttcacaggcctcatgtaaactggcgacatatatagtttgttcaccctttatctagaagatgggaagtgccttctcttctactgattaaaggttattgctgtatatttttgaagtcatatttcttcccttgtgtaggaaagttttagaacaaaggaagtattatagtgatctccttcacttccttttatataaacactgatt

SEQ ID NO: 142637 - DNA, 601 bp, Human
cttctactgattaaaggttattgctgtatatttttgaagtcatatttcttcccttgtgtaggaaagttttagaacaaaggaagtattatagtgatctccttcacttccttttatataaacactgattttttggctcctcagatcttttggaaagaaagtttaagcagttaaaaactatttcttctgttttactttttatttaaaacctgatatggtttttaaaaattgcctacaattcagaaaatattctttaatgcactcgggaaaatatttatattgaagaacctgtttccttgtaagwtccaaccatactgtatctaaagataatctgtttgaaactcctgttttatttccctatgaaaaccatctttgaattgtgattaggctcccaaagcagtgaacaaaatcttacttagcatataatgtagttaaagtagcaggctggagtcacctggtgtccttctggttcttaacctggagttgtcaaagtatggctctggaaagcctaaaatatttgtttctggccctttgcagaaaaatttgctgatccctgtttaaccttgagcctaaagatttgaatggaggtgaaggggaactgggg

SEQ ID NO: 142638 - DNA, 601 bp, Human
agttttagaacaaaggaagtattatagtgatctccttcacttccttttatataaacactgattttttggctcctcagatcttttggaaagaaagtttaagcagttaaaaactatttcttctgttttactttttatttaaaacctgatatggtttttaaaaattgcctacaattcagaaaatattctttaatgcactcgggaaaatatttatattgaagaacctgtttccttgtaagttccaaccatactgtatctaaagataatctgtttgaaactcctgttttatttccctatgaaaacyatctttgaattgtgattaggctcccaaagcagtgaacaaaatcttacttagcatataatgtagttaaagtagcaggctggagtcacctggtgtccttctggttcttaacctggagttgtcaaagtatggctctggaaagcctaaaatatttgtttctggccctttgcagaaaaatttgctgatccctgtttaaccttgagcctaaagatttgaatggaggtgaaggggaactgggggacaataggtgggaggtgggtgaggaaagtagaaatagtttgatccttgggtgatggcagtacc

SEQ ID NO: 142639 - DNA, 601 bp, Human
aagcagtgaacaaaatcttacttagcatataatgtagttaaagtagcaggctggagtcacctggtgtccttctggttcttaacctggagttgtcaaagtatggctctggaaagcctaaaatatttgtttctggccctttgcagaaaaatttgctgatccctgtttaaccttgagcctaaagatttgaatggaggtgaaggggaactgggggacaataggtgggaggtgggtgaggaaagtagaaatagtttgatccttgggtgatggcagtacccgagcaggtctgggaataaggaagtaygagggagacttggtacccactgcttatggttttaccaaaggtcttggacaggctctggtgcctgagagatggctgctgctcagatatacttgcaggcaattcttaaattaagtgtttatatgtttcctgcatttctagttttatagaggtgtgttcttaatattcttttcctgtgttatgaattattgttttgtataatgcaatgaaatgagtggctagttgtaagttcttattgtgaaaaagttttatattaagccccactcatttctcaattattattttctttctgctgcctttaaa

SEQ ID NO: 142640 - DNA, 601 bp, Human
attttttagttgtcacaacttgagagatgctactggcatctagtgggtggagaccaaggatgctgctaaacatcctgcaatccccatgacagcctcacaacaaagatttatccagccccaaatgtcagtactgctgaggttgaagaacgctgctgtagaatagaagttggcaaactatgtctcatgggccaaatccagcttgctccctggttttggtgtaatggagactgactggcttgcaaagcctaaaatatttactgtttggcccttacagaaaacaattattgacttgtgttttggwtgaatataataataataacatttcttgagtgtttcctatgttaagtgctaggcactgtgctatgtgttttttgtgttttctcatttacttcttccacattttcaaggtaagtactttacccctgttttattgacgcagcatctgaggttccttaagattacactgttaatatgtggcagcactgggctttgaatcagaaacatcatgcaagaattgtttagctaaggatgtggtataagagagggttaagaattaggggcattggaggagatagacctaattttaatcctagactgagat

SEQ ID NO: 142641 - DNA, 601 bp, Human
taggggcattggaggagatagacctaattttaatcctagactgagattgtggctgcatacacacttgtaacctctttaagcttcagtttgttcatttttttaatttgagaaaataatatggggtgctgaaaattaaataaaatctaataggtaaattaccaggggaaagatttatgagatggggacctataggagtcattggggcagttaagaagtcatacaggtttcaagatgtgtgttggtgagtgaagggaagcagggaggaatagtgttgtgtgtaggcttttatgtagaaacagayattacatttaaatattgaaatgttacacgacattgtgattgcttcagcttcagcaatgtgtgatgagacagttgataatgcaactgcaagcatggctatcattttgggaaacataccgagtgaaagtgttgaaaattggttctagatcttgaaaaggcttatactaatccacttgaagtagttcgaatatgaaaaatatgtgttataaataaagtttcagtgccacacacaaaaaaacagcactcgaatacaaaattttctttttttcttctcagcaaggcagttttccttctatagaag

SEQ ID NO: 142642 - DNA, 601 bp, Human
gaggaagttaaatttaaaagtagaaggcaaagaattgaacatactgacatactgattcttcgaagagaaatttagaactcatatctaacaatcccctcctcttgcattttccttacacctctttctcttcaaacttctttaacatgccttggcttagttctgctcaattttccgaaagaagaagcttctctggataaggtggaggatagttaagggaggttttagtaagtgccatttctatgagcacttactctgcaccaacccacagatgcatggtatgacacagcacccgacaagaatragtacacccattacagctgtgagggaagtaagaattgaggctgttattcctttccatttaccgaaccacttttctagccatcctgtaaaggggtcatttaccgctgagctgctggctaactcattggacagagcagtcagaccttgcaatgcctttgttatacttccattaggggcagtgttgtttgggatgaaggcacaacattcagttttaatcatgatgcaaactcctcctctttctgctaatatcatgtctaaggctatcctattttcccaagccatctggcagttagtccctaat

SEQ ID NO: 142643 - DNA, 601 bp, Human
agtaagtgccatttctatgagcacttactctgcaccaacccacagatgcatggtatgacacagcacccgacaagaataagtacacccattacagctgtgagggaagtaagaattgaggctgttattcctttccatttaccgaaccacttttctagccatcctgtaaaggggtcatttaccgctgagctgctggctaactcattggacagagcagtcagaccttgcaatgcctttgttatacttccattaggggcagtgttgtttgggatgaaggcacaacattcagttttaatcatgatgyaaactcctcctctttctgctaatatcatgtctaaggctatcctattttcccaagccatctggcagttagtccctaattgctcagctattcctttaacagcatctctagtgtagttcataaattgctgttggttataatagatgtagtttatccaatctatgtttttattaattgtgacccaccaaaatattgactcaaatcctgcagctatttgatttcgggctttaaattgatctggtattccccgtgggactccaattgcatctaaatagacatgagagttgaatgacctataaggag

SEQ ID NO: 142644 - DNA, 601 bp, Human
ttgtttgggatgaaggcacaacattcagttttaatcatgatgcaaactcctcctctttctgctaatatcatgtctaaggctatcctattttcccaagccatctggcagttagtccctaattgctcagctattcctttaacagcatctctagtgtagttcataaattgctgttggttataatagatgtagtttatccaatctatgtttttattaattgtgacccaccaaaatattgactcaaatcctgcagctatttgatttcgggctttaaattgatctggtattccccgtgggactccarttgcatctaaatagacatgagagttgaatgacctataaggagcttctctcactttatgatgtcttatttttccttcctctggttgatgaaatgccagagtaaaagggatagccaattgaactagagcataactactgctctaattatttggcagagtgtccagtaaaggtcctccataataccaccatacatccgctcagggatgaataagggcagattgacgggtcacctcttggaagtgcctaacttcactgcatcctgttaagtctccaagaaatgccaaatttttccccgtgtcgt

SEQ ID NO: 142645 - DNA, 601 bp, Human
gcactccatgtccacttgatttgaggaccatcccagtggaaaggtaacaacctgggcctctagcctaccgtgcacacaagtgtaacagttacttttgtttaaagtgtgaatggaatatttaatacattttaaccaggcatttacatctttataccctgtcaatagctatggtttgccttaggtctcctatttctactactgagaccttgcttttgtcatttggcatgaggcgaggcatagttttatttcgtaggtttgtgaaaggggcagttgtaggaggtagagcagggagaacaaagcrcatcttaaagaagcctatagggtcctttccagtgacttctgctcctaaaccatagaaacgctctaaagtggggttagagttgctagtggtaggaacagtaatggatataggcactgtgttaggaaaggaaaggaaaagatagatagactaagcttttcttagctttaatttggtaaggcttgatccaggaacaatggtccatgattctgatggtaatggtgcttgcttgactcgggtgtgatgtgtccatcccccttctgtggtacaaaccatagtcttggtggttagcagcacaaggta

SEQ ID NO: 142646 - DNA, 601 bp, Human
ctctctgtctctctctctctctttctctctctctgactctctgtctctttctctttctctctctctctctgacttcctttcccagtttctctttcctctctgctggtctttccctgcctctgccagccgcttatgctgctgttcttccctctcctccttcccctaggggagcgaccagtgggagtggagtttagcctttctttcccccgagaagaagcgaaaggggagttctgaatatttttcttactactggaggtttctgtgaggttcagccccccacaatggggatttctcacctcaytgaggttcaatgtacccctattgggatttttcacctcttttgaggttcaacccctcgtaatggggatttctcagttctttgaggttcagcccctgaaattagcggaaggctcaacccatcaaaccaggggtgtcttccctcgcctgtcctggaagactcaacccctcaaaccagggatgtcttgccttgcctgccgtggaaggctcaacccctcaaaccagggatgtcttgccttgcctgctccggaagcctcaacccctcaaaccagggtgtcttgacttgcctatcctgggaggttga

SEQ ID NO: 142647 - DNA, 601 bp, Human
tgtctctttctctttctctctctctctctgacttcctttcccagtttctctttcctctctgctggtctttccctgcctctgccagccgcttatgctgctgttcttccctctcctccttcccctaggggagcgaccagtgggagtggagtttagcctttctttcccccgagaagaagcgaaaggggagttctgaatatttttcttactactggaggtttctgtgaggttcagccccccacaatggggatttctcacctcattgaggttcaatgtacccctattgggatttttcacctcttttgaggttcaacccctcgtaatggggatttctcagttctttgaggttcagcccctgaaattagcggaaggctcaacccatcaaaccaggggtgtcttccctcgcctgtcctggaagactcaacccctcaaaccagggatgtcttgccttgcctgccgtggaaggctcaacccctcaaaccagggatgtcttgccttgcctgctccggaagcctcaacccctcaaaccagggtgtcttgacttgcctatcctgggaggttgacatgtttcctcccctttccccctctgaaggtcccttgcaca

SEQ ID NO: 142648 - DNA, 601 bp, Human
ggaagactcaacccctcaaaccagggatgtcttgccttgcctgccgtggaaggctcaacccctcaaaccagggatgtcttgccttgcctgctccggaagcctcaacccctcaaaccagggtgtcttgacttgcctatcctgggaggttgacatgtttcctcccctttccccctctgaaggtcccttgcacacttcccactcatgttgtcctctctggctgctcccccaagggagaattaggcccttcttagtgttggcgtgctggtataaatcccacagcaggatccgccctaagccataygaggtagctgtggaactgcagagaggacgcactcactccatccagcagtaggacttgtcaccatccacacaacaccacaagcagggttgtctgtgatcattcacgcacacacacattcagccctccagactttgaccaccaaggaagtactttactggctcccgtggtttcttcttcattggtctgtgcacagtcattgctgtggtatgtgaggatcctttacctcaggttgccagccggtttggtttctttctgtgttgctgagagctcgggttattccttgcactgggcgggtcctga

SEQ ID NO: 142649 - DNA, 601 bp, Human
caagggagaattaggcccttcttagtgttggcgtgctggtataaatcccacagcaggatccgccctaagccatatgaggtagctgtggaactgcagagaggacgcactcactccatccagcagtaggacttgtcaccatccacacaacaccacaagcagggttgtctgtgatcattcacgcacacacacattcagccctccagactttgaccaccaaggaagtactttactggctcccgtggtttcttcttcattggtctgtgcacagtcattgctgtggtatgtgaggatcctttacctsaggttgccagccggtttggtttctttctgtgttgctgagagctcgggttattccttgcactgggcgggtcctgatttctcacccctgaggacgccacaagggggcggggtgcacctcctcacaagagagaaccagagaccgcctctggaggggaatgtaatcccagacgagcccctaaattgttataaagttttggtgctgcaaaagaaatagcactcgaatataaaattttctttttttcttcccagcaaggcagtttccttctatagaagggtacaccctcacagttggagcagtggt

SEQ ID NO: 142650 - DNA, 601 bp, Human
tgatcattcacgcacacacacattcagccctccagactttgaccaccaaggaagtactttactggctcccgtggtttcttcttcattggtctgtgcacagtcattgctgtggtatgtgaggatcctttacctcaggttgccagccggtttggtttctttctgtgttgctgagagctcgggttattccttgcactgggcgggtcctgatttctcacccctgaggacgccacaagggggcggggtgcacctcctcacaagagagaaccagagaccgcctctggaggggaatgtaatcccagaygagcccctaaattgttataaagttttggtgctgcaaaagaaatagcactcgaatataaaattttctttttttcttcccagcaaggcagtttccttctatagaagggtacaccctcacagttggagcagtggtgagcacacacttggacaagggaggaaaagggggtcttattcctgatgcacgtggcccctgctgctgtgtcattcacctattggctagggttagaccgcacaggctaaactaattccgattggctaatttaaagagagtaacggggtgagtggtttggcaggaaaaatg

SEQ ID NO: 142651 - DNA, 601 bp, Human
tcatggccaacagcactataacatgcctgaacaaagcttatctatcacatgtattttctccataatatatagcatatccttcttatacttaggaacatcagacagtgcgtcagccctacaatgcttgggagccatttaaacaaaatcaccaacacaaagcacaaaaatgcaaaaaatgtggtactgaatagattgcacttgtttatgatctgaaagcggaaacaaggcagaatgttaacttgttcagcgtcagccaggaatgtgcacacttggtgaatcaaattttttgccactctgcacrtgtctgccaatgactgcaagtgttaccagcattgatttgggggttacagatacattttaatgagtggagaattcacacgtacagtccatgaataataataatcaactatagtaggggaaggaaagggaggtatcaggaagcatatctgtgtttcctagtataaacaattgggtagagttattattatttttgttttttgaaacaggaaaaacagatttgggggaaaaagatatcaacagtttgattttgggtaggtataatttaaagtttttaatgtcttgagacatccaaatgggcagt

SEQ ID NO: 142652 - DNA, 601 bp, Human
agctgtggctctcaagagacaggattagttcttgcaggaattgattatttctcgggagtgggttataaagccaggatgctcctcatgttttgctctcttcacacgtgtccacctccccttagaccttctctgccatgtgatgcagcaggaaagccctcgaagaagccagggccatgcccttgaacttctcagcctgctcaactgtgagctttttttttttttttttttttttgtagatggagtcttgctctgtcatccaggctggagtgcagtggcgcaatctcggcttactgcaacctcsgcctccaaggttcaagcgattctcctgcctcagtctcctgagtagctgggactacaggcatgtgccaccacgcctggctaatttttatatttctagtagagacagggtttcaccatattggtcagactggtcttgaactcctgaccttgtgatctgcctgcctcagcttcccaaagtgctggtgagccaccgcgcctggccaaattttttttttttttttttaataccagtctcaggtattctttcacagcaacgcaaagcagacaaagacagtatttaacatatttaaaagagaactct

SEQ ID NO: 142653 - DNA, 601 bp, Human
ttcagatttcaggatttttaggattctgaaatatttgcattatattaatttgatacgagcatcccaaatctgaaaacctgaaatccaaagggctctaatgagcatttcctttgaatgtcatgttggcattcaaaaagttttaggttttggaacatttcagattttgaattttcagatttgggctactcaacctttatcttcattttggctgaaactattatttcctcttctttgatgagaaatcttaggctgagggaaattttaatttgccaaaggaacctagaaagtaattgacaatgayaggattagaagacaagtttcttgaactctgattttcaaattatgagtctttcagaaaaatgaagtaattaagtatttttgattaagacaaagataagcacagtggcgttgttagacatttcagtagtttacaataattttttctcttaactttttatttccaaatgttaacactttgccatgtgtcttcttcattcaggtggctctataataaaataccatagaccagttggctcaagcaacatttatttcttacatttttggaggctggaaagtccaggatcaagatgctggcagatta

SEQ ID NO: 142654 - DNA, 601 bp, Human
tcctgcctcagcctcccaagtaggattgggattacagggatgcaccaccacacccggctaatttttgtatttttagtagagatggggtttcaccatgtttgctaggcttgtcttgaactcctgacctcaggcgatgcacccagcttggcctcccaaagtgctgagattacaggtgcgagccaccacacctggcctaatcctggtttcttgattaaggtagtgcctgctaggtttctccacataaagttaccagttttctctttgttattaacaagtgtcttttggagagatactttgagaygagataaatattctctttctcatcacactttcacctactggttttgtggtctgatactgttgtcaaatgataacttcctgatacttcatcattacctatacatttattggcattctactctagaaatttcccttcttcccccctttctctccctctttgtatttatatgaacatggactcaaggattattttattgtgcaggttagaatccattattatcattattttgatgctcaaaatgtcccagatttgcacagtgggattaaacagtttctttttagcatatcttgttacaggctt

SEQ ID NO: 142655 - DNA, 601 bp, Human
ttgatgctcaaaatgtcccagatttgcacagtgggattaaacagtttctttttagcatatcttgttacaggcttttcttgtactttccctgccccaaccctgaaatcatacatttcttcaaggatcctttattccttttttttccagaatggtatttggaaaccagaatctaggcatttggtatacacattgatactggagtatcattactttagacccttttagcagagctatgaaatatatatgcatgtgtatgcatagacacctatctaaatctagttgtgtgtgtgtgtgtgtgtgtataacaaagagttctacattgattgataccacaattttgatctaacatcactgtgttcattctaaacttctccttacccatgtttgttcccttatctaatggtgaggattctagctcccattatgctcaagatgtttacttatttgctcaatcctagaatagataatgagtagtttcagaatttctaatatttacctgagaaaaaaacaaactactaactgaagtatgtatttgtatgtagttctctttgttttagttttacagcatacagtaaaatactgtgttttagaatatttgagt

SEQ ID NO: 142656 - DNA, 601 bp, Human
atgaattattatatcagataacttttaaattaaaagagaaattagtaaattctgttttgagggaggggcagattagcagttggatattgcgaaagctgtacatgtaaataaggtgattttttttaaatatttgaatttttttttttttttttgagacagagtctcgctctgttgcccaggctggagtgcagtggtgtgatctcagctcattgcaagctccgcctcctgggttcatgccattcttctgcctcagcctcgcgaggagctgggactacaggtgcctgccaccacgcctggctawttttttttgtattttttagtagagacggggtttcactgtgttagccagaatggcctcgatctcctgacctcatgatccgcctgcctcagcctcccaaagtgctgggattacaggcatgggccactgcacccggccaaatatttgaattttaagttatcaatttctaagctataatttggttgaaagataaacaatacaacatttaaaagtactttttcataaaattaattactgctgcaattcacgggaaaattgttataatgctttactagactctatcacagctgttaacactaacag

SEQ ID NO: 142657 - DNA, 601 bp, Human
tgctttactagactctatcacagctgttaacactaacagtttagatttaaacctgtcattgttagtataaagaaaaggaagtgaaaacactttcatattgccttggaacaaaggaacaaagtcaactttttttttttgagacagggtatcactctgtcacccaggctggagtgcagtagcgtgatcttgacttgctgcaaccatcgcttcctgggctcaagcaatccttctgcctcagcctccccagtagctgggattataggtgcgtagcaccacacccagctaattttgtagacatggrgtttcgccatgttgtccaggctggtctcaaattcctggactcaagcaatccgtctgccatggcctcccagcatgctgggattataggtgtgagccgctgcgccagctcaaacaactttttattgtttgctattcaccatagtttataaagactatccctagcaggatgtgtaaatgttaatgtacatacactttgggtgtgtttagtaacaaaccaaatatatcttaactttgaactacatacccatattaagaccagagaaaattattctactgtttcatagtattatctagagaaatt

SEQ ID NO: 142658 - DNA, 601 bp, Human
ggtttacattttcagtacccttttgtacccatgctataatgggttcagggtgttggggaggaagtaaaaatcatgtccctcatatgaagggtatttttgtcctcaaattgacctcattattggttttttaacctagcccctcaaagtctttttttttttttcttttttgagacagagtctagctctgtcgcccaggctggagtgcagtggtgcgatcttggctcactgcaagctctgcctcccgggttcatgccatcctcctgcctcagcctcccgagtagctgggactacaggtgcatgycaccacgcccggctaattttttgtatttttagtagagacagggtttcaccgtgtaaatcaggatggtctcgatctcctgaccttgtgatccgcccacctcaacctcccagagtgctgggattagaggcgtgagccaccgtgcctggccaatcaaagtctttttaggtgagttaattatacttaactttgtagatgataagaaatttataaacaaaatttaactttcttaagctcatgagtaacttctgctgtgttccattttgcacagtgacttggtaacctagccaaggattttatgcc

SEQ ID NO: 142659 - DNA, 601 bp, Human
ctctatttaagatgttggccaggtgcagtggctcatgcctgtaattccagcactttgggaggccgaggcaggaggatcacttaaggtcaggagtttgagaccagcctgccaacatggaaaccccgtctctaccaaaaatacaaaaataagccgggcgtagtggcctgtgcatgtagtcccagctactcaggaggctgaggtaggagaatccatgaacctgggagatggaggttgcagtgagccgagattgcaccattgcactccaggttgggtgacagagaaagactccgtctcaaaaaaracaaaacaaaacaacaaagatgtaaggaaagtatatggggcatcttagatttgcattaagcagttaaaaaaaaaggcaaacattagtttaaagagccaatcttcagaagcctggaaaactctcctacatagattttttggtggaaaatctgtggtatttttggtattcttctgcttttcgaatagagtttgtagtccaccactaggctgtgtgcgttccttttcagcatatagacttaacactgtggtgtgggtttggatttggtaatacaaagagatctgtaactaagaaggatgtctt

SEQ ID NO: 142660 - DNA, 601 bp, Human
gatcacttaaggtcaggagtttgagaccagcctgccaacatggaaaccccgtctctaccaaaaatacaaaaataagccgggcgtagtggcctgtgcatgtagtcccagctactcaggaggctgaggtaggagaatccatgaacctgggagatggaggttgcagtgagccgagattgcaccattgcactccaggttgggtgacagagaaagactccgtctcaaaaaagacaaaacaaaacaacaaagatgtaaggaaagtatatggggcatcttagatttgcattaagcagttaaaaaaaaaggcaaacattagtttaaagagccaatcttcagaagcctggaaaactctcctacatagattttttggtggaaaatctgtggtatttttggtattcttctgcttttcgaatagagtttgtagtccaccactaggctgtgtgcgttccttttcagcatatagacttaacactgtggtgtgggtttggatttggtaatacaaagagatctgtaactaagaaggatgtcttttgtttctgtggcttaggtcaaagttcctgtcttattaattaagcattttcttggaggtagaatgttctacagc

SEQ ID NO: 142661 - DNA, 601 bp, Human
aaatctattgtaatttaaaaaaaactttaaaaataggccaggtgcagtggctcacgcctgtaatcccagtactttgggaggccgaggcgggcagatcacttgaggtcaggagtttgaaaccagcctggccaacaatactaaaaatacaaaaaatttagcttggtgtggtggtgggtgcctgtaatcctaggtactcaggaggctgaggcaggagaatcacttgaacacgggaggtggaggttgcagtgagctgagatagcgccactgcactccagccggggcgacacaacaagactccatstcaaaaataaatataaaaataaaaatggatatgcaaactgatcaattaaaaagtaatcagggtgaacttgatgaaatagttaaagtagcaggggatgaatttttttataggtaatatcaacagttttcctaatctcattattcaatatactcagaatctctcagagctttgactagagatagtggtaaatctagttgttgtcatattttcccaaacagaactataattttttaaagaggatacattattggtatgtttcttttaatctaaaactagttagaaattattagtttgctaaat

SEQ ID NO: 142662 - DNA, 601 bp, Human
tctttagtttttaagagttaatgtgaaggtacataacagatttttaaagagttaacgctaagatacatacatgattttttttcttacattgtatgcctcaatcagttatttccccaaagagaaacaggaaatgggatgccagtgaatagttttgtgaaggtcaggagtttcctacagttgaatatttactctaacttttagcaaacagactatggttctcttaggaatggaaggcggctgggatgtacagtgcttgtgaacagtatcatatccccaccctccaggtcccctccttccccarttaaaaccctactgtttctttctataatatggtttctagacagacttcctgatccctgccttctgcccctacacttttccttatatttttctcctagatgcattcatctgtcattatttctcaatatatcctaaaaccccactgtctcccaatgttgtctaagtaatacgaggcacagtttggtaattacccctttgttctgcataccggagacttgttatacagtcatgcatcgcttaacaaagaatataagttcagggttctgagagatgcatcattaggtgatttcactgttgtgca

SEQ ID NO: 142663 - DNA, 601 bp, Human
aagtaatacgaggcacagtttggtaattacccctttgttctgcataccggagacttgttatacagtcatgcatcgcttaacaaagaatataagttcagggttctgagagatgcatcattaggtgatttcactgttgtgcaaacatcatggagtatacttacacaaatctagatggtatagactacttactacacatctaggctgtacagtatatagcctattgttcctaggctacaaacttctgcagcatgttactgtgctgaatactgtagcgagttgtaacacagtggtaagtttagcrtacctaaacatagaaaaggcacaaatatagttttatcttacaggaccgctgttttatatgtggttcatcatggactgaaatgtcattatgtggtacatgactgttaatttctggggggcaggcaaagtatctattttacaattgatcataaaccactacatgtaactgtgtcacccaaatagtttgtctcaaatgtatcttgtatccctctcaccccactgttccctcaatctgtctgcactgccatgcactcctccactactggttaagtgggttccaagtgtcaggactggaatagac

SEQ ID NO: 142664 - DNA, 601 bp, Human
ctgaatactgtagcgagttgtaacacagtggtaagtttagcgtacctaaacatagaaaaggcacaaatatagttttatcttacaggaccgctgttttatatgtggttcatcatggactgaaatgtcattatgtggtacatgactgttaatttctggggggcaggcaaagtatctattttacaattgatcataaaccactacatgtaactgtgtcacccaaatagtttgtctcaaatgtatcttgtatccctctcaccccactgttccctcaatctgtctgcactgccatgcactcctccamtactggttaagtgggttccaagtgtcaggactggaatagactctcattgacactagaactcaaactctggcttattctaaaccagaatgcaggttgagtttgtatttattaagctcttcttgttagctttgggtcattgctcagccccttgagttatttccagttcttacccattattagcttctcctttgggtattacgctttccagagtcaaaaaaaatatgccttctgggtctttaatgaaaattttaggtagaacaggaccagagttctgtggctgtacctttagaattctctcta

SEQ ID NO: 142665 - DNA, 601 bp, Human
ttctgtggctgtacctttagaattctctctagcttgatctttttcttgcttactgaacatatcatctctcatagtttttatgggtcaggaatttgagggtgccttagctagctggttctggcttgaggttgcagtcaagatactggctagggctgcagtcaactgaagacttgactacggctggaggatctgtttctaacgtggcttatctatatgcctggcaagttggtattggttgatggcctagcttgattttgttcaattaactaccatttttctgtatgagcattcacacacttayggattgtacctttatcctcactacagttctgtgttgtctataaaaatattatgtggctggtcgcagatcaccaggtgaggagttcgagaccagcctggctaacatggtgaaaccccgtctgtactaaaaatacaaaaacttagctgggcgtggtggcaggcgcctgtaatcctagctactcaggaggctgaggcaggagaatcgcttgaacctgggaggcagaggttgcagtgagccgagatcgcgccactgcacaccagctcgagtgatagtgcgagactctgtttcaataataataat

SEQ ID NO: 142666 - DNA, 601 bp, Human
aaaaaaaagctttctttaatgccttacaggattttttgcaagcctccacttattctgagttttcgatttcttgatactattcttaaattcctggttagattcctcttggtgatctgtacttcggctttgttcttgtaaaatcagaattcagtgaagatgcccttatttagatatgttgatttccttatgtattcttttttttacttttcaccagaacctccttcttcagtaactcttaatctctcttgaatgttcttctcacgagccatggaattctaacttgaagttttacatttttgarttttgatttattcaggactggagcacatgtctcttaactgtgctgtgtttggctcatgctcagatcacatggttgctttctgccaaagttcccatcacatctacttcatcacccagcagtttcttgtcagaatcaagtccagataagctgtttccatcactatttttcctaactgtagagacattcaactggcaggaaagtaagtcaagaatttatcaggcactctatttttagcagttggagcttcccagcagatgttgggataggtggtatctcacactatgattttattctatctat

SEQ ID NO: 142667 - DNA, 601 bp, Human
ttacttttcaccagaacctccttcttcagtaactcttaatctctcttgaatgttcttctcacgagccatggaattctaacttgaagttttacatttttgaattttgatttattcaggactggagcacatgtctcttaactgtgctgtgtttggctcatgctcagatcacatggttgctttctgccaaagttcccatcacatctacttcatcacccagcagtttcttgtcagaatcaagtccagataagctgtttccatcactatttttcctaactgtagagacattcaactggcaggaaastaagtcaagaatttatcaggcactctatttttagcagttggagcttcccagcagatgttgggataggtggtatctcacactatgattttattctatctatgccagtcttgaaatttgtattataggaaagtatacttgttaataatgtatagtctatagcagtggttctcaaactttagcgtacatcagaatcaactggaaggttggttgaaacagattgctaggcccattcccatagtttatggttcagtaggtctggggtagagcctgacagtttttatttctaacaaacccccagtg

SEQ ID NO: 142668 - DNA, 601 bp, Human
ctcaggtaccataaagtggcacttttcttatatcaggcttatttattttgaacaaggtatatacttccttgtcatattacagtcatgaatctcaaccctctaatttcagtgatactattgagatagtatttatctttcaggaaagactgatgaaagctcctgacagtttagaaaagaaagagaaaataaagtgaaacagagggttaggacccatatacttggatctgtgagcactggtctcacactattttggttatatatacttgtcaattttgcctatacataacagagctgtgtattrtaatcttctttattcatttagtatgtatcttagtccattttctgctgctataacagaatacgcagagtgggtaactcataaaaaacagaagtttatttggcccatggttctggaggctgggaagtccagaacacggtgctggcatctggtgaggctcattctatggcagaaggcagaagcgatcccatgtgacagagggaagtgggctgaactcatcctttttatcagaaacctgctccctcaataactaactcattccctcagtaatggcatcaatcccttcttgaggacagagccttc

SEQ ID NO: 142669 - DNA, 601 bp, Human
acatgtgttttgaagttgacattcaaaccacagcagtgtgtatagacaatgtatctggtacacagaaggtatactaaaaattcaataaattggggagtcttaagaggcagcactgtatcctgtaggtgatgaggaataaataagttaaattgttatcattttcaggattgatgctataagctcttaaattagagtgataatagaaattaaaattaagtagtatgctgacttggcctgttcaaaagttcatgctagagtgcttattggtattaggaaacagtgggcacatattatattaagyatatactatggctgtgatttgagggacacatttttcacttaagccaagtgccctggttaatttctggaatggtctttttgtttagttgtcttattctgtagaatagctgtgtctgatgtggaatatacttttagtaagactgtaacaggtttttgtatttatttgtttggactcttggatgaactctgtttattagtcactaaaaataactttaacaattaatattgcaggtggaacaaaatccattattagggtttggcgctatagctattgctgtattgtgctcaggatttgcaggta

SEQ ID NO: 142670 - DNA, 601 bp, Human
tagttgtcttattctgtagaatagctgtgtctgatgtggaatatacttttagtaagactgtaacaggtttttgtatttatttgtttggactcttggatgaactctgtttattagtcactaaaaataactttaacaattaatattgcaggtggaacaaaatccattattagggtttggcgctatagctattgctgtattgtgctcaggatttgcaggtaaatcatgaaagcattgttttattcttttgtcatatttttcgaaaacatcaaactttagacaccagtctagtttatcttgcttyctcagttttattcccattaaacttgatcttcttgcttatatttagttttatgtcagctgtttttccagtaaatgtatagcattgttcaactaagttcagactcagtccctattcatacttgcagttaactacttctgttatccttgaccatctcagtccggccaaaaacccaaaagtaaatgaaaaaagacttctgaaaatggaggaaattagtcttcagaaagccctttccttttttctggaactgccactatcaagtcagatcctgctgctttaggttgttaatgttaccagctaagt

SEQ ID NO: 142671 - DNA, 601 bp, Human
ttggcagttcctaagtctctagcatgatatttataactaaaatctttaatggctttgtaaaatatgcattcattttaagcataaatccagagataggggacttttgttggggaggggtatcatgtactcctttgaagtatctgaaaaaatctatggaccttcaactccagaaaaatgcacatatacacaaaatttattatccagttggggagttcatgatccttctgaccttgtgtatgaacttggcttgtggaaccctgctttaaaggaaaatggctttacacagcaaattctacttcarttttggttgttactctgaaaagattcctagtggtgattatagattatattgcagaattaggagtattcattagtaggcagatattacagggatgtgattaagataattcactcttaatgtagtttttcagctgaccaaagcaaatgacatactggcattaagtagtacagagagcttttgtggtcttactgctctaataaaggcagaaactgtcttaatttaacagccttctgttaaatgtagcttataaacttcccaattagttattattctatatactctgtaaaaacataaatttat

SEQ ID NO: 142672 - DNA, 601 bp, Human
tttatttctctctgtatacaagttcttgcaagtgttggtggcctctacacttctgttgtggttaagtacacagacaacatcatgaaaggcttttctgcagcagcggccattgtcctttccaccattgcttcagtaatgctgtttggattacagataagtatgtcttagtttgtgttgagtttttaacatggaagagcctcccatttccttgattcatttaatcccttatttaaaagtggcagttggtcatactgtttacagaaattcctagctttgttactacagtttattccaccagtayagctgttcatagttgtgtgggatgtggctaagcagtactttggttgtttaggtggtcttagaggttaagacgaggggtgctagttctatgtgaaagtgaggggactttttttgcagtcaaggcctccctgtatttttaggtattgtatataggacaacttgagtgtctgaatgtgagaaggtactcaaggaaatacatataaagactttaggaaattattttcagcagtcagtttaaactatattggctcattatttagaagaatgtagaaaacatcttttagtcctccctcagcttgta

SEQ ID NO: 142673 - DNA, 601 bp, Human
cgtgtaaagattgatttgataaacaaaaaggctgaaatgtagaaagcaaaggagagagtgatatgagaggcaggagatctttcatgcaggatcatgaataatttttatatctttctcagcgggaagccattgacgagtttggcgcaagggggtgtaatgatatggtttatctttttttaaaaaaaagtttggctgctttttgtggaattaattagggggcaagattaaaagcaagacaataaattaggataatattgtagtagtcaaggtagaagtggtcggggcttcaattagcatgatrtcagtggagactggggaagagaagttgataggttgaggatatgtttggatgtagagcttacaggacttgatgaactgtacattgagtgtcagaataagaggaatcaaaaggttttgtttagcctgaggtattagtggtactgccatttactgagatggagtagactgatagaagaatgagaaggaaattaacaacactggtcatactaaatttgagatgcctgtttgacatttttgctctgaagtatgttttatatctttataactactaagattctaattccatttctttttatagctt

SEQ ID NO: 142674 - DNA, 601 bp, Human
atgatcgtaccactgcattcccacctgggagtacagagcgagaccctgccacccaaaaaaaaaaaggtcatcagctgctacatggagagagcttcagagaggggcagcagattatccagttaggagatgattggaatagaggacaaaggtgattgatggtggctagcttgttcctataaactttcttttgatattctaccttttctttttttcactctgggggctctaacaagcctacctactctcttatacatttcttcatttttgtactgcacttgttcatatctagttttcttttccttttttttttaaccaagtgaattccttctcctatattttctcccgtttttcctgaagtaacttttttctgccttcctttctaatatacatatactactactttagtttgttttccttttcatttcagcctgtcttcctttatggaccttgtctactaggttgaaaagagtgatgctaaactgttgcatgcaatgttgttctctacagataccagcaaaaatgcttctgtctccaaatgaaaagtgttttccatttcgccttagccagtcttttatgttatatataaactcattgcagaacc

SEQ ID NO: 142675 - DNA, 601 bp, Human
agttaaagtgataaattctgtttatcatgtgagttcatgtacttgaaacagtaaagtagaacctcacttggaatgaaagtgattttcaggcaaagtttagtgggtcatacctgttatcctgagataacacttcgggaggccaaggcaggaggattgcttgagcccaggagttcaagaccagcctgggcaacataacgaggccccatctctgcaaaaaatacaaaaattaaccggatgtcacagcatgcacccaaagtcccaggaattcaggaggctgaggtgggaggattgcttgttgctsgagcccaggaggttgaggctgcaattcatgacactgcacttcagcctgggtgacagagctgagaagaaagaaagaaaaaagagagggagggagaaagaaagaagaggaaaaagaggaaaggaggaaggaaagaaagaaggaaagagaggaaggaaagaaaggaggaaagaaaggaaggagaaaagaaagtgattttcgctagaaatgcattgagaatatgaactcaaaagtcagaatgctgaggttcaacatctggctttactacttgttagctatgtgatcttggatagattacttaac

SEQ ID NO: 142676 - DNA, 601 bp, Human
tggccttagtttaacttctagttgattgggaatggattcaggaatttctgaaactaggcaagcataagtatggacaaaagaggaagaatgttagaaacttttccttccttttgttttttctttcatttagtgatgcctgggtcttgctctcattttcattacttaagctcttagaaatggtcatactattcacgatactaaaagtaaaacagtatcttgatataaaatgccagttaatccactaagtcacagactgttaatgctcacagttacagcacacttaagttgtatacctaagtcwtattacttagaatgatgcaacaatggataatccattattgtgaactgcaaatgatggttgccatcatcaggtaataaaacaatggctacagttacagaaagtgatagataatctgtgccatatccatttgacactaaaaacagggttgtttttggaccctaattttttttgtctaccttagggttttgtacttcccagaatcttctgcatccattggcaaaaattattaactattatcttcagagtatatggggctttcagtgctaaaattgggatagtcccaggcacactgggatgttt

SEQ ID NO: 142677 - DNA, 601 bp, Human
ttgctatatcaaatacattttatagtttttgaagatgcgttttttccccctcccaaattcactgcattacagtttttgaaacagaacgggagaaaaaaaataacaaacagtgctggcatccaatagatggtaaattcacttttcatttttaataaagagtggacgacgaggaactagaaattctcctaggcttggagaatttaaactgtttagtaaccttgttgtttcatatattcaaaaatctacaactttctaccttcataacctcctacttatgaatcaagaactaaattctggagayaagatgaaggtactacttaactaccatgacccctgctgactctgcttctgtggaaaccaataacttctctttcttcataaccccagtggtcactatttgaatgaagtgggattccaaacattttggcattcagtcttctgttttcagcccaggttggttttcattttttaaccacaggagatataaaagaatgatttagtaaatcataatagcagttaagtctgaagctgttcatcagcttctccttcacaagtttgggtatcagctcctcagtctcttttgctttcaccatttacaggc

SEQ ID NO: 142678 - DNA, 601 bp, Human
agcttttcagactttgtctttcttgaccttgacatgttttaagaaaacagggtggttattttgtagtttaatcccaatttgcgtttatctgatgtttccttatgattcaagtcaggttatgcattttttaaaaatataaggaatgccataaaaatgatttttttgttcttttcagtgtgtcatattgaggggaccatgatgtcaatttgtcttgttgttggggaaattaactttgatcacttagttaaggtggtgttcaccagatttttccacagaaagttactatctttttttttttttktttttgtttgagacagagtctggctctgtcacccaggctggagtgctgtggcgcattctcagctcactgcaacctctgcctcccaggtttaagccattcttctgcctcagcctcccgagtagctgggattacaggtgtgcaccaccacgccaggcaaatttttttgtatttttagtagagatggggaattaccatattggccagactggtctcaaactcctgaccttgtgatccacctgccttggcctcccaaagtgctaggattacaggcgtgagccactgcacccagccactatcttt

SEQ ID NO: 142679 - DNA, 601 bp, Human
tgcgtttatctgatgtttccttatgattcaagtcaggttatgcattttttaaaaatataaggaatgccataaaaatgatttttttgttcttttcagtgtgtcatattgaggggaccatgatgtcaatttgtcttgttgttggggaaattaactttgatcacttagttaaggtggtgttcaccagatttttccacagaaagttactatctttttttttttttttttttgtttgagacagagtctggctctgtcacccaggctggagtgctgtggcgcattctcagctcactgcaacctctgyctcccaggtttaagccattcttctgcctcagcctcccgagtagctgggattacaggtgtgcaccaccacgccaggcaaatttttttgtatttttagtagagatggggaattaccatattggccagactggtctcaaactcctgaccttgtgatccacctgccttggcctcccaaagtgctaggattacaggcgtgagccactgcacccagccactatctttctctttgaaattaataaatattgtgtggagagatactttgaaacctgtaaataacttgtttctcgtcagatttcaccca

SEQ ID NO: 142680 - DNA, 601 bp, Human
ttacaagcatgcaccaccacacccagctcatttttgtatttttagtagaaacagggtttcaccatgttggccaagctggtcttgaatgcctgacctcaagtgattcacccaccttggcctcccaaagtgctgggattatctcgcctatcctgctaagaggtttgttttggtttgtttgagtcttgctgtgtcgcgcaggctgaagtgcagtggcatgatctcagctcactcaacctctgccttgtgggttcaagcgattctcctgtgtcagcctcccgagtagctgggattacaggtgcgygccaccatgcctggctaatttttgtatttttagtagagacggggtttcgcagcattggccaggctagtctcaaactcctgacctcaagtgatccacccacctcgccctcccaaagtgctgggattacaggcatgagccactgtgccctgcctgctaagagtttttgtttgttgtgagtggatactgtaaattacatttatgattttcaaatgtttacttttgctttttagaataaaccctgcttaattgtaatgtgttatttatatatcactgagtttgatttgctaagattttgtttag

SEQ ID NO: 142681 - DNA, 601 bp, Human
tgctaagattttgtttaggttttatatctgtctttttgtgagattgctcagtaattttccttccttgaatgtcactgtcaagtttaggatcaagtattctgacttcataaaatgagctgcaaagtgttccttttttattttctgcaaaagttcagataagattgatgctattttttaaaagtttgaaagaaattagtggcgaagccttctgagcctgagttttgattttttgggaagatttgtcataatgaattcaatttattttattgatatagcagtattaaaaatcttcttttgcttattgtgttcatttggtaacttgtgccctcatagacatttaggtttttgctttctttggtcaaccatactagttcctattcatccaccgaatgtttatcttttttcacttttgttaatctctcttctactattatctcctctctggttctttttgttcttatgggttgctacttttcttcctctttccattattgtcattttagtggaggatatggagaaaactttaggtgtttaatttgtgatatttaactgggatctctccttaacctttttctttccatctccttaattttctaactag

SEQ ID NO: 142682 - DNA, 601 bp, Human
cagtaattttccttccttgaatgtcactgtcaagtttaggatcaagtattctgacttcataaaatgagctgcaaagtgttccttttttattttctgcaaaagttcagataagattgatgctattttttaaaagtttgaaagaaattagtggcgaagccttctgagcctgagttttgattttttgggaagatttgtcataatgaattcaatttattttattgatatagcagtattaaaaatcttcttttgcttcttgtgttcatttggtaacttgtgccctcatagacatttaggtttttgstttctttggtcaaccatactagttcctattcatccaccgaatgtttatcttttttcacttttgttaatctctcttctactattatctcctctctggttctttttgttcttatgggttgctacttttcttcctctttccattattgtcattttagtggaggatatggagaaaactttaggtgtttaatttgtgatatttaactgggatctctccttaacctttttctttccatctccttaattttctaactagaatacagtggacataattttctactctcataattacaaaggtcaacca

SEQ ID NO: 142683 - DNA, 601 bp, Human
ttttctgcaaaagttcagataagattgatgctattttttaaaagtttgaaagaaattagtggcgaagccttctgagcctgagttttgattttttgggaagatttgtcataatgaattcaatttattttattgatatagcagtattaaaaatcttcttttgcttcttgtgttcatttggtaacttgtgccctcatagacatttaggtttttgctttctttggtcaaccatactagttcctattcatccaccgaatgtttatcttttttcacttttgttaatctctcttctactattatctcytctctggttctttttgttcttatgggttgctacttttcttcctctttccattattgtcattttagtggaggatatggagaaaactttaggtgtttaatttgtgatatttaactgggatctctccttaacctttttctttccatctccttaattttctaactagaatacagtggacataattttctactctcataattacaaaggtcaaccataacaagttattgaaatgtagtgatactctcaaggacttttgaagattttaagtttttgtccccactccaggttgcccccaaactttta

SEQ ID NO: 142684 - DNA, 601 bp, Human
atctttccttgtttttcataaccttgacagttgtacaaaatactgtatacaggtattttatacagtgtccctcaggttgggtttgtctgatgttttcttatgattaaactgggattatgagttttagggaaaggatcacagtgctgaagtgctattttcatcataccatattaaagggtacatgccatgaataagacatatcactatgaatgttaactatgatcacttggctgaggtagtgtttgtcaggtttctccattgtcagtttgtttttcctcccttttatgtctgtgtttttgaygtaagttaccaagttgagcccatactcaagggaaggaaaattcatttttatctttggagaagggagtatatgcttatattatttggaattcttctgtaaggaacatgtgtcccttctttccatttatttatttattcatctgtttttatcagtatggattcgggaatgtttattttatttaggagttataacccaatgccgatgttatttatttttgctaaaattgttccaactttggccgttgggaattctttcaagttggcttctgtaaccttttgacatgcccctgtctttaaaaaa

SEQ ID NO: 142685 - DNA, 601 bp, Human
ttgtcaggtttctccattgtcagtttgtttttcctcccttttatgtctgtgtttttgacgtaagttaccaagttgagcccatactcaagggaaggaaaattcatttttatctttggagaagggagtatatgcttatattatttggaattcttctgtaaggaacatgtgtcccttctttccatttatttatttattcatctgtttttatcagtatggattcgggaatgtttattttatttaggagttataacccaatgccgatgttatttatttttgctaaaattgttccaactttggccgytgggaattctttcaagttggcttctgtaaccttttgacatgcccctgtctttaaaaaaaaataatgattttcttgcattctgaccctgtaagttacaccaggttcatattggtgttttttctgcctctggcctagaatcagtcatttcttctaggaaccctggctccttttattagagagaatggtatttagaaaccaagatctagttgtaggtgtgtttgttgctactggggtgtcactgcttctagaccctctaagaaagcagctctagctctctatactaacccgtgttacaacata

SEQ ID NO: 142686 - DNA, 601 bp, Human
tttttttttttcaggcttgcattgaagttttatattttttagagaggatttatgtttgcttgtgttagtcactttcaggcttttttttttttccttttaaaagcagttttttattgtggtataatatacataacatataagttactgtttaaccatttttaagtgtatatttatgcagttcattggtattaagtacatttataatgttgtgcagccaccaccaatatttatttttggatcttttaaatcatcataaacaagaactgtgtacctgttaaacagtaattctccatttctctayttcctttagcctctggtaaccttgattctactttctgtctctatgaatttacctattctgggtacttcatatatgtggaatcatacaatatttgtccttttgcatctggcttatttcacttagtaactgttttcaaggttcatctgtcttgtatcctgtatccaattcgtatccctttaaggctgaataacattccgttgtgtctatgtgtgtgtgtgtgtgtgtgtgtgtgtacatatgtacacacatactgtattttgtttattaatctgttgatagaaatttgggttgtttccacca

SEQ ID NO: 142687 - DNA, 601 bp, Human
catagactgagtggcctttaaacctcacatttctcagaattctggaagctgggaagttagatcaagaggtccagattcagtatctggtaaggtcccactttttcacaaatggtgccttctggctgtctcctcacagaatggaaggggcaaacaggctccattgggcctctttgataagggcaccaatcccattcgtgagagctgtgccctcgtgatctaatcagctcacacaggccccacctcttaataccatctgtatcttggggttaggatttcatcatataaatttgagaacattcakaccatagcactgaccatggggtggatgtactttatttgtctttagttcaactcagaaagccagagccaagcttaagacatcagaattatccccactgcctcttcagtgagttttttgttctgttttgtttttccctagttcaccaagtcagagcgttgcccttcagcttgtctggttttcagtctgacatctcattttgctggggccttgaggttaacctaataaagcctgggttctaggacatcaggtttttggtcatagggtaccaagagagaaatgccatctttggaatttcattta

SEQ ID NO: 142688 - DNA, 601 bp, Human
ctggtaaggtcccactttttcacaaatggtgccttctggctgtctcctcacagaatggaaggggcaaacaggctccattgggcctctttgataagggcaccaatcccattcgtgagagctgtgccctcgtgatctaatcagctcacacaggccccacctcttaataccatctgtatcttggggttaggatttcatcatataaatttgagaacattcagaccatagcactgaccatggggtggatgtactttatttgtctttagttcaactcagaaagccagagccaagcttaagacatcasaattatccccactgcctcttcagtgagttttttgttctgttttgtttttccctagttcaccaagtcagagcgttgcccttcagcttgtctggttttcagtctgacatctcattttgctggggccttgaggttaacctaataaagcctgggttctaggacatcaggtttttggtcatagggtaccaagagagaaatgccatctttggaatttcatttagctctctgggttcccactttctaattgttaatggcttcaaggggtttcagccatgcacttataaaattttttaaaattcataa

SEQ ID NO: 142689 - DNA, 601 bp, Human; identical to SEQ ID NO: 37901

SEQ ID NO: 142690 - DNA, 601 bp, Human; identical to SEQ ID NO: 37902

SEQ ID NO: 142691 - DNA, 601 bp, Human; identical to SEQ ID NO: 37903

SEQ ID NO: 142692 - DNA, 601 bp, Human; identical to SEQ ID NO: 37904

SEQ ID NO: 142693 - DNA, 601 bp, Human; identical to SEQ ID NO: 37905

SEQ ID NO: 142694 - DNA, 601 bp, Human; identical to SEQ ID NO: 37906

SEQ ID NO: 142695 - DNA, 601 bp, Human; identical to SEQ ID NO: 37907

SEQ ID NO: 142696 - DNA, 601 bp, Human; identical to SEQ ID NO: 37908

SEQ ID NO: 142697 - DNA, 601 bp, Human; identical to SEQ ID NO: 37909

SEQ ID NO: 142698 - DNA, 601 bp, Human; identical to SEQ ID NO: 37910

SEQ ID NO: 142699 - DNA, 601 bp, Human; identical to SEQ ID NO: 37911

SEQ ID NO: 142700 - DNA, 601 bp, Human; identical to SEQ ID NO: 37912

SEQ ID NO: 142701 - DNA, 601 bp, Human; identical to SEQ ID NO: 37913

SEQ ID NO: 142702 - DNA, 601 bp, Human; identical to SEQ ID NO: 37914

SEQ ID NO: 142703 - DNA, 601 bp, Human; identical to SEQ ID NO: 37915

SEQ ID NO: 142704 - DNA, 601 bp, Human; identical to SEQ ID NO: 37916

SEQ ID NO: 142705 - DNA, 601 bp, Human; identical to SEQ ID NO: 37917

SEQ ID NO: 142706 - DNA, 601 bp, Human; identical to SEQ ID NO: 37918

SEQ ID NO: 142707 - DNA, 601 bp, Human; identical to SEQ ID NO: 37919

SEQ ID NO: 142708 - DNA, 601 bp, Human; identical to SEQ ID NO: 37920

SEQ ID NO: 142709 - DNA, 601 bp, Human; identical to SEQ ID NO: 37921

SEQ ID NO: 142710 - DNA, 601 bp, Human
tcattatctggaataatgattcttaatgtgtgtccatcttgtttttctgaggcctttgtttgtttaaatagctctgatggctcttacttccaaaatagaataatttttaaaagctaggtttttctgatagcttagaatgtgcttttaaaaaacacccacatttttttttctactttgggtgaaaatcttttgtgcatgtattgaacatttctctatttcataaagagaatattccaaacatttcatcctttcttaataatgaacagtctttatagatgtgaattattatactttacatacyaagcatagttaagcttactaagtttattaagtttagtaatagtgactactctcttcagcatttattctgttataccttaaatgtttattgagctcttactctgctatatgcttagtccagtgctttgcattcattatttacttttatcctagctttctgttgaagatccctataagctaaaaaacttcctcaaggacatagggctagtaaatgacagagctggtattggaacccatgtctgtttgatgccaaatcccactcttaaacactgtacattactatattcttgctctgtcacaa

SEQ ID NO: 142711 - DNA, 601 bp, Human
attgtagttgaatctgttgttaaagttgggtttccttagtattgtatttagtaaagcttttccaaccctgggattttaaaaatattcacctttattttccaaaagtccttgtagatttatttttatttatttacatgtttttacatgtacatcatttttatttaacagcattattttattaattaaccttgttttccctcaatgcgtttgggtgaatgtcaggaatgcctactgaagtatttaataaattgctctaggaatcaatttcaacattttttctcatgtttttggaatgttgtgtttttttttttttaactagtttattttgcaaatatatttgtaagttttccactgatatcttaaagttaggtatgattattaattcaagctggccttgtgcccctataaaatgacagtgtctgttcttgggaaactccacggctagatagactacaaacttgtaaacatactgttgtagagtcagaaagtagtatgtaaaagccaatttaaaatgtggtatcataaaggagtggtcactgcccttttctggagttttaattaaatcttcacacacaaagatgaggccaagcatggtggctca

SEQ ID NO: 142712 - DNA, 601 bp, Human
ttaattcaagctggccttgtgcccctataaaatgacagtgtctgttcttgggaaactccacggctagatagactacaaacttgtaaacatactgttgtagagtcagaaagtagtatgtaaaagccaatttaaaatgtggtatcataaaggagtggtcactgcccttttctggagttttaattaaatcttcacacacaaagatgaggccaagcatggtggctcacacctgtaatcccagcactttgggaggccagggtgggaggatcacttgagcccaggcattcaagaccagactggccarcatagtgagaccctgtctctataaaataaaaaaaaattagccaggtgtggttatgagcacctgtagtcccagctactcaagaggcagaggtgaggggatcatttgagcccgtcaggtgaaggctgcagtgagcacaggttgaggcactgtgatcacgcctctgcactccagcctgggctacagagtgagaccctatctcaaaaacaaagcaaaacataagtaaagctgagttttgaatcactggaatttgacataccaagtcgaggaggaaaagctttgcacctaatgaggatggaatgc

SEQ ID NO: 142713 - DNA, 601 bp, Human
cttgtgcccctataaaatgacagtgtctgttcttgggaaactccacggctagatagactacaaacttgtaaacatactgttgtagagtcagaaagtagtatgtaaaagccaatttaaaatgtggtatcataaaggagtggtcactgcccttttctggagttttaattaaatcttcacacacaaagatgaggccaagcatggtggctcacacctgtaatcccagcactttgggaggccagggtgggaggatcacttgagcccaggcattcaagaccagactggccagcatagtgagaccctrtctctataaaataaaaaaaaattagccaggtgtggttatgagcacctgtagtcccagctactcaagaggcagaggtgaggggatcatttgagcccgtcaggtgaaggctgcagtgagcacaggttgaggcactgtgatcacgcctctgcactccagcctgggctacagagtgagaccctatctcaaaaacaaagcaaaacataagtaaagctgagttttgaatcactggaatttgacataccaagtcgaggaggaaaagctttgcacctaatgaggatggaatgcaaaggcacaacaggt

SEQ ID NO: 142714 - DNA, 601 bp, Human
tagtatgtaaaagccaatttaaaatgtggtatcataaaggagtggtcactgcccttttctggagttttaattaaatcttcacacacaaagatgaggccaagcatggtggctcacacctgtaatcccagcactttgggaggccagggtgggaggatcacttgagcccaggcattcaagaccagactggccagcatagtgagaccctgtctctataaaataaaaaaaaattagccaggtgtggttatgagcacctgtagtcccagctactcaagaggcagaggtgaggggatcatttgagccygtcaggtgaaggctgcagtgagcacaggttgaggcactgtgatcacgcctctgcactccagcctgggctacagagtgagaccctatctcaaaaacaaagcaaaacataagtaaagctgagttttgaatcactggaatttgacataccaagtcgaggaggaaaagctttgcacctaatgaggatggaatgcaaaggcacaacaggtgaaagagtctcatcttatttgaacaaataatgtatttgattggagaatgggtagaggatagccagagttgaagccatagaagtaggtagaggtag

SEQ ID NO: 142715 - DNA, 601 bp, Human; identical to SEQ ID NO: 37922

SEQ ID NO: 142716 - DNA, 601 bp, Human; identical to SEQ ID NO: 37923

SEQ ID NO: 142717 - DNA, 601 bp, Human; identical to SEQ ID NO: 37924

SEQ ID NO: 142718 - DNA, 601 bp, Human; identical to SEQ ID NO: 37925

SEQ ID NO: 142719 - DNA, 601 bp, Human; identical to SEQ ID NO: 37926

SEQ ID NO: 142720 - DNA, 601 bp, Human; identical to SEQ ID NO: 37927

SEQ ID NO: 142721 - DNA, 601 bp, Human; identical to SEQ ID NO: 37928

SEQ ID NO: 142722 - DNA, 601 bp, Human; identical to SEQ ID NO: 37929

SEQ ID NO: 142723 - DNA, 601 bp, Human; identical to SEQ ID NO: 37930

SEQ ID NO: 142724 - DNA, 601 bp, Human; identical to SEQ ID NO: 37931

SEQ ID NO: 142725 - DNA, 601 bp, Human; identical to SEQ ID NO: 37932

SEQ ID NO: 142726 - DNA, 601 bp, Human; identical to SEQ ID NO: 37933

SEQ ID NO: 142727 - DNA, 601 bp, Human; identical to SEQ ID NO: 37934

SEQ ID NO: 142728 - DNA, 601 bp, Human; identical to SEQ ID NO: 37935

SEQ ID NO: 142729 - DNA, 601 bp, Human; identical to SEQ ID NO: 37936

SEQ ID NO: 142730 - DNA, 601 bp, Human; identical to SEQ ID NO: 37937

SEQ ID NO: 142731 - DNA, 601 bp, Human; identical to SEQ ID NO: 37938

SEQ ID NO: 142732 - DNA, 601 bp, Human; identical to SEQ ID NO: 37939

SEQ ID NO: 142733 - DNA, 601 bp, Human; identical to SEQ ID NO: 37940

SEQ ID NO: 142734 - DNA, 601 bp, Human; identical to SEQ ID NO: 37941

SEQ ID NO: 142735 - DNA, 601 bp, Human; identical to SEQ ID NO: 37942

SEQ ID NO: 142736 - DNA, 601 bp, Human; identical to SEQ ID NO: 37943

SEQ ID NO: 142737 - DNA, 601 bp, Human; identical to SEQ ID NO: 37944

SEQ ID NO: 142738 - DNA, 601 bp, Human; identical to SEQ ID NO: 37945

SEQ ID NO: 142739 - DNA, 601 bp, Human; identical to SEQ ID NO: 37946

SEQ ID NO: 142740 - DNA, 601 bp, Human; identical to SEQ ID NO: 37947

SEQ ID NO: 142741 - DNA, 601 bp, Human; identical to SEQ ID NO: 37948

SEQ ID NO: 142742 - DNA, 601 bp, Human
gtcatatcttatgtctttgttttccagagtcaggctttttgagttttaaattccatctctgccacttactgtgtgacatttggggagttattttttctgtttctgtctttgcacattttaaaaatgagaattctatctaaaaagttgtgaaaattgggccagggagatatctggcttatgtctataatcctgacactttgggaggtcaaggtgggaggatcgcttgagcccaagagttcacgaccagcctgggaaacaaagtgagaccttgtctccacaaaaaatttaaaaattagccagkcatatacctatagtcccagccacttgggaggctcagacaggaagattacctgagcccatgagttcgaagttgcactgagccatgatggcgccactgcactccagcctggtcaacaaagcaaaactctacccccacacccacccccgaaaacaggagttgtgagaattaaatgagatcgtacatatcaagtagtaggaaaaatgcctagtacagtgttagaagtttatggtcttgtaggaagcacaaatacagaattaaagcaatgatagaagcattaacatggtacagtcctagcagatg

SEQ ID NO: 142743 - DNA, 601 bp, Human
agtatacggacagatcctggagattacattttaagagatagaccgggaataaaaaggctcccatgaataatttccaaagctgttgaagaagtaagaagagaaattgaagggaagtgagagctttaaaggagattatactcagtgttaacaatatagcagagatcaaggcagataagggctaactaagtataattttgagttcacaatgaccccaaggtaattaagttaactatacagcctggacttgcacccctgaactccattagagatggtatcagtggaagcctattggaggagtccyacccccatccatcagtaacagggagctctctggtatcagtggaggtctagtagagaacatgtacttttagtcccacctcacaataatgaggtaacaccctactacccactggagtgtggtgctagaggaagtctgctaaaacacaagaattatattgctctacatagttgccagcaaaaacaaaaaccatagtactcaaaatgtccagatttcaaaatgaaaatcatttgccttacccagaatcaggaagatctcaaactgaatgagaaaagaatatcaatagacattaacaccaagaag

SEQ ID NO: 142744 - DNA, 601 bp, Human
catttgtaatccacaatgttggaagaggggccttgtgggaggtgattggattctgggggcagatttccccctttccatccttgttacattgagtaagttctcacaagttctggttgtttataaaagtgtgtagcacctccccctttgctctctgttactcctgctctggccatgtaagatgtatgtccttcctcttcaccttccctcatgattccaagtttcctgaggcctccacagctacgcttcctgtatagcctgtggatctgtgagtcaattaaacctcttttctttataaattacycagtctcaggtatttctttttttttttttggagatggagtcttgctctctcacccagtctacagtgcagtggcgcgatcttggcccacggcagcctttgccttctacattcaagcagtccttccacctcagcctcccaggtagcttggattacaggtactcaccaccacacccagctaattttcaggtagttctttagagcagtgagagaacggactgatacagcatccatcataaaaatgttttaatgaacatgatgacaactcttgaaacaaatgaaaactcaaaacaatataaagaa

SEQ ID NO: 142745 - DNA, 601 bp, Human
acagtcaggtccctcagctgtaggtcttttggagtttgctggagttccactccagaccagcagaggctgcagaacagcaaatattgctgcctgatccttcctctggaagcttcgtcccagaggggcagctgcctatgtgaggtgtctgtcggcccctactgggaggtgtctcccagttaggctacacaggggtcagggacccacttcaggaggcattctgtccgttctcagagctcagatgccgtgctgggagaaccactgctctcttcagagctatcagacagggatgtttaagtctgcagttgtctgctgcctatttttcagctatgccctgcccacagtggtggagtctagaggcagtaggccttgttgagctgcagtgggctccacccagtttgagcttcctggccgctttgtttacctactcaagcctcagcaatggcggatgcccctcccccagtcaggctcctgtctcacagatggatctcagaccgctgtgctagcagtgagcaaggctccatgggcgtgggagccgccgagccaggcacgggagagaatcaccttgtctgctggttgctaagaccttgggaaaagcacagta

SEQ ID NO: 142746 - DNA, 601 bp, Human
ccgccgagccaggcacgggagagaatcaccttgtctgctggttgctaagaccttgggaaaagcacagtatttgggcgggagtgtcccatttttccaggtagtctgtgaaggcttcccttggctaggaaagggaaatcccccaacctgttgcacttcctgggtgaggtgatgccccgccctgcttcagctcaccctccatgggctgcatcccctgtccaaccagtcccaatgagatgaactagttacctcagttggaaacgcagaaatcacccatcttctgcatcggtcatgctgagagctrcagaccggagctattcctatttggccatcttggaaccgccaccccacccccccgtccaggattatattctatttagtttaaactgtgcccccatttcaaggacaccatttttccttttggtgtgtttcaaagttcttcatagctgaccagacacagtggctcatacctgtaatcccagggctttgggaggccaaggtgggaggatcacttgaagccaagagttggagacccagcctgtgcaatataatgaagccctgtgtctacaaaaaagaaaattttaattagctgggcaagccaggc

SEQ ID NO: 142747 - DNA, 601 bp, Human
aaatttgaaatagaactacaatatgatccagcaatcccacttctgggtatacagtctcgtgccacataacgtttcagtcaattatggaccatatgtgatagtgagcccataagattataataacgtatttttactgtaccttttctctgggcacacaaatagtttccattgtgtcacagttgcctatggtattcagtacggtaacatactatacaggtgtatagtgtagaagcagtaggttataccatatagcctaggtgtataggacactatgccacctcggattgtataagtacactckatgatgcacaacttcaaattacctcatgatgcctttctcagaacataaccccattcttaagcactgcatgactggatgtccaaaagaactgaaagcagcgtctttttgttttgagttagggtctcattctgtcacccatgatggagtgcagcatcacagtcacagctcacgatagcctcctgggctcaagtgatcgtcctgcctcagcttcctaagtagctgggactacaggtgcacaccgtcacaccctgctaattttttcacttttatacagatggtgtctcactttgttggccaggc

SEQ ID NO: 142748 - DNA, 601 bp, Human
gttacttgctttaacatagatgaaccttgaggtcattgtgccaagcacagtaagtcagtcacaaaagtatgatttctgttatatgaggtatctaaagtagtcaaattcatagaaacagaaaatagaattgatgtttactgggatttgaggggaaggggaaaaggagttgtttaatagacatatgttcagttttgcaaaacaaagttactggagatctgtttttaacactgtgcatatactttacactgctgaactctacactcagaatggttaacatgataaattttatatgtttgttttkgtttttttgttttttgtttttttttttgagatgagagtctcgctctgtcacccaggctctggagtgcagtggtgcaatctcggctcactgcaagctccgcctcacgggttcatgccattctcctgcctcagcctcctgagtagctgggactacaggcgctcaccaccacacctggctaattgttttgtatttttattagagatgggatttcaccttgttggccacgctggtcttgaacttctgtcctcaagtgatcccccctgccccccatcagcttcccaaagtgctgggattacaggc

SEQ ID NO: 142749 - DNA, 601 bp, Human
agatgaaccttgaggtcattgtgccaagcacagtaagtcagtcacaaaagtatgatttctgttatatgaggtatctaaagtagtcaaattcatagaaacagaaaatagaattgatgtttactgggatttgaggggaaggggaaaaggagttgtttaatagacatatgttcagttttgcaaaacaaagttactggagatctgtttttaacactgtgcatatactttacactgctgaactctacactcagaatggttaacatgataaattttatatgtttgttttggtttttttgttttttggttttttttttgagatgagagtctcgctctgtcacccaggctctggagtgcagtggtgcaatctcggctcactgcaagctccgcctcacgggttcatgccattctcctgcctcagcctcctgagtagctgggactacaggcgctcaccaccacacctggctaattgttttgtatttttattagagatgggatttcaccttgttggccacgctggtcttgaacttctgtcctcaagtgatcccccctgccccccatcagcttcccaaagtgctgggattacaggcatgagccactgtgctca

SEQ ID NO: 142750 - DNA, 601 bp, Human
gagcagtgacgcaatcacgactcactgaagcccagacctccctggctcaagtgatcctcctgcctcagcctctcaagtagctgggactacatgtgcgagctaccacactctgctaatttttaaaattttcttggagatatagggtcttcctgtgttgcccaggctattctcaagggatcctcccaccactgtgcccagcccaaaatcactgtttaacttcatcttatagttaaaggagttctgatgatgttagattttccattttatggaatagcaactaaacagcttcaccagcattcartatttaaatgatgtatgcacttagagaaattggtgcacccaaatggaagaaattcccataaggcttttttttgttattgtgttttgttttttgttttttgtttttgttttttgttttttttttgagacggagcctcgctctgttgcccagtttggagtgcagtggcgcgatctcagctcactgcaagctccgcctccctgaggcattctcctgcctcagcctcccgagtagctgggaccacaggcgcctgccaccaggcctggctaattttttgtatttttagtagagacggggtttcac

SEQ ID NO: 142751 - DNA, 601 bp, Human
gagatatagggtcttcctgtgttgcccaggctattctcaagggatcctcccaccactgtgcccagcccaaaatcactgtttaacttcatcttatagttaaaggagttctgatgatgttagattttccattttatggaatagcaactaaacagcttcaccagcattcaatatttaaatgatgtatgcacttagagaaattggtgcacccaaatggaagaaattcccataaggcttttttttgttattgtgttttgttttttgttttttgtttttgttttttgttttttttttgagacggagyctcgctctgttgcccagtttggagtgcagtggcgcgatctcagctcactgcaagctccgcctccctgaggcattctcctgcctcagcctcccgagtagctgggaccacaggcgcctgccaccaggcctggctaattttttgtatttttagtagagacggggtttcaccgtgttagccaggatggtctcgatctcctgacctcgtgatccgcccgcctcggcctcccattgttttttggttttttttgagatggagtttcactctcgttgtccaggctggagtgcaatggcacaatctcgg

SEQ ID NO: 142752 - DNA, 601 bp, Human
ccccatgtttacccccaccaaaaaaaaacaaagttagccaggtatggtggcgtatgcctgtagttccagctactctggaggaagaggtaagaggatggcttcagcccaggaggcggaggctgcagtgagccactatgtccagctcagttgtcttatatcacaaatacatttcctttttttaaggtgaatatccctttattcagttaagttttataaaacagccattgtaggccaggcacagtggctcacgcctataatcccagcattttgggaggccagggtgggaggatcatttgaggartggagttcgagaccaacctggccaacatggtgaaacctggcctctactaaaaaaaaaatacagaaattagctgggtgtggtggagggtgcctgcagtcctagctactcaggaggctgaggcaggagaatcacttgaacctggaggtggagattgcagtgagccaagattgcaccactgcactgcagcctgggagacagagtgatactcagtctgaaatttaaaaaaaaaaaaaaaaaaaacaccaaagtagccattatagtttgggccagcaaaagtctcatggttcactcattacagta

SEQ ID NO: 142753 - DNA, 601 bp, Human
ccattgtaggccaggcacagtggctcacgcctataatcccagcattttgggaggccagggtgggaggatcatttgaggaatggagttcgagaccaacctggccaacatggtgaaacctggcctctactaaaaaaaaaatacagaaattagctgggtgtggtggagggtgcctgcagtcctagctactcaggaggctgaggcaggagaatcacttgaacctggaggtggagattgcagtgagccaagattgcaccactgcactgcagcctgggagacagagtgatactcagtctgaaatttaaaaaaaaaaaaaaaaaaaacaccaaagtagccattatagtttgggccagcaaaagtctcatggttcactcattacagtatagtccctggactgatagctatttatctacatagtgtgttttgaagatactattgtagaattcagcaattaatataaactgtgtcttgatctgactcactgtcttgtattatcttctgtaggggcacactgagttgcctgaaagcaagaaatcttaaattatgtcattttcattgaaacttgagctttggaattattgcatattagtgataaaagtaacag

SEQ ID NO: 142754 - DNA, 601 bp, Human
aaacttgagctttggaattattgcatattagtgataaaagtaacagatctcaagaatgtgccctctagggggccagatgttttaagcatttgctctttctgtgtaagatttcacaagactttcagactgtcctcattttgataatattaatatggccataagcttgaacttgcataagtcctatgagaaagtttggatcataaataaatttaatatatcataatttccctttgtgatataaacgactattgttacttgttttgctatagatgtataaaaaaataactaaggcaataaaaamttagaaccaggccaggcacggtggctcacgcctgtaatcccagcaccttaggaggccgaggcaggtggatcacctgagatcgagagttcaagaccagcctgagcaacatggagaaaccccgtctctactaaaaatacaaaattagcctggcatggtggtccatgcctataatcccaactaatcaggaggctgaggcaagagaatcgcttgaacccgggaggtggaagttgtggtgagccgagatcatgccattgcactccagcctgcctgggcaacaagagtgaaactcttatctcaaaa

SEQ ID NO: 142755 - DNA, 601 bp, Human
taggaggccgaggcaggtggatcacctgagatcgagagttcaagaccagcctgagcaacatggagaaaccccgtctctactaaaaatacaaaattagcctggcatggtggtccatgcctataatcccaactaatcaggaggctgaggcaagagaatcgcttgaacccgggaggtggaagttgtggtgagccgagatcatgccattgcactccagcctgcctgggcaacaagagtgaaactcttatctcaaaaaaaattagaaccaatgtaagatcactttacagagtcattgttaccaccycaccactgtacaagttctttctctttattttctattttcataaaaaatactatgctgctggatcttcgtggtttattaactgaactgtttaaaatgaaataaacaatacataatgataacagctttacttagatataatacatataacatacaattcacccatttgaagtatacaattcagtgtgtttcattgccccataaagaagcctagtacccattagcaatcactgttttcttccaatccctcctccaggcctatgcaactgtcagtcttttctctatctctggctttttgtattc

SEQ ID NO: 142756 - DNA, 601 bp, Human
caaggattttctatgatcatgtattatcacttcatttctatttcagatatttcattgtataaatgtaacactttatttttccatttgtcagttggttagcatttttcttatgcttttgggctattatgaataatgtggggacatatgctctactctagatttagagtgtgcccttggttttttttaatttatttttattttcttgagaccaagtcttggtctgtcatgcccaggctggagtgtagtggtgtgattttggctcactgcaacctctgcctcataggttcaagtgattctcccrcctcagcctcccaagtagctgggattacaggcactcgccaccacgcccggctaaatttttgtatttttagtagagacagggtttcatcatattggccaggctggtctcgagctcccaacctcaggtgatctgcccacctcagcctcccaaagtgctgacattacaggcatgagccaccgtgtgcagcctaacaaggtttttggttttttgtgtgtgtgacagagtctcactctgtttctcaggctggagtgcagtggctcaatttcagctaactgcatagaatgtgtccttgttttaaaa

SEQ ID NO: 142757 - DNA, 601 bp, Human
gatatttcattgtataaatgtaacactttatttttccatttgtcagttggttagcatttttcttatgcttttgggctattatgaataatgtggggacatatgctctactctagatttagagtgtgcccttggttttttttaatttatttttattttcttgagaccaagtcttggtctgtcatgcccaggctggagtgtagtggtgtgattttggctcactgcaacctctgcctcataggttcaagtgattctcccgcctcagcctcccaagtagctgggattacaggcactcgccaccacrcccggctaaatttttgtatttttagtagagacagggtttcatcatattggccaggctggtctcgagctcccaacctcaggtgatctgcccacctcagcctcccaaagtgctgacattacaggcatgagccaccgtgtgcagcctaacaaggtttttggttttttgtgtgtgtgacagagtctcactctgtttctcaggctggagtgcagtggctcaatttcagctaactgcatagaatgtgtccttgttttaaaacattagatctttatgttataattttattttcaaatagcaattttc

SEQ ID NO: 142758 - DNA, 601 bp, Human
tatgcttttgggctattatgaataatgtggggacatatgctctactctagatttagagtgtgcccttggttttttttaatttatttttattttcttgagaccaagtcttggtctgtcatgcccaggctggagtgtagtggtgtgattttggctcactgcaacctctgcctcataggttcaagtgattctcccgcctcagcctcccaagtagctgggattacaggcactcgccaccacgcccggctaaatttttgtatttttagtagagacagggtttcatcatattggccaggctggtctygagctcccaacctcaggtgatctgcccacctcagcctcccaaagtgctgacattacaggcatgagccaccgtgtgcagcctaacaaggtttttggttttttgtgtgtgtgacagagtctcactctgtttctcaggctggagtgcagtggctcaatttcagctaactgcatagaatgtgtccttgttttaaaacattagatctttatgttataattttattttcaaatagcaattttcattgcctgaagataatcggatagttatcaaactttgctaataacttccttggttctaaagaag

SEQ ID NO: 142759 - DNA, 601 bp, Human; identical to SEQ ID NO: 37949

SEQ ID NO: 142760 - DNA, 601 bp, Human; identical to SEQ ID NO: 37950

SEQ ID NO: 142761 - DNA, 601 bp, Human; identical to SEQ ID NO: 37951

SEQ ID NO: 142762 - DNA, 601 bp, Human; identical to SEQ ID NO: 37952

SEQ ID NO: 142763 - DNA, 601 bp, Human; identical to SEQ ID NO: 37953

SEQ ID NO: 142764 - DNA, 601 bp, Human; identical to SEQ ID NO: 37954

SEQ ID NO: 142765 - DNA, 601 bp, Human; identical to SEQ ID NO: 37955

SEQ ID NO: 142766 - DNA, 601 bp, Human; identical to SEQ ID NO: 37956

SEQ ID NO: 142767 - DNA, 601 bp, Human; identical to SEQ ID NO: 37957

SEQ ID NO: 142768 - DNA, 601 bp, Human; identical to SEQ ID NO: 37958

SEQ ID NO: 142769 - DNA, 601 bp, Human; identical to SEQ ID NO: 37959

SEQ ID NO: 142770 - DNA, 601 bp, Human; identical to SEQ ID NO: 37960

SEQ ID NO: 142771 - DNA, 601 bp, Human; identical to SEQ ID NO: 37961

SEQ ID NO: 142772 - DNA, 601 bp, Human; identical to SEQ ID NO: 37962

SEQ ID NO: 142773 - DNA, 601 bp, Human; identical to SEQ ID NO: 37963

SEQ ID NO: 142774 - DNA, 601 bp, Human; identical to SEQ ID NO: 37964

SEQ ID NO: 142775 - DNA, 601 bp, Human; identical to SEQ ID NO: 37965

SEQ ID NO: 142776 - DNA, 601 bp, Human; identical to SEQ ID NO: 37966

SEQ ID NO: 142777 - DNA, 601 bp, Human; identical to SEQ ID NO: 37967

SEQ ID NO: 142778 - DNA, 601 bp, Human; identical to SEQ ID NO: 37968

SEQ ID NO: 142779 - DNA, 601 bp, Human; identical to SEQ ID NO: 37969

SEQ ID NO: 142780 - DNA, 601 bp, Human; identical to SEQ ID NO: 37970

SEQ ID NO: 142781 - DNA, 601 bp, Human; identical to SEQ ID NO: 37971

SEQ ID NO: 142782 - DNA, 601 bp, Human; identical to SEQ ID NO: 37972

SEQ ID NO: 142783 - DNA, 601 bp, Human; identical to SEQ ID NO: 37973

SEQ ID NO: 142784 - DNA, 601 bp, Human; identical to SEQ ID NO: 37974

SEQ ID NO: 142785 - DNA, 601 bp, Human; identical to SEQ ID NO: 37975

SEQ ID NO: 142786 - DNA, 601 bp, Human; identical to SEQ ID NO: 37976

SEQ ID NO: 142787 - DNA, 601 bp, Human; identical to SEQ ID NO: 37977

SEQ ID NO: 142788 - DNA, 601 bp, Human; identical to SEQ ID NO: 37851

SEQ ID NO: 142789 - DNA, 601 bp, Human; identical to SEQ ID NO: 37852

SEQ ID NO: 142790 - DNA, 601 bp, Human; identical to SEQ ID NO: 37853

SEQ ID NO: 142791 - DNA, 601 bp, Human; identical to SEQ ID NO: 37854

SEQ ID NO: 142792 - DNA, 601 bp, Human; identical to SEQ ID NO: 37855

SEQ ID NO: 142793 - DNA, 601 bp, Human; identical to SEQ ID NO: 37856

SEQ ID NO: 142794 - DNA, 601 bp, Human; identical to SEQ ID NO: 37857

SEQ ID NO: 142795 - DNA, 601 bp, Human
agtggtacaaagagctgaatgccgaccagctgccagtgaaaactacatgcgattaaaaaggttggtgttttgtaactccagaatgatacctgatatttccctttggggattgagatacgtgtgttatatcgcctattgactgcattaaaactgtggttattgttgagtgtttgcttcaaaagctgtttggttttaaaagcaagtaagagtttctttggcactaaagaaatttcagtatctgggctgtttatttgaggtattttaagctactttgttaatacatcctggaatcaaagtttttaaactacattttctagttgtctttataaattttgattctttaaagacatgtataagatctttgtaatattttattttccagggctgtaatttttccataataaatatgtatccgaaatactgtaactgggccaggcatggtggcacatgcctgtaatcccagcactttgggaggctgaggtaggtggaccattcaagcccaggagtttgagaccaacctgggcaacatggtgatatcctatctctacaaaaagatagaaaaattagctgggcgtggctgaggtgtgaggattgcttgggc

SEQ ID NO: 142796 - DNA, 601 bp, Human
gcgccagcccaggctcaaaattttaaagaatcataagatactattcttattccagatagtttagtctttaaacctgaagaaacacacacacacacgcacacacacaccacacccccacatatgcgcacgcacacacacagttaccctactacctaaaggatctgtttacagacagtgtcgtggaggaaaggcatagcaacgtggtagtgctattgaatgtaatatggaaaggcagttttcagatgtaggtaacattaaagtagaagtgtttgagaacagaattggtaagtctgagatattstatacctagatttttcataaacatgctcacaatttttcagggcctccttttgactgcatagtttttagtcatattcaagtttttttattatctggctcttgtcttacttgtctttattttcagctattctcttttacataggcattatatagttatagcacactacaagttcttatcccacatatgcttggcacttgcccatattatgcctttgctacttaaatgctgcatcttctacctaggattgatttctttctttctttctttcttgtttctttctttctttctttctttctttct

SEQ ID NO: 142797 - DNA, 601 bp, Human
atgggccgggcgcagtggctcacgcctgtaatcccagcactttgggaggccgaggcaggtgaatcatgaggtcaggagttcaagaccagcctggccaagagagtgaaaccccgtctctactaaaaatagaaaaattagctgggcatggtggtggccacctgtaatcccagctactcgggaggttgaggcagagaattgcttgaacctgggaggtggaggttacagtgagccgagatcacgccgccacgctccagcctaggtgacagagcgagactccatctcaaaaaaaaaaaaaaaaaaagattcagctcaaatgggaaatctccctgaccgtttctcttcacacagaataagtaccatgtccaccaaactccagctacactttttaaaataaaccattactcacattttgctttttattttacctttattacttttgtttctgtctgtgctagattgtgagccccttgaggtcagggactgtatcttgttcatcttcattctaacagctttatgttcagttaacactagtagagcaaccaaagatgagcattttaaagttaaggatttatagttacaccttggttaatgaatctccaga

SEQ ID NO: 142798 - DNA, 601 bp, Human
aatcccagctactcgggaggttgaggcagagaattgcttgaacctgggaggtggaggttacagtgagccgagatcacgccgccacgctccagcctaggtgacagagcgagactccatctcaaaaaaaaaaaaaaaaaaagattcagctcaaatgggaaatctccctgaccgtttctcttcacacagaataagtaccatgtccaccaaactccagctacactttttaaaataaaccattactcacattttgctttttattttacctttattacttttgtttctgtctgtgctagattgtgarccccttgaggtcagggactgtatcttgttcatcttcattctaacagctttatgttcagttaacactagtagagcaaccaaagatgagcattttaaagttaaggatttatagttacaccttggttaatgaatctccagaattgatactcttttttagttagctttgtttaaaattcaaattataagtcctgagaagcagtattggcatgtgatggtgtttctacaaagccttacagctttgcaggataaaaatacctcagcacacagtttctctttgttcactcacagttgaaaatcaaca

SEQ ID NO: 142799 - DNA, 601 bp, Human
tcagaaaattgacacgataattgccatctctcatgtgaatgtgcccctttaacacaacgtcattgtgcactataaaacaggctgatctaggaaggggctgcaccctccagtttgctgcaggccaatgtgtcctattttcttaccagtttacttaaaatttaagtaatttcaaataaacttgcctgtccttgcaggcactggaattttcaattcttggtctttgatttttctgaaacatttgaaaatgcagaaaagataccacatgttctttgttcaagaaaaagggtctcatttagggaaytgaattgatggggtgccgaatggtctgggattgttaaatgctgttaatcaagtctttagcttactattaggaagaactaatttagactttgggatgatcaggatttaaatattcctagtagtttgtcactgacagtacaggaacacctgactcctaagtgtgttacattctatctgtcttgcttgagactgtaatgcagttgccatgggatgtattgtaaagaaaacttgaattatttaaggaatctttgagtttctaagtagagaaagagaagatgttgggggtttttttgttttgttt

SEQ ID NO: 142800 - DNA, 601 bp, Human
cacctgactcctaagtgtgttacattctatctgtcttgcttgagactgtaatgcagttgccatgggatgtattgtaaagaaaacttgaattatttaaggaatctttgagtttctaagtagagaaagagaagatgttgggggtttttttgttttgttttgttttttttaaaaaaaaggctgctcaaaggaaatgactttcagctagaatggttcagcctgcatagtgggtccctcacttttatatggcttcatattttatgaattagaagttctttttagtgactatccttaaaaaaaaaaatctcatttcctttctcacaaaaaagaaaattgaatcacagaaaagttgcgatttgcccaaggtcatgatttgtaaatggcaaagctggaatttgaacccacatctgattgattccaaaggaatcagctgacaagctacctctttcagctttcagtttcaaaaggttgcctggcttattcgtaggaaaagagaaaggagcagctggtactgtctctctcctccctcttattgaatgaccttcaaagtcccacaacttaaaccaacattgttagtaccatggttccgttacattataaaata

SEQ ID NO: 142801 - DNA, 601 bp, Human
tcctacacggtgtcagctaaaagttcttagtgacaatgtaaattcataaggataagacagaagtgtttaagtttgggttttttttagtttgcagcttttgtggggttttttttgcagcttttgttttttataagattggagtagaagtatgtagaatgctagataatttaacttcttcaggttcaattctagtattaattgtttgtcattgtatcacagaagttcatatccagcttttattttttaattttcattcttattcttctatttatttatttttttatttattatttatttattwattttgagacggagtctcgctctgtcacccaggctggagtgcagtggcacaatcttggcttactgcaacctctgcctcccaggttcaagcaattcttctccctcagcctcccgagtagctgggactacaggcgtatgctaccacgcccagctaatttttgtatttttagtagtgatggggtttcaccatattggccaggctggtcttgaactcctgacctcatgatctgcccacctcggcctcccagagtgctgggattacaggcatgagccactgtgccggcctattttcattcttgaa

SEQ ID NO: 142802 - DNA, 601 bp, Human
cttgaactcctgacctcatgatctgcccacctcggcctcccagagtgctgggattacaggcatgagccactgtgccggcctattttcattcttgaatttaaagttaaattattcaaagttgaaatatgtacagaaattctctcacttctattcatcctctcaatggagagagagagaccatatggcctgaaaccacgtccacagagcaatgaatcaatagggagtcctcctttcctgttttgcagtcctaaatgatactcccaatggctttcactctttaatatcagtatcagcaccacarctggtcgtaaatgaaggtcttttccttgaaagggtgactactctttctctcattttttttttcctggcttgatttggctctagttagcacaagaaaacttcttaattttcaaacagcatattaaaaactaccttctcttttaagaatttttctctgaatcccagctcacattggtagccacatactgccaggtatttcccatctatttttctagcatttaaagtttcatggagtcactaatgaagtagccatttgctatatttacttagtcaccatagcaacattgtctcggttagtgta

SEQ ID NO: 142803 - DNA, 601 bp, Human
attgaggagtaataaatggtccctgatcagctcaacgttttttcccctcatatatttctgctttatgcctgtactaaaatagtgtctagagtgcgtgattaacaggaaaagcattagcagtaagtttcttctatcacatgctgtcccttatgcctcccctccctcttcccactcccttgttcctcttccctgtcacacacacatttattttggaatccgaactttcgagatgaaaagcagtttactttcataaagtagcatgacacatcatgcctgacttgaagtaaagaaaaaaaaaaaatagtcgggtgcagtggctcacgcctgtaatcccagcactttgggaggccgaggcaggcggatcacctgaggttgggagttcgagaccagcctgaccaacatggagaaacctcgtctctactaaaaatacaaaattagccgggtgtggtggcgcatgcctgtaatctcagctatttgggaggctgaggcaggagaatctcttgaacctgggaggcaaaggttgcggtgagccgagatggcgccattgcactccagtctgggcaataagagcgaaattccatctcgaaaaaaaaaaaaaaag

SEQ ID NO: 142804 - DNA, 601 bp, Human
agagctgagtacttgctacccacctggggtggagcatattctctattttctggttcactctagccccagcttctctctcttatgttctactgcactggacaggcccctgtagacatttgagtttgtgattctcttccaccatccaatagattttctgcaatggtagaagtgtgttatatctttgttgtccagtatgatagccactagctacatgtggcaattaagcacttgaaatgtggctagtgtccttgaggaggcgaattcttaattttatttatttttaattaatttaaatagacaaggctagtggctaccatattggacagttcaagtcaataatggagtattttcctttattggctatttcctacagagtgaaaagcaagccttaatgcattttatatctattctcttaaatgctgaatctaaatgttagcatatattactgtaagccttatgatttgaaaaccaaataaccctctctgatgaaatggagcctgagacttttcttcttttttcctccttatttatttattcaacgcactgggttttacatgcctgttctgggccctaggcatatgatcatggtccctgttttcat

SEQ ID NO: 142805 - DNA, 601 bp, Human
aggcgcctgccaccatgcccggctgatttttttgtatttttagtagagactgggtttcgccatgttgggcaagctggtcttgaactcctgacctcaggtgatccacctgtctctgcctcccaaagtgctgggattacaggcgtgagccaccactcccagccagcaccaagtatttttttaatggtttacaaaacaaagtaaaatgtagcctggctgtatctaagtgatcagccattatttttctatttgtttcctgaaaacaacactgtatttttaaattttctgaaaaagtggagactcrttttttaaaatggtcagggtagccttttagcttgctcccaagtcagcctaatacctctgtgtagtttgtttggaaatatgtggtgctttacgaaccacatatttccaaattatattattttgtacaaacctagataaaccttaccttgactttgaaagcatatcaaggtcagtaatgtttaatttagtacattgttcagtgatgaaatggagttgccagttgttcttgtcacttcatgagatagtgttaaatgaattatttagtgttaaggaccctgctaaattattttaaacgattcaa

SEQ ID NO: 142806 - DNA, 601 bp, Human
gcggcaacataacagattaccatttagagaggccaaacccctgagagctgattgcattagaggaggatggggggccaagattaggacacaggtgtgttcagaaacaggctgacacttacttgtgtttcccacccactcccatcccccaccaagttaacacatttagctgtcccgacactttgtaaacattcctatatctgtcttcaatcttttttctctctctaaaggtttatctcttagaagctttgacataactttccttggaggaatcatttccacctaatctttttgccttatctctttttttttttttttttttttttgagacagtctctctctgtcacccaggctggagtgcagtgacacgatgttggctcactgcatcctccaccttctgggttcaagcgattctcgagcctcagcctcctgactagctgggattgcaggtatgcactaccatgcccagttcatttttgtattgttaatagagacagggtttcaccatgttgcccaggctggtcttgaactcctgacctcaagtaatctgcctgcctccacctcccaaattacaggtgtgagccactacacccagcctgcctta

SEQ ID NO: 142807 - DNA, 601 bp, Human
aataaaataatacataatgttaaacttgtattattttttaatagccagcatttttgtggttttcaaatgaaccatccaaggaattatagtatttcttctctttttaagaaagtgtacttcttcaggttataaaagtagtaaatacttattgcagaacatttagaaaacaaacttaaaatgcatccagtctgatctcttccttcccatctttcatgttagtttcaccatttaaaaaaactgccttttttttttaattaaaggcaattttctaacatcgttttcaatttttttgctgtaaccrttgcatctcactgcttcctattggattcattttccttcttactgaaataaattcttgagtagtttctcagtgaggatctataaataataaacataagcttttgtccaaaaatgcttatgttttacacttactcttcaattgtaatctaactagatatgttaggcaattttcttaaaaaactgcaatcttatattttgatatcttgctgatgagtttaaaaggtacagtgataacttttgcatcattaaaaatagttggcttagaaagctgtacttttccttccttaaaacagttttttaa

SEQ ID NO: 142808 - DNA, 601 bp, Human
gtgttgatgtattctctttttatttacctttatcttttatcagctgagtagacattttgaattaataacttgattgattttagaccatgtaatttaagatgatttatttttacatgaagattttttcccccagaaatttaaggctgattagcttcttggttttagtggttaagatttgcctatataataagcgggtgaaaagtacattgtggcattataatgagttagtttgtatatttagcttgtgtactggtttctgcattatagtcacgtatattcagtgcatttttaaagtattaargctagtgtatcctctgaggttacctttttatatattagttttcattgaataagaattatagaaataataactcttcatatttcactctgctaaacaagagtgttaataatgccttatattttttttcagattgcaaatagaagagtcttccaaaccagtgaggctatcacaacagctggacaaagttgtaacaaccaattacaaacctgttgctaatcatcaatacaatgtaagtcttctgcttgtctcttttcattcttttatatcttcattcttttctgtatcatagagtcttaggtt

SEQ ID NO: 142809 - DNA, 601 bp, Human
tctttaagactagccttggcagagtgcggtggctcacgcctgtaatcccagcactttgggaggccaaggcaggtggatcacctgaggtcaggagttcaagaccagcctggccaacatggtgaaaccccatctctactaaaaatacaaaaattagccaggagtggtggcaggcacctgtaattccagccactcgggaggtgaggcaggagaatcgcctgaacccaggaggcagaagttgcagtgagccgagatcacaccattgcactccagcctgggggacaagagtgagactttgtctcamaaaaaaaaaaaaaaaaaaaaaagactagcctttagtatcaacatttattaagtgacacaggatagcatctaccaaactactactttatgatatttgaatggttattttatatgaaagtagcaaatgccactagggctaagtagatatcttaaatgagtggaacaatgaaatttaagaaagtcagtgttagagactgtgtgaactggagtgcacatgacccatataaatacattcacattttgaaattgctacactatgtgagttaaacaaaccaggtaaaagttcaactgcattcagcca

SEQ ID NO: 142810 - DNA, 601 bp, Human
cccgggaggcggaggttgcagtgagccaaggtcatgccactgcactccagtctgggcaacaagagcgaaactccatctcaaaaaaaacaaaacaaaacagaaaaataccctcagaaactgatttggttaatctaatggggaggccagccatcttaagtttttaagcttcttgggtaattctagtatgcagccactgaaccaaagagatgagaactttttatagttctgccatctcctgttgagggtggggtgttcagtaatggtacttagaaggaaacctctttctcgcaaacctagaacttttttttttttttttttttttttttgtgagacagagtctcgccctgttgcccaggctggagtgcagtggcacaatctcggctcactgcaagctccgcctcccggattcatgccattctcctgcctcagcctcccaagtagctgggactacaggcgcccgccaccacacctggccaatgtgatccacccatctcggcctcccaaagtgttgggattataggcgtgagccactgcgcctggccaaacctagaacttttaaaaagaattaatatttcttttctttgttagaatttctgcccca

SEQ ID NO: 142811 - DNA, 601 bp, Human
cactctagtctgggcgacagagtgagatcccatctctaaaattagttaactaattaaaacaataatatttttgtagtacagtattagttaaatctttaatttatttttgagacggtgtctcactccgttgcccaggttggagtgcattggtgcattctcagctcactgcagcccctgcctcctgggctcaagtgatcctcccacctcagcctcccaaggagcttggactacaggtgagtgccaccacacccagctaatttttgtagaggctgggttttgccatgttccccaggctggtctygaactcctaagctcaagcgatccgcccaccccagcctcccaaagtgctgagataacaggtgtgagccactgcgcccggcctaatctttattttgttatttatttatttatttattgtcttagagacagaatctcactctgttgcctaggctggagtgcatgagtggcatgatcatagctcactgcagcctcaacttcttgggctcaagtaatcctcctgccttagcctcctgagtggctgggactacaggctcgttcatggctaattttgtagagatgggtctcactttattgcccagac

SEQ ID NO: 142812 - DNA, 601 bp, Human
cattctcctgcctcagcctcccgagtagctgagacttcaggcgcccgccaccatgcccggctaattttttgtatttttagtagagacagggtttcaccatgttagccaggatggtcttgatctcctgacctcgtgatctgcccacctcggcctcccaaagtgctgggattacaggcgtgagccaccgcacctggcttacagacaacatttttaagagtttttgtttactacagattatgtagtcaggataccttgaaactatgcttccaggtggctatcctcaagctttgggctcgaataractatatagttaattttattttctgaatctcattacttaagattgacatatgcctgtcaaggacaataactaccatggtttccagtgctttgatgaaaccaaacgccatgcatctgaggttttatgttgttggagcattcattgcatccctgggggttgcagctctctgtaagtttgctgtgctgaagcaagaaataaggcatatgcagatttcttcagaaattaggattccatgaaagatattgaggagatgaggaaggctggtatctttcagagtgcaaagtggtttgggaatataaa

SEQ ID NO: 142813 - DNA, 601 bp, Human
gaatcacatggaagtttgtcactgacttgtgttcgtgaactatgaaacacgaatatctaggctgagaaagagttcgtcttgataagtaaacaattaacaaatatttcggacaggaagaaaaaaaacagtttttgttcactaggcaaatgtagaggtaggctgcagtgcccccaggaactaaaccagtgatatacatgttaacacagaaagataagcatatatttttagtctgtttttctaattttaaagagaaagcaccaacattaacttcaatttgagattgaagcatgtaaaccaagattttttttttattttttattttttatttttatttttttatttttttatttttttgagacagagtcactctgttgctgagagtggagtgtagtggcacgatcttggctcactgcaacctctgtctcctggcttcaagcgattctgctgcctcagcctccctagtagctggagatacaggcgtgtgccaccacgcccagctaatttttttgtatttttagcagagacttggccgtgctggtcttgaactcctgacctcaaatgatccgcccactttgtcctcccaaagttgctgggattacag

SEQ ID NO: 142814 - DNA, 601 bp, Human
tcacattgttttccatttaactttctccaccacatgtcaccaaagtatcagactgagtatttacttataggtttaagaaaattgaatggaaacccttttatctcatttcctttaccattttgtctactctgccggtatactcaagaatctgttgattcttgctgctccatttattggattcagaatatgtaacaataaccaattttaaaaaacatcttaacataaccaaataacctatttgtgaaaggacttgattttttttatttatacaaagctttaggaaatgatttatgaaattttratgttcattatacagtttctcctgcagatatttctttactattatacatcaacccttgccttttgttaagaaattaatttgaattccaaaagatttactttttaataagaagaaagtgctcatggtggagtattatcaattcatcccaatgacttcactccctttggcatcaaagccttagaaacagcattctaagctagattaaaaattttttttgaaatagaataaataactcattagctaagctgtgtttcttctggttttaatgaaatttatctttgtatttatatatataaatat

SEQ ID NO: 142815 - DNA, 601 bp, Human
atcgccacactgtcttccacaatggttgaactagtttacagtcccaccaacagggtaaaagtgttcctatttctccacatcctctccagcatctttttttatacataacctacatgcatcctccagtatactttaaatctttagattacttatataatataatgtaaatgctatgtaaataattgttatactatattgctgagggaatagtgacccaaaaaagtttgtgtatgttcagtacaaatgcattaagaaaagaatcagaagatttttgatctgccattagttgaatccatggacktgtaacgcaagaatatggaaggctgattgtacttcatttctttttatttgcaaatatatatcatagtgtgtatataccatattttgtttatacattggtacatttgggttggacatttgcattgtttctacgttgggactattatgaataaggctgctatgaacatttgcctacaaattttcatatgaatatatgttttcatttctcttgggagtggaattgttcggtcacatggtaactttgtttagccttctgaggaactgctagacttttttttttttttgagatggagtctcgctc

SEQ ID NO: 142816 - DNA, 601 bp, Human
ccaccgcagttttaacttgacccacaaatgcaaacaaacatcctaatcacttgacctctttgatcaagtatgtgccttgccatttccttccaagaaagctgtgatgttctatcccttatttctctgcattcagacttgccgtaaattctctcccacacatccttttgatgaagaattgctggacctgagccagtttattcagatcttgtgctgcagcttggcacatagtctgtaataagacatatccccaatcctatgtgacataaaagtgatctactcagttctagaatcctctgtttcraatacaggtggttagacaaaagatttaattggaaagtcactcagtgtttaagtaagaggaggagaactcctttctctagatctctacacagaattgctgttcaaatcgaatgatcaaatatctatcctcaaagaacctaacatctctatgcgggctgtgttaggtgcccccttctcagtggtctcataataccctgtacacatgcctctgttatattttctgattacctgccaatttgcctttttctttttctttttttttttttttttttttttttgaggtggaatcttgctctgttgc

SEQ ID NO: 142817 - DNA, 601 bp, Human
gatttaattggaaagtcactcagtgtttaagtaagaggaggagaactcctttctctagatctctacacagaattgctgttcaaatcgaatgatcaaatatctatcctcaaagaacctaacatctctatgcgggctgtgttaggtgcccccttctcagtggtctcataataccctgtacacatgcctctgttatattttctgattacctgccaatttgcctttttctttttctttttttttttttttttttttttttgaggtggaatcttgctctgttgcccatgctggagtacagtggtgsgatctcagctcactacaacctccacctcctgggtttaagtgattatcctgcctcagcctcctgaatagctgggactacaggggcctgccaccacgcccagctaatttttgtaattttggtagagacgaggtttctccatgttggccggctggtcttgaattcctgacctcaggtgatccacccgcctcagcctcccaaagtgctgggattacaggcgtgagccatcacacccggcgtaatatgcctttttctttgcccccatcctctgcactaatcttaaactgtgaactctgagaggaa

SEQ ID NO: 142818 - DNA, 601 bp, Human
agtacagtttagtcagtaaactttgtttctcaaactagatcactgcttgagttctaaaactgaactagaatttgaatggtctatttttatggaccttcttagtgatatccccaccaccacccagcagtcctcttagctgccttgttagtcttaagcacgccttattcactttgcataagtacactgagtctctgtgatgtgcacgcaggcactataacaggagcatgtggccgggcgcggtggctcatgcctgtaatcctagcgctttgggaggccgaggcgggtggatcacgaggtcagsagttcaagaccagcctggccaacatggagaaactccgtctctcctaaaaatacaaaattagccaggcgtggtgtcacatgcctgtaatcccagctactcgggaggctgaggcaggcgaatcacttgaacccagtaggcaaaagttgcagtgagccaagatcatgccattgcactccagcctgggcaacgagagtgaaactctgttcccaccgtccccccgccccccccaaaaaaggagcatgtgatttaagaggagagcaaggcatataaataaaggattataatataataagagctacc

SEQ ID NO: 142819 - DNA, 601 bp, Human
agtgatatccccaccaccacccagcagtcctcttagctgccttgttagtcttaagcacgccttattcactttgcataagtacactgagtctctgtgatgtgcacgcaggcactataacaggagcatgtggccgggcgcggtggctcatgcctgtaatcctagcgctttgggaggccgaggcgggtggatcacgaggtcagcagttcaagaccagcctggccaacatggagaaactccgtctctcctaaaaatacaaaattagccaggcgtggtgtcacatgcctgtaatcccagctactcrggaggctgaggcaggcgaatcacttgaacccagtaggcaaaagttgcagtgagccaagatcatgccattgcactccagcctgggcaacgagagtgaaactctgttcccaccgtccccccgccccccccaaaaaaggagcatgtgatttaagaggagagcaaggcatataaataaaggattataatataataagagctaccatcgaaggttgtgcggtgtgaaatgtaaatctaaggtaaggctgttagagaaagtttctctgagaaagtaacatttgagcctagtcttaaagaatgaggg

SEQ ID NO: 142820 - DNA, 601 bp, Human
aataagacaactcctaaactgcttggcttaggaggccagctggttgtctttgtaccctgcgtgactgcctgtggcaattctgctgaatgactgccctttgccttacaacatgcattgacctagtgcctgccacccacatactcaccatgaggtacatagccccagaagggcggactggccggagtccagggatggcagccaacgccccataacagagatcagcattggactacaagaagaggcaaggagaaatcaaggatcaaaatttaagtaaaagaaaagccaagtcattaaaaatagmcccctcattgaagagtgggaacgtaggtgtgatgttctggcataaggagtgaaaaagaaaaagctctattacttgaagcttttcaccaggggcagagagaatggccggaagtgagaaacgtgtgtgtggatgcttacaccgatgccgtctcctaatattggaacatggctccagaaaggagaaccaattattcctaattccacgggcggcattctctgactcccaaactcccaaagtggagggcaggagctgcccttaccttgaggaagctcagagtgttgtggtaaaactctcccgggg

SEQ ID NO: 142821 - DNA, 601 bp, Human
ttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccraagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcag

SEQ ID NO: 142822 - DNA, 601 bp, Human
caactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggt

SEQ ID NO: 142823 - DNA, 601 bp, Human
caacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcrtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggc

SEQ ID NO: 142824 - DNA, 601 bp, Human
gcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccsgggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggc

SEQ ID NO: 142825 - DNA, 601 bp, Human
tgagccaccatgcacaacccaagcaaatttttaatactcagatatccaggagcaggaggggacatccctttgcaaaatggcttctctccagagctcagaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaasagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctc

SEQ ID NO: 142826 - DNA, 601 bp, Human
cccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcrgaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgaca

SEQ ID NO: 142827 - DNA, 601 bp, Human
aggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatgggggragtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtat

SEQ ID NO: 142828 - DNA, 601 bp, Human
gtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttag

SEQ ID NO: 142829 - DNA, 601 bp, Human
ccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttacca

SEQ ID NO: 142830 - DNA, 601 bp, Human
acacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtscgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaat

SEQ ID NO: 142831 - DNA, 601 bp, Human
ctgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattaggsacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcacct

SEQ ID NO: 142832 - DNA, 601 bp, Human
agtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagagatgaaatgtcccactgagtgacataagatcccactgctcatctgtcgtctagaaaaagcgaagaacctgccacccagggctgttctgtttactaggaaagtctgctgggtgtgctggccagcccggygacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaa

SEQ ID NO: 142833 - DNA, 601 bp, Human
acagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgsgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgcagctttgtggggggaaaaggagtttaggaagaaagggatgggtggggggatgtatttctccctggtctgtccac

SEQ ID NO: 142834 - DNA, 601 bp, Human
ggctgaggcaggaggactgcttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacayaccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaat

SEQ ID NO: 142835 - DNA, 601 bp, Human
tagcctggccaacatggcaaaaccccgtctctactaaaaatacaaaacaaaacaaaaattagccgggcatggtggaaaaccagcccacgctggtagtcccagctactcgggaggctgaggcaggaggactgcttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctacyccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaa

SEQ ID NO: 142836 - DNA, 601 bp, Human
tctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctac

SEQ ID NO: 142837 - DNA, 601 bp, Human
caggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgayagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttc

SEQ ID NO: 142838 - DNA, 601 bp, Human
agtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactacygagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaact

SEQ ID NO: 142839 - DNA, 601 bp, Human
gtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacartcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccg

SEQ ID NO: 142840 - DNA, 601 bp, Human
ggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattcsgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgcccca

SEQ ID NO: 142841 - DNA, 601 bp, Human
catccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttctcttcctcctcctccccccagcaggttaaagacctgctagttagcaacgagagcgggtggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcagga

SEQ ID NO: 142842 - DNA, 601 bp, Human
gcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatsgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggg

SEQ ID NO: 142843 - DNA, 601 bp, Human
aaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccartgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccat

SEQ ID NO: 142844 - DNA, 601 bp, Human
aaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaaygacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggc

SEQ ID NO: 142845 - DNA, 601 bp, Human
acatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtatkagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaata

SEQ ID NO: 142846 - DNA, 601 bp, Human
tggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaaytccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggct

SEQ ID NO: 142847 - DNA, 601 bp, Human
agattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctrccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagca

SEQ ID NO: 142848 - DNA, 601 bp, Human
caacatgtgttgggtcggaactggcccgcagactagagtttgccaatcccagattgctgggagacttctcaatatctactaatagaataccacaaagccaaaaaaagacaaaccgtgatcattcccaggcttattacaattttaactctccagtccagtcaaaattgcttgcctagcaaacaccaaacgtaacccaggctccaggtatctgacagcaatacagcttgcgcatgcaggcggggtgttcaaacttctctagaaaacaatgcctttttatgggaatgcctttttatgggaattkttgcacaaaatttcaagttaagaaactttccataaatacacaacgcatgctctagccacagctggtttcatatgctaactgcagaaggcatttccgaaagcagcatgtgaagagtcctccttaaatacagcgttagggaaaatgacaccctctatcctccccactgcccccaccaccaagaaggaatttgggtctgtgttcagtaagaagaaatctggccagaaaggggttaatgcccttccaggctgggatctgataaatggctgtgcagaaagcaggttccctcactttgagatatga

SEQ ID NO: 142849 - DNA, 601 bp, Human
tctaatgcctacacttcctcaatgaaaatacactttccacttggacatcagcccattagctttgggctggaatctctggcctccttatccctcccccaggcacccctgggctgcaggtctggcatctggccccctgacaccccagccaacatgaacatcccagccagagtattgtcagggcccaaccgaaaaagataaacagtcagagacctacaggaaaaggcctgctctccctgtctataaatcactggtgggaaggaaagaaaagtgatccaactctttcaggataaaaatcacagcrgtcactgaggaaaattgatgttcccttgcaaagcgaaagatgttctctccgggaagatgcatgccttcaagttttcagacagactgagactcaaacttcacccaatgtgacacaggattgagacaagttatgtgacctccacaaagctcaacctctcacgccagattcgatgcttcccaaaaggaacacacccatgtcttggcagtctccgataggctgaaatagtagagggtctgctgggcacagtggctcacgcttgtaatccgagcacttagggaagcagaggtgggtggatcccat

SEQ ID NO: 142850 - DNA, 601 bp, Human
ggctgtcactggatgaaagaataaaacagcaaaacatccggcaccttttcatcctggctcaagtcaaaagagttgggattaaagccacttgtgactttcaaaagctatcactacgaggcaaggaccgagtggccagttcgtttcagaaagtggcctgatgctgttgaaactgccagctgccagtggacgtgagcctcactcccactttatagtctcaggaaggtggctctcaggacatgacgccaagccccagaagggcctctgaatcctccaccagcgtgtgcgtgtgtgtgtctgtgcrtgtgtgtgtgtgtgtgtgtgtgtgcgtgtgcgtgtgtgtgtctgcacgcgcacctgagtgcacatgggctgcctggtttacaggccaccacaacccttccaccaagtgtgaacacacatacacttccttaccaaggtgcccaccggaaacccctgcctggacccctgcagccctcccagccacactgcagcatcgagggaacagcactttgcctccccaaacctgccctggctactgggtgaccccgctctgctatccccaccttcaccctgagatgcacagactgtctgctctaaaggg

SEQ ID NO: 142851 - DNA, 601 bp, Human
cagctctgcttgcaccctagtgttggggctcaagcttccggttccgctaagactctgacctcgcttctaaggacacacacctcagaggcccagagctccgctgtatcacacactcattgtcacatccctcgatgcatcattcccagaatcctcaaggctgtcactggatgaaagaataaaacagcaaaacatccggcaccttttcatcctggctcaagtcaaaagagttgggattaaagccacttgtgactttcaaaagctatcactacgaggcaaggaccgagtggccagttcgtttcaraaagtggcctgatgctgttgaaactgccagctgccagtggacgtgagcctcactcccactttatagtctcaggaaggtggctctcaggacatgacgccaagccccagaagggcctctgaatcctccaccagcgtgtgcgtgtgtgtgtctgtgcgtgtgtgtgtgtgtgtgtgtgtgtgcgtgtgcgtgtgtgtgtctgcacgcgcacctgagtgcacatgggctgcctggtttacaggccaccacaacccttccaccaagtgtgaacacacatacacttccttaccaaggtgcccaccg

SEQ ID NO: 142852 - DNA, 601 bp, Human
ccccacagatagagctcgtccagagaattgtccaaccatccattaaaatatccaagtggccccagtgtgccagagactgctctctctgcactagggctaggggtaagcagcaaaccaaacaggctaagacctctgccacctgcatagagcccatgcctactgtctgacccatccctacctctgcagatgctccttaattccccacttttactctctcctcttcagaaaatgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttcccaggctcaagcaatcctcccgccttagcctcttgagtagctgggactacaggcatgcgccatcacacccggctaattttgcttgattttttttttatagagacagggtctcactatgttgcccaggctggtctcgaactcctgggctcaagcaatcctcctgccttggcctcccaaagtgctgggatgacaggcgtgagcatacacgcctggc

SEQ ID NO: 142853 - DNA, 601 bp, Human
atcagctgacttctccaactccagggagctagaccacatagtcctccaccaagagctttgctagcttagcaccccacagatagagctcgtccagagaattgtccaaccatccattaaaatatccaagtggccccagtgtgccagagactgctctctctgcactagggctaggggtaagcagcaaaccaaacaggctaagacctctgccacctgcatagagcccatgcctactgtctgacccatccctacctctgcagatgctccttaattccccacttttactctctcctcttcagaaaakgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttcccaggctcaagcaatcctcccgccttagcctcttgagtagctgggactacaggcatgcgccatcacacccggctaattttgcttgattttttttttatagagacagggtctcactatgttgcccaggctggtctcgaactcct

SEQ ID NO: 142854 - DNA, 601 bp, Human
aagtcatgaaaactctgccaacactgttctctctccagcactcacctgggctccccaccaatgtcttggctgccgtcacgactaaataatgccttctcttcttcccctccacccacccctctctggtctttagcacaacctatcagctgacttctccaactccagggagctagaccacatagtcctccaccaagagctttgctagcttagcaccccacagatagagctcgtccagagaattgtccaaccatccattaaaatatccaagtggccccagtgtgccagagactgctctctctgsactagggctaggggtaagcagcaaaccaaacaggctaagacctctgccacctgcatagagcccatgcctactgtctgacccatccctacctctgcagatgctccttaattccccacttttactctctcctcttcagaaaatgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttccc

SEQ ID NO: 142855 - DNA, 601 bp, Human
tctagtttgccttgattcaaattctttatgctacttgacccatttctcttttcctcttgcttctcctgatgcctctcaaaataataataaaccaaccccagaaatagaatcctgtcttccttagatgtcaccatatgactaatttatggcctttgtttaaagcccttacaccagagttgactccagtaatttcctcctcttctatttgaatgtccatttacagcctctctgtaacctctgggtgaactgagaatgttctctgtgcctctcatgatgtggattcgcaccctggtgacagcakagtggctccgagcagaatctccccattacagctgaagcccactgggaccctacccaagttcacgtgtatatcccaagagagtttgctgaacactccttatgccttaatgcacctttgaaaaaaaaaagactaagggggctgggcgcagtggttcatgcctataatcccagcactttgggaggccaaggtggaaggttcacttgagcccaagatttcaagaccagactaggcaatatggcaagacctcatctctacaaaaataaaaataaatcagccaggcgtgggggcatgtgcctgtgg

SEQ ID NO: 142856 - DNA, 601 bp, Human
tccacaggtgggcccgcctgaagcctcgctgtgatgccaggcagccagcctgaagaactggaaagccagggcccgtgcacgctgggctcctgaagacaaaggaaacagaatggctcgggaaggccgtggcaccctgcccgcctccgtggtagcctggggccactggatcttgctgtctccgcagcacctgagaggtgtgagccaggcagccaaccacatcagaagctggctgccggctgccccaattgcacaacacctccaggggagccagctttccaggactgggttttacacaccatasgggcactggccatgttgacccagtcaaggcatggcaccttgaagaatggcccacgcaaagaccggccatatggacagaaggcatcctgccacagagcgatttctgaatcacctctatgcaaagaatagtcttctctcttacgcaaaggagatcccatcaccaccatctcatttctatcccaggctcctccagttctctttcaatcacaagccagactacccaaccacttaactctctaggcccagatatgacttaattctcccactcctgcatgtttgttgccacttccccattttgtgt

SEQ ID NO: 142857 - DNA, 601 bp, Human
taatatccgtaacctacaaatatgttaccttctacagcaaaggaaactttgcagatgcgatcaagtgaaggatctttggatagaggagatgatcgtggattatccagggggcctgatgcaatcacaggggtccttacaacaggggcaaaggagaggacagagtcaggcagaagaaggagatgtaacagaagcatgacacagagtgatgtgaggaaggggccatcaacccagaaatgtgggggcctccagaacctagaccatgcaaggaaatgggttcctcctcgaaaccgctacgagaaascagccctgccaacaccctgacttcagcctactgaaactgatttcagacttctaggctccagctacaaggcaatcagtttgcggttttttgcatttttttttttttttggaaaaatgaaagctgatttttattttatcatcaacagccattctttagacatgaacatgcatacgtaatattctatgcacacatcgcagttttgaacattagttaataaagtttaaacatactacatccttacagaaaacatcaaaatgcaaacttaagtttgtgttttacaccaacaagtttgtggtaatt

SEQ ID NO: 142858 - DNA, 601 bp, Human
ccagcaacactgcatatattaatatcacaagtctgggctgggcgtggtggctcatacctgtaatcccagtactttgggaggccaaggtgggcagatcacgaggtcaagagatcaagaccatcctggccaacatggtgaaaccctgtctctactaaaaatacaaaaattagctgggcttggtggcgctactcaggaggctgaggcaggagaatcacttgaacctagaggcagaggtcgcagtgcatggatatcatgccactgcattccaggctagtgacagagcaagactcaatctcaaggaaaaaaaaaaaatcacaagcccccctgtggattcttaagctttaagctaactcccctccccccaaaatactgggataataaatgcaaccaaaattaagatgcccctcctcaactcaattcggtgggatacctttttttatcttggtgttatttgggtattctgcactaattctggggcaccaggtaagtttctatcgaggggtagaagctgacttctgtccccgtcccccaagaccaaagaggaagcctcttctgccaccactgaaatactatctttagaggaaggcatgctattagctca

SEQ ID NO: 142859 - DNA, 601 bp, Human
ctcccaatgtgctgggattacagacctgaaccacttcacctggccctggctaatttttttttttttaattttttgtagatatggggtttccctttgttgcccagcgtggtctcaaactcctggcctcaagcaatcttcctaccttgaactcccaaagcactaggattacaggcgtgagccaccacacccagcaacactgcatatattaatatcacaagtctgggctgggcgtggtggctcatacctgtaatcccagtactttgggaggccaaggtgggcagatcacgaggtcaagagatcragaccatcctggccaacatggtgaaaccctgtctctactaaaaatacaaaaattagctgggcttggtggcgctactcaggaggctgaggcaggagaatcacttgaacctagaggcagaggtcgcagtgcatggatatcatgccactgcattccaggctagtgacagagcaagactcaatctcaaggaaaaaaaaaaaatcacaagcccccctgtggattcttaagctttaagctaactcccctccccccaaaatactgggataataaatgcaaccaaaattaagatgcccctcctcaact

SEQ ID NO: 142860 - DNA, 601 bp, Human
gactggagtacagtggcgtgatcttggctcactgcaacctcgacctcccgggtttaagcgattctcccacctcagcctccccagtagctgggactacaggcatgcaccaccacaccgggctaatttttgtattttttggtagagacggggtttcaccacgttggccaggctggtctcaaactcctgacctcaggtcgatccgcctgcctcagcctcccaatgtgctgggattacagacctgaaccacttcacctggccctggctaatttttttttttttaattttttgtagatatggggtytccctttgttgcccagcgtggtctcaaactcctggcctcaagcaatcttcctaccttgaactcccaaagcactaggattacaggcgtgagccaccacacccagcaacactgcatatattaatatcacaagtctgggctgggcgtggtggctcatacctgtaatcccagtactttgggaggccaaggtgggcagatcacgaggtcaagagatcaagaccatcctggccaacatggtgaaaccctgtctctactaaaaatacaaaaattagctgggcttggtggcgctactcaggaggctga

SEQ ID NO: 142861 - DNA, 601 bp, Human
ttgtccagcagtaattaatagtataatccacatttcagatgcattaaagcgaaaatgctgcattatcagagagcccggcacacagcctcagggcagagcctccctgctgacctgcagaaccaggttacctcatctcagcctcctcctctcaggggagctgactctagacacctcataaaaggaccgagctggcagccagaagtctccactctgcctgatgtgctgtgtctgtcttcagaaaccacccactccagagccagtcctttgggcacacgagttctactccaggagacatttacawcaagttctactctctgaccaacattgaacattttatttttattttatttttttacacagagacagagtcttgctctgtcacccaggctggagtgcactggcatggtcatagttcactgcagcctcgaactcctgggctcaagtgatcctcccaagtctacctcccgagtagctaggactacaggtgtgcaccaccgcactgggttaattttttgtttgttttattttgtgagacagggtctcactcttgtcatccaggctggactggagtacagtggcgtgatcttggctcactgcaacc

SEQ ID NO: 142862 - DNA, 601 bp, Human
tcactgcactccagcctgggttacagagcgagactccctctcaaagaaaaaaaaaaaaaaaaaaactcataaaggtacacagcacctgggggcttccattagcatcagaacacccacggaggcacgccccatgggaaggtggcactcagctcccaccacagagcaaggccctttaacagcgaagatgctgcagggcactgctactcgccctgctggggagaagccacccagcagccaccctaggagcctggcacagaatgcccagctgtggggaaggaaactgtgccacctgcatcgcccrtgtgccaaatggagttcaagactctgcaccgttccccattcatccccacgagaggttcagcagccactgccgctaaaacaaaagacggatgacaggaaaacccgctggcctttggcccattccctagcaaaggggaagtgtaaaagtgcaaaggggaaagtgggccagctgcactaatccctctttgtccagcagtaattaatagtataatccacatttcagatgcattaaagcgaaaatgctgcattatcagagagcccggcacacagcctcagggcagagcctccctgctgacctgca

SEQ ID NO: 142863 - DNA, 601 bp, Human
aactcattccatatggatgaaaaatgagtatactagcctgaatatgggaaaaaaatagaaaatgtaatcatatattacttaaaatctataacgttttatgcaaagataaggtgttagtaccaaacttaggcattcagaatgtctcaaatacaatatcatgggctaattgctggctaccaaaacctccatcccccagcagcagatggcagggccagccttttgtactttacttgaccatttaagaaactcacaaaggggccagtcatggtggctcacacctgtaattccagcactttcagargccgacgcaggcgaatcacttgaggtcaggagttcgagacaagcctgaccaaaatggcaaaaccccgtctctagtaaaaataaaaaaattagcagggtgtggtggcgcacgcctgtaatcccagctattcaggaggctgaggcaggagaatcatttgaactcaggaagcagaggttgcagtgagccgagattgcatcactgcactccagcctgggttacagagcgagactccctctcaaagaaaaaaaaaaaaaaaaaaactcataaaggtacacagcacctgggggcttccattagcat

SEQ ID NO: 142864 - DNA, 601 bp, Human
atctccttacgcagcctttcccattttacaattactacatcttgtagatcttgcctgctacagaccttaaaacgcatttcaatcccaaattaattgaattaacttgtgcttataagcatcataccgtatcaactcccttccttcccacaaactttgtagtgccaagttaaaaagaaaagaaaaaaaaatggactccataaatcagttttccaatttacgttgaagaaatctgtttcctactttctaatttctgcaactgggaaattctgtatattatgttaccatataatgaaggatgccrgtaaacagaaatccacacgcctgcacacacaacagattacattgtatgtaattgcaaacaccaccaagttatgtactcttgggagcattattagtgagatgtggttatttaatgcttcatctatttaaaaaaaaaactcattccatatggatgaaaaatgagtatactagcctgaatatgggaaaaaaatagaaaatgtaatcatatattacttaaaatctataacgttttatgcaaagataaggtgttagtaccaaacttaggcattcagaatgtctcaaatacaatatcatgggctaa

SEQ ID NO: 142865 - DNA, 601 bp, Human
gggaagaggatgttaagtctctgtgccttctgaaaattttatcttgggcatatactgcttgcttatttcagaagcaaagtcacccctcaataaatggaataaaaccatcccagatacaccatctaagtatataaccaagtaaacttccatatttttttgatgaaatttagagatggcttcaattgagtaagacttggccccaagatgattacatctgtgactaaagaaggcaggagggaaaaacaataatctctaattctgcaatctccaagttcagaagaattgagagctacaagaaaawtaaagtatatacgtgtgtgtgtgtgtgtgtgtgtgtgtgtatgtgtgtatatatatgttaaaaagcttaatgaggttccaactgggctattttgaaacctaaatgtcaggaacatgaagctgaggcagtacagtagccagttccctgtatctccttacgcagcctttcccattttacaattactacatcttgtagatcttgcctgctacagaccttaaaacgcatttcaatcccaaattaattgaattaacttgtgcttataagcatcataccgtatcaactcccttccttcccacaaac

SEQ ID NO: 142866 - DNA, 601 bp, Human
tcaagtaactggatttcattaacatgtttaagtattctatggaggataaaaacatctctgaaaggagatgaaactctggcaaataaaaaaaaaccttttaaatagaaaacacgacaatgttaaaagtgaaaaatgactcatataatgctgtgatggccatatctacagacactccttgtagaagggatataaccaccattggtcctggggcactgagagatctgagtgtaagcaacacaaggagagagggaagaggatgttaagtctctgtgccttctgaaaattttatcttgggcatatrctgcttgcttatttcagaagcaaagtcacccctcaataaatggaataaaaccatcccagatacaccatctaagtatataaccaagtaaacttccatatttttttgatgaaatttagagatggcttcaattgagtaagacttggccccaagatgattacatctgtgactaaagaaggcaggagggaaaaacaataatctctaattctgcaatctccaagttcagaagaattgagagctacaagaaaaataaagtatatacgtgtgtgtgtgtgtgtgtgtgtgtgtgtatgtgtgtatata

SEQ ID NO: 142867 - DNA, 601 bp, Human
tccagcctaggcaacagagcgagactccgtctcaaaaaaaaaaaaggtcttcagcataatgcttggcacttagaagttctgaagcgttatgtgagctgttactctgattcctctcacttaacatgaaatacaacctttaccagacacatttctatttgattccatcccactgagtgatctctatattttctaaccagtttttcccagtatatgagaaagctaattatcttttaaaatgttacgttgtaactgaactccttaattaaatttaaatgtgtcttgggccactaggaagacagtracatctggaaataattttctttgtttctttttaaccattatttgactttggtttgtccatcctgaccagttcaataaggtaggaaaaagaaattagcaaattagtatattccatagtctccattgtgttcccagtttcagaatgttgcctctcatgattcatcactaagtctgagggtgttggctgcctgtttcttcattgagaagtcaatgcatcctctttcaagcttgagttttcaaaattctaagcagactaggaataagggtagaaaattaccaaatgcagtcaagtgtgacggct

SEQ ID NO: 142868 - DNA, 601 bp, Human
gaatcgacatatcacatatcacaactgcatactgcccacccagcttatgctgaggtgtgatctaagtttgctttgaaattcagtgacatatcagaaagacagcacacacatttccatcaagacagctaacttgggcaaaggtgttctcaagtacccaaggcgattgattccacaagcttgcagatcactaagacttccactatttttacaaacacataccatagatgcttacagtaaatatcataaataattaaagctaagtagcctaaggacattttgtgaagcatctttgctgcttttytttaaattaggttctcgctaattcacaagattgaataatctccaaaaagcctccaaacacagccacaggccagtgctatttaagtgattctacatttttgcaaacttttaagcacatattttcttctcatgacaaaaagtaatagatattcactatgcggagctcagaaaacaaagtattaaaagtagcctgtacttctaccagctggaaatagccatcagtcatatgtaattctttagcttctcttctatgcatattttaaaaattaaactgaagtcctatagtccacagagttccttt

SEQ ID NO: 142869 - DNA, 601 bp, Human
ctaactggaaaaggacagcggatgggcgtcagatcatgtgacaagaccttcctccacgttcgacacactcctggagtctctgctgaaccccacaaaccccttaggcaaagcaattttgaaactgggggtggagacaagaacagcagccaacactaagcaatgaagctgttcctgacacttgaacaaactgtcgcctcactcagtccttatgatccctggtgggcagcctctaagccagatcctccaatcccaccccgtggcattcacatccttgtgtagtcccctccccttgggagtgagyaatacatagggactcacttcttaccaacagcatgcaaatggaataggacaaatgtgataggacaccacttctgagatgaggctgcaaagaaaccgtcattttagtcgtctgcacccttctcctcctcctctcccttatggaagccaagtgccccattgtgagctgctctgtggtgagacccacatggcaaagaactgagagcagcctccagccagcagctcttggggaaatgaatcctatcaacaaccgtgtgtgtgagcacagatttcagtctgtccccagtcaagtcttcagatgaga

SEQ ID NO: 142870 - DNA, 601 bp, Human
agacatgccacacccagcagacactccaaagcctaactggaaaaggacagcggatgggcgtcagatcatgtgacaagaccttcctccacgttcgacacactcctggagtctctgctgaaccccacaaaccccttaggcaaagcaattttgaaactgggggtggagacaagaacagcagccaacactaagcaatgaagctgttcctgacacttgaacaaactgtcgcctcactcagtccttatgatccctggtgggcagcctctaagccagatcctccaatcccaccccgtggcattcacayccttgtgtagtcccctccccttgggagtgagcaatacatagggactcacttcttaccaacagcatgcaaatggaataggacaaatgtgataggacaccacttctgagatgaggctgcaaagaaaccgtcattttagtcgtctgcacccttctcctcctcctctcccttatggaagccaagtgccccattgtgagctgctctgtggtgagacccacatggcaaagaactgagagcagcctccagccagcagctcttggggaaatgaatcctatcaacaaccgtgtgtgtgagcacagattt

SEQ ID NO: 142871 - DNA, 601 bp, Human
ttgggcacgatacaagtcagacatgggacagccttcgatgccagcgtgggcaggggtctcacctgagcccacgagaccacacacactttggcagcaactcttgaatcagtcaattttcttcacaccataagtacatacttcactctctccgctcagcagctgcacctgccctatctggtggagtggaggacactggcaagctgaaagcttctgcaggctcatccatccagattcagctctaagagcagggcaacccggggaaaacggaaacatacagaaaacagttcacttctggcttgtygctttggctgcaggcaagagaaggtgtgcacagagttttgaaggaaagactggaatgggctgacactgggctttgttcccggagccccatggggacagggctggcttccgaacctagaaatgcagagagctgctctccaacaggtggagggcccacccgagtaagtatcccgggcagaagaacagagcaggcaccactgtctgtcaacaccaggctcggcatcctcccatcccccagggtccctcgacctgtccccagggcactggagagaggagggagggacgaagggcacgcggtgaa

SEQ ID NO: 142872 - DNA, 601 bp, Human
cagcctcctgagtagctgggattataggcacatgccgccacacccggctaatttttgtatttttagtagatacagggtttcgcatgttggccaggctggtctcgaactcctgacctcaagtgatcctcccacctcagcctcccaaagtgctgggattacaggcatgagccaacatgcctggatacctggaaaatcttaaggcacaaacaaacacaggacaaatccacaggcttgggaatcactataagcagaagaaaaatgtccacagggcataaactttggaggcatgctcacagcaacmgctaaccagaaaacttcgcaggctcagtccagatctgggcaggattggctcaggggtgacccatctatcctgagagctgtcaggaccccatcctattgggcacgatacaagtcagacatgggacagccttcgatgccagcgtgggcaggggtctcacctgagcccacgagaccacacacactttggcagcaactcttgaatcagtcaattttcttcacaccataagtacatacttcactctctccgctcagcagctgcacctgccctatctggtggagtggaggacactggcaagctgaa

SEQ ID NO: 142873 - DNA, 601 bp, Human
gtcactggcggggtaagatctgtcttgcatatcatggcggtctccatcccactggagaattcaatggtgctgtcttgcctatgggctgtgaaacttgaacaaccggattctgagggtccagacgtctctgtttgagcaacagctgccttcctttaaaggtcccacagttgagcaatagagttctttactcaagagggctgttccaagtcttgagtaaccacccttgccctcaagggttccccagggtgaagccccattgcctctgcctcaccaaggaggcagcgactcagtcttctcgctrcacatctgtctcctcactttccagtcagatcacagccagtgggacacaatctgacaaagttctgtctaaggtggggtaatctgaaaagcaaatacagatcatctccccccagacttattcacagcactccccactggagccaggtttgactttccacaaagttcactggccagaatcataacccacacatctatggctcttccttctttaaccatctttcatgtaaatccttcatctaaaaggggaaccacctatctatgaactttaaatttcccagtatccatgttaaaaaaggggagg

SEQ ID NO: 142874 - DNA, 601 bp, Human
gtttctgttcaaatcaaaaagcgctaagtcctggctgatttctgactcagccagtcaaaagagggacacgcctccctaactgcaggagggtggggaagggcagctgcactcagtccgatggaggggaaaccagtaaacccgtcccttggcactgtcacttggcaatttctgaggtttaagacgacacggcgttctcccaggtcctggcctgtaaatgccagggaaacgcattgtacttgtgaagagagagaacacagagtttcgaaactgctctaaagcccatgtctcaggctgcaagaaygttatcagtctcacacatcgtgcccctgcctccaaggcccccatcaccacatactgatcttgccctgatttgaagcgggcgggagagagctatggggaagtccaggcctgtcccagccacggatgggacaaacagacaggaactgagtgctgaagaccttgctgtagctgctgagcgatcttaaaagggatccaccctggaggagctgagcaccctcttctttccagttctcctcactttaaacgatttttgtctaataatgtacccaacaggcagatatcagagaagcactaaactaac

SEQ ID NO: 142875 - DNA, 601 bp, Human
gatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactctggcctgggcaagacagcaagacgctgtctcaaattaaaaaaaaaaaaaaattaaaacagagccaggtgcggctgttcatgactataataccagcaccttgggaggccgargcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaaaaaaaaaaaaagaaaccatggcactatcaaactccaccagccaatgcgagaagcaggctaagaacacgcatac

SEQ ID NO: 142876 - DNA, 601 bp, Human
aataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactctggcctgggcaagacagcaagacgctgtctcaaattaraaaaaaaaaaaaattaaaacagagccaggtgcggctgttcatgactataataccagcaccttgggaggccgaagcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaa

SEQ ID NO: 142877 - DNA, 601 bp, Human
ctgataattactgactgcattttttaatactgatggcatcatcttgatgaggaatcaggcaatgaaataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcrgtgagccaagatcacatcactgcactctggcctgggcaagacagcaagacgctgtctcaaattaaaaaaaaaaaaaaattaaaacagagccaggtgcggctgttcatgactataataccagcaccttgggaggccgaagcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtgg

SEQ ID NO: 142878 - DNA, 601 bp, Human
tggattcatttccaagtgatcctgattggaattcaattgcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaakcaggcaatgaaataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactctggcctgggcaagacagcaagacgctg

SEQ ID NO: 142879 - DNA, 601 bp, Human
agccagtcccggagctactcttcccgctcccacctttcctgcagctgactgaagggtgcatgcttagctggtacacggacccaagatccttctccagccactggatcaggaagctgtggccatcgaggggtcgatatgcaggctggaacccgccaaacatttctgattaagggattcactccagccttcctctgagctcacaccatatacaatcttccctctgcactgctctaaatcacttcttttcaaataacgcggatttctggattcatttccaagtgatcctgattggaattcaatygcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaatcaggcaatgaaataaactacggtactggctaggcaca

SEQ ID NO: 142880 - DNA, 601 bp, Human
aacagccagccagtcccggagctactcttcccgctcccacctttcctgcagctgactgaagggtgcatgcttagctggtacacggacccaagatccttctccagccactggatcaggaagctgtggccatcgaggggtcgatatgcaggctggaacccgccaaacatttctgattaagggattcactccagccttcctctgagctcacaccatatacaatcttccctctgcactgctctaaatcacttcttttcaaataacgcggatttctggattcatttccaagtgatcctgattggamttcaattgcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaatcaggcaatgaaataaactacggtactggct

SEQ ID NO: 142881 - DNA, 601 bp, Human
caagcagatgataaaactgtttattatgataattgcagggtccctgcaagatgctcccagcgcttcctaaagctgtttacaaaactaataaagatttgccatttcaaggtcttccatttttaaccaccccccaccccgccaactccccacaatctcccactcccaaaaagcaggcctcacccctgggcggttaacatgttcttcccagggacaggcactccatggcccgtcctgggtggagcttcactctcagattctctaaagaacagactgtccttctccaccctcaccctgcccccarcttcaggaaggggaggacggaagcacagccgacagccactcagggccttcagatttcctccttaggacccgccatgtgataattatggggttttatcgatggaggggggctgctcagggctccttgggctgacatccatttgttctaacacatttaagaaaccacaccaccttggtttgtaattaaaacttctctggagaacttggtggccatgaagctaactgaacatggtcaaatgctgattgtagaatgcatttccgccaacactactcaactgtgacttgggctgctgaactgggc

SEQ ID NO: 142882 - DNA, 601 bp, Human
ttatataaatatgcatatatacctatacacatatacacatacatctctcatatttaaaacaaaatagagcaattaaaagaggaaaaaaacaaagccaacacacacgtacccctaccaccaccactacgaacaccaacacgcccccacaggcaagatcttgtcccaagtttctgagaaacgtcacttaatactacgtaatctcgaaatgatggggtctgcctactggctttgtctggagactggactccagctgctctcctaaactgtccttgtcaccttctcatcaggagaaaaggggaaygtaaacatgaaccacaccagagatgggctatccagtgaggctgatatcatctcaggcgccaccgacatctctctccagcattctgtcatcttatgatcaactatgtaactccagacatccaggggaacctgaatcctagaactagatgtccccaaataagtggtttctctgtaaaagtcaaatgtggatcacaaaacaaatgtgaggggagtcccaggaaagccagttgcataagggtgtcctcaattaaattctacacacgtcaatttttccccagggagggcgaggcagagctgagaa

SEQ ID NO: 142883 - DNA, 601 bp, Human
tatctatgtaaaacagaaaagaaggaaaccggcttcttccccgtcaggaatgtcgcttattctatgggtgtgagcagtttctttagtccactttctgccatcacggtggagcccttggaagcccctgttcctaccgtgatagaaaacaatgagacttatgaggcaacttaataaccactgaccaccttcttagtccaactgactaagctgagtgacatttttaggaagagcattaatgcggaaaacaaacctttccaattcatggaatgaggtaatctgggcagaggaagggtgggggcasagtgagtagatccagaacacaaaacaatgaccaggatccccgaacatcccagctggaatgagggcaaccccaaaggggtcgacagagaaggcctaggccaggtgcgatggctcatgtctgtaatcctagcattttgggaggccgaggcgggaggatcacttgagcctggcagttcgaggccagccacagcaacatagtaagacccccatctctacaaaaattaaaaaattagctgggagtggtggcacccacctgtagtcccagctactcaggaggatgagatagaaggatcgcttgagc

SEQ ID NO: 142884 - DNA, 601 bp, Human
actcagaggagctcatgtcaacgcagagttcaggttaggaccagtgggggtaacgtaaagggtgatttgggccccaggattactgtagcatgacccaagcaaagtgcacatatctatgtaaaacagaaaagaaggaaaccggcttcttccccgtcaggaatgtcgcttattctatgggtgtgagcagtttctttagtccactttctgccatcacggtggagcccttggaagcccctgttcctaccgtgatagaaaacaatgagacttatgaggcaacttaataaccactgaccaccttctkagtccaactgactaagctgagtgacatttttaggaagagcattaatgcggaaaacaaacctttccaattcatggaatgaggtaatctgggcagaggaagggtgggggcagagtgagtagatccagaacacaaaacaatgaccaggatccccgaacatcccagctggaatgagggcaaccccaaaggggtcgacagagaaggcctaggccaggtgcgatggctcatgtctgtaatcctagcattttgggaggccgaggcgggaggatcacttgagcctggcagttcgaggccagccacagc

SEQ ID NO: 142885 - DNA, 601 bp, Human
ccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttttttcctgagatggagtctcgctctgtcatccaggctggaatgcagtggcgccatctcggctcactgcaacctccacctcccgggttcaagcgattctcctgcttcagcctcctsagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccagcctttctacacattttcaaacactctcatttgacctctaacaatctttttaaatagaatgggaatcatattttcgattttacaggtttaaaaaaataattcattcaaacatctgagtgactcctacga

SEQ ID NO: 142886 - DNA, 601 bp, Human
ctgctcccaattgggctggttctctagtgtggctctgtaggtaaacggcccagtggtaagtgggcttctggccatatgtgggcccatacccacccccaacatccagcacaccctccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttctttcctgagatggagtctcgctctgtcatccaggctggaatgcagtggcgccatctcggctcactgcaacctccacctcccgggttcaagcgattctcctgcttcagcctcctgagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccagcctttctacacatt

SEQ ID NO: 142887 - DNA, 601 bp, Human
aagcctcaactgaactgctcccaattgggctggttctctagtgtggctctgtaggtaaacggcccagtggtaagtgggcttctggccatatgtgggcccatacccacccccaacatccagcacaccctccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttttttcctgagatggagtctcgctctgtcatccaggctggaatgcagtggcgccatctcggctcactgcaacctccacctcccgggttcaagcgattctcctgcttcagcctcctgagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccag

SEQ ID NO: 142888 - DNA, 601 bp, Human
tccttaaaagttaccattcgctatcaggaacatcttctaaaagaacagcattgaccagaaccaagagattcagtcttgagtcaatacgttcatggcaagccaagccttttttcaaagaaatgtgggtttctcctttcttccgaagggctttcctcccaggccgggccccagctatctctaaagctcctttcaaacaccaccatctactgacccccactcttactccttctcttagaaggtaccaagcaccaccaggctgctaatgtttaaaagaacacagaaaaagacaatatgcatcacrcctgggcatagcacctgacagcctttataagtggtagctatcacgatcattactgagcaaaaatgcgcctgtttacaaaagttaacagcctaaggttatataacagcttgatttcaagctttgagccaaagtctgattaagaagaatatacatccgttgaattaaaagcctccacttcttgactcaacgggttaagaaaatatttttaacactttcagtgagtttaaaaaatcagatgtttaccagccattgtttttgcgcacactgtcttttatctcagcatgaatgttttataagcac

SEQ ID NO: 142889 - DNA, 601 bp, Human
ccaggagtctgagaccagcccgggcaacaaggtgaaaccccatcactaccaaaagttaaaaaaaaaaaaaaaaaaacagctgggtgcagtggtgtgcgcctgtagtcccagctacttgattgcttgagaccagggaggtcaaggctgcaatgagctgtgatcgcaccactgtactctagcttgggccacagagtgagaccttgtctcaaaaaaagtcagttttgttagggaataatattatgtttacataagaaaatgatgaagcagcatgatatcgttggcttcaaaatatttcagcaayggacaaaaaagacggaacaaatctagccaaaagttcattgttaagtcaaggtgatagaactatggaagggttcattatatcattctttctacttttatacagtaattttttttttccttaaaagttaccattcgctatcaggaacatcttctaaaagaacagcattgaccagaaccaagagattcagtcttgagtcaatacgttcatggcaagccaagccttttttcaaagaaatgtgggtttctcctttcttccgaagggctttcctcccaggccgggccccagctatctctaaagctc

SEQ ID NO: 142890 - DNA, 601 bp, Human
gcagttaagatccctccaactgtttgcctgccaaatattgctttgcttacctaaggcctatggaaaaaacagcaaggagctcctcaaaaagacaagttctatgaaaaacaccaccagccaggtggctctccagacctccacaggccatttcgccataggaaagatggatcacagaagaaccagggcacagtccgaaattaacactgctccccacaactcttcactgttaaaatggaaattttacatggaccagtgatggcaatgtgtccaaccaaaatctctcaggaagcttttattgagyacctaatctgtgcctcaacaaagcaaagaatatataagacatggaccccgaaatcaatgcgcttacagactaggtgatggccccataagaatacctagcacacagttatttattgatcctgtttacaatatacaatacaacatcatagcataaattgaggcccgggcaaaagaagaaagaaaaaacaaaactggaggaaattttgaaccaaaaaaatcaagcttaaaatgcatgtaagaataacctacacactgagtcaaatttggctctaagctttctaaaagtcaagaggataaaggc

SEQ ID NO: 142891 - DNA, 601 bp, Human
cccaggaccccttcccccactccctgaccgaggtctcgccttcctctgggctaagtccacactgcccagaggattggaagtgctctcctcccagaaaaataaaagaccagcgccacgctgctggcctaggagagcatcggccgggggtgggagacatcgttggactctgaaccaacaaggcacctcggtgcttctctatggattacagcaaagtcttccagggatgcagaataaacatccttacaaccaatctccacagccccttgggatccccttccaaatgtcaacaaacaagaaaagrggaggccactatacaacagttgtaaagatgtcctccagccagtcatagagatgatcctgaaggcacttaccatttattgagtgcctactatgtgccaggcactgtgctaggtgcttaccatgcccagactctggtcctcacctaaccctctaggacagatgttcttctccctctctctcctggatagatgaagaggcagaggtctaggaaggtaaaggagagaaccagttggtaccaacaccttcctgagggtcaggccaaactctcacaagcagcaaaggaaagctgagtgtcaacagg

SEQ ID NO: 142892 - DNA, 601 bp, Human
ctcacacgcctgatgagattattttaccggaactgacacagctggaagcagcaggcatacgtggagcctctgaggaggtgatgcaatttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaagtgctctcctcccagaaaaataaaagaccagcgccacrctgctggcctaggagagcatcggccgggggtgggagacatcgttggactctgaaccaacaaggcacctcggtgcttctctatggattacagcaaagtcttccagggatgcagaataaacatccttacaaccaatctccacagccccttgggatccccttccaaatgtcaacaaacaagaaaagaggaggccactatacaacagttgtaaagatgtcctccagccagtcatagagatgatcctgaaggcacttaccatttattgagtgcctactatgtgccaggcactgtgctaggtgctt

SEQ ID NO: 142893 - DNA, 601 bp, Human
ctcctgacctcaggtgacctgcccgcctcatcctcccagagtgctgggattacaggcgtgagccaccgcacccagcctgggattttttttctttctaaggaactctttcccgagcattcacgacccagccctttctgctctgggatggaaagtgttactcagctacaaggcctcttgttaattgtgggtttttatttttatttcctattaccctctcacacgcctgatgagattattttaccggaactgacacagctggaagcagcaggcatacgtggagcctctgaggaggtgatgcaayttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaagtgctctcctcccagaaaaataaaagaccagcgccacgctgctggcctaggagagcatcggccgggggtgggagacatcgttggactctgaaccaacaaggcacctcggtgcttctctatggat

SEQ ID NO: 142894 - DNA, 601 bp, Human
agcaactctcctgcctcagcctcctgagtagctgggaccacaggcgcacaccaccatgcccagctaatttttgtatttttagtagaaacggggtttcaccatgttggccaggatggtctcaaactcctgacctcaggtgacctgcccgcctcatcctcccagagtgctgggattacaggcgtgagccaccgcacccagcctgggattttttttctttctaaggaactctttcccgagcattcacgacccagccctttctgctctgggatggaaagtgttactcagctacaaggcctcttgytaattgtgggtttttatttttatttcctattaccctctcacacgcctgatgagattattttaccggaactgacacagctggaagcagcaggcatacgtggagcctctgaggaggtgatgcaatttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaag

SEQ ID NO: 142895 - DNA, 601 bp, Human
acgtgaccagtgtccatttatagggtcgcatgctcacgacacatgctgcattatggggaatgctgcagagaggggagtcttattcttaaaggagttagaattgaagcataaagtctaggaactaacatgaaccacctcttagaagtctatgtacaacctgcactcgactttgagttgttccccaactattagttccctgtcgtgggtcagtggggggaaaaaaaatcactctccacacagctcttgaggagaggctgggatctctacgattcacttggtgtctacctgcaggggactcagrgaaaaaaaaagcaaaagccacaccagcatgagcatatcacacagaaattctactgaccccaaaagcggggcaatgaaaatctgtgcacaatttcaaaccatgcaccccagggtggaggggagagatggaattcaggggaagtgagaagaaaaaggggaagaagaaaaggaccagggattttttttcttttttcttttttttttgagacagagtctcactcttgttgcccaggctggagtgcagtggcacgatctcggctcactgcaacctccgcctcccaggttcaagcaactctcctgc

SEQ ID NO: 142896 - DNA, 601 bp, Human
atcatgaaacgtgatcacatgtccccttcttcatggccccttctccatcccacatggtaattacaaagcccattatttgcactgttacttttaatcaagaaatccatattgagacatacttaccactggccacttcaaagagcggccctgatagttagctaaaataacaaaggaaaatttcttcttgaagtgtaaggatccaagagctcacacttccttaaccttccagaagccacccagagaaccaagtgactgtgggcaataattacaccctcaccaactcagcaaaaatggcacagayggtctttctcctcttgctgctcccaatgctgcgtttgggtcaacagctgctaagaagaaccaccaaggccacgttaaatagtacttggattaattatgcttgaaaatctcttatctgagcactgctaagacagaacaattgagtttgggaatgagtgtggttacatatttttccttaatggcttcctgaacaccctggttaggtctggtcccaggggagaaattgccagctcaagtcataaaatgtgatcaatgtagatcaagaccctgtgctaagtgtctaggatgaaagaggggaagc

SEQ ID NO: 142897 - DNA, 601 bp, Human
ccctttgggatgtgcgtactaagcttccacccaacttcctatctggtggaggcatgctatgcacagagaccccatcactgaattccctcctagataactcactgcactagactgaaggcttgagaggtttatttcatcatgagtagtcctcaaatcctagaggcccagagagttgctcctatctcgattctctttcttagggtaaagtgaaccggcagcaagaactaccaccaggacgcaagggctttgagacagactgaagggggcatggattctgctggcactctgagtttgtttgaawgacttccaaattccaaagcttaaaaccctatcagggccaggtgtggtggctcatacctgtaatcccagcactttgggaggccgaggtgggcggatcactggaggtcaggagttcaagacaagcctggccaacatagtgaaacaccctctatactaaaaatacaaaacttagccgggcatggtggcaggcgcctgtgatcccagctaactcaggaggctgaggcagcagaatcacttgaacccgggaggcagaagttgcagtgagctgatcgtgccactgcactccagtctggaagacaga

SEQ ID NO: 142898 - DNA, 601 bp, Human
attcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggagaaacccactaaaaatacaaaaattagccaggcrtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaaaaatcaggtatgaactacatgcaagtgaacccctgggttcccgcttcctgggaagggctatcaaagccgggttcactagtttaatagaaagatgagtctactatggttcctaagttcctattaggtagctct

SEQ ID NO: 142899 - DNA, 601 bp, Human
attcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggwgaaacccactaaaaatacaaaaattagccaggcgtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaaaaatcaggtatgaactacatgcaagtgaacccctgggttcccgcttcctgggaagggctatcaaagccgggttcactagtttaatagaaagatgagtc

SEQ ID NO: 142900 - DNA, 601 bp, Human
catccttccccatccaagaaacaactaccaaaacacattcaaactgaaactctccagagcggtttcaaatcaccccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccrggcatggtggctcacacttgtaatcccagcactttgggaggccaaggcgggtggatcatctgaagtcaggagttcaagactagcctggccaacatggagaaacccactaaaaatacaaaaattagccaggcgtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaa

SEQ ID NO: 142901 - DNA, 601 bp, Human
aaaaagggatttggggcaatttaaacagctatagtaactgtatctcacacttgagtacgtaagtctctaccctgagtcacgtggaggcctttccaccatttccagaacaagaaagacaagcatcgtgtgcccatgactggcttgactggtgctcctgacttggatttaattaccatagagcacggatcccctcccggatttgcagcagaacctcctttcaccaaataccattgctttacctgactgtaccaacccacctctcctaccttgcaagcccgcagctcacaaccccaaccttcayccatcttctggcactttcccggctaaaccggacaccttctgacactaaccataaccaacacttatgtgtttcctttgccagcactcaaggctttttcatctcctcccaatttcctcaaagtccctctccaagatcctatttctactctctctccactcttgctattgggattatagggcaaaagctaggagacaatgtaaaaacgtgccatctggcccattacagtttcaatctggcatgtcatgatgtcaaatttatgttaaatcatgtcttatgattaaagttgtgggagttcattat

SEQ ID NO: 142902 - DNA, 601 bp, Human
tgtaaacatactcagagttcaaccaccatgaatcaaaaccaaacccatgaatataataataaaaagcaagacaaaccagctattatttatgctctgccttgttctaaaaagggatttggggcaatttaaacagctatagtaactgtatctcacacttgagtacgtaagtctctaccctgagtcacgtggaggcctttccaccatttccagaacaagaaagacaagcatcgtgtgcccatgactggcttgactggtgctcctgacttggatttaattaccatagagcacggatcccctccckgatttgcagcagaacctcctttcaccaaataccattgctttacctgactgtaccaacccacctctcctaccttgcaagcccgcagctcacaaccccaaccttcacccatcttctggcactttcccggctaaaccggacaccttctgacactaaccataaccaacacttatgtgtttcctttgccagcactcaaggctttttcatctcctcccaatttcctcaaagtccctctccaagatcctatttctactctctctccactcttgctattgggattatagggcaaaagctaggagacaa

SEQ ID NO: 142903 - DNA, 601 bp, Human
gagaactccagcagcccccagagtgtgagcattgttaaatccaggctaaaacatatcagagagaaaaacacactacactgaagcaactatcccctcactaaccccacctccttaaaaaaacaaaaacagaaaaacaaaggcaacccagattccaagagaaggtgaaacctccttcaagggtcaaagaaataatacctgcatctgtttagcttggaatccactgaagaaccatacccagttcccttctgtgtttttttacaataacagtgtttgtctactgctgctgcacagaagtcaataygtgttaagccatacataggtgattccatctgcttggtagcaatttcccagcagccttcaggattgctctgcaagtgtggccaggtcggagaacacacaggtgcttgaacaggcgccttgtgctgccggacgcccactgcccagaaggcccagagaatcgcccaggccgtgggcctccatgtttgctaataagtgcatctgtgctatttccagcatgaacataaatcagcctagaagtgaaaactgctagctcagcccattctgcagggaatccacaaccaccatgatattctggttacag

SEQ ID NO: 142904 - DNA, 601 bp, Human
gtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgtaagttcttcatagttttcaaacagattcaagttgctggaaaagaattttaggggtgggatgatcctgaggaattrgcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgccattattttaagcgtcaacacagaggtccgtgtgtctcgggacacgccaacaaggctctgtcttgtccctatttggctgactgaaatcaacag

SEQ ID NO: 142905 - DNA, 601 bp, Human
caaaaggcaggttccagaacctacagatcaggaaacatattcattcgttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgyaagttcttcatagttttcaaacagattcaagttgctggaaaagaattttaggggtgggatgatcctgaggaattagcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgccattattttaagcgtcaa

SEQ ID NO: 142906 - DNA, 601 bp, Human
tgatttttaaagaaggacaaaaggcaggttccagaacctacagatcaggaaacatattcattcgttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgytgtaaagcatatactgtaagttcttcatagttttcaaacagattcaagttgctggaaaagaattttaggggtgggatgatcctgaggaattagcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgcc

SEQ ID NO: 142907 - DNA, 601 bp, Human
cattcacactcagtctttaagcacccagggactgtcctaaggtgatgggatcccaggactgctcatgcaaaagaacgctggcatctcacccaaacgcccttttcttgcttgagagtgatgggggtgaggggaacagttcaaagcagactgatttgcttggatatctttaggcagacaagagaggataaaggaggtaggagaagctgctgcaaagaactgaaatgtaggtccaatatcctgatttttaaagaaggacaaaaggcaggttccagaacctacagatcaggaaacatattcattygttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgtaagttcttcatagttttcaaacagattcaagttgctggaaaagaa

SEQ ID NO: 142908 - DNA, 601 bp, Human
ctgggtgacaaaatgagacttggtctatttaaaaaaaaaaaaaaggaaaaaaattgaaaaccatcatactggaagtcatcacttaatgagttaggtgttgtgttaagacccatgggtacagcatcactttgatcctcatacccacactaggagatagatactatttttatccccattttagaaatgggaaaactgaggtggcccagttatgcagcctaactgacaaaccggagagtatgggtgtggagtctatgctttcaggcagttttcctttgtcacccaggctggagtgcagtggtgygatctcagctcactgcaacctctgcctcttgggctcaagcgattctcctgcctcaccctcctgagtagctgggcctacaggcgaccaccaccacgtctggctaactttttgtagttttagtatagatggggtttcaccatgttggccaggctggtctcaaactcctgagctcaggcaatctgcccgcctcggcctcccaaagtgctgggattacaggcgtgagccaccgcacctggcctgtttttctttaatgtctaattttcaaaagagaacactagaacatccctacatctcacattc

SEQ ID NO: 142909 - DNA, 601 bp, Human
aactatttataagcatgggaaaatgatcatacagatgctaaatgaacacagcacatataggtattatggagaggaaaacaggagagacttatattacaatttttacaactgtgaattctagggaatgaggtataggtgacttcatttcctcctatgtgcctttatttcccaaagctctttaaaattaaaaccatcattgagacagtaggattgctagagcccaggagttcaaggctgcagtgagctacgatcgggccactgcattccagcctgggtgacaaaatgagacttggtctatttaaaaaaaaaaaaaaggaaaaaaattgaaaaccatcatactggaagtcatcacttaatgagttaggtgttgtgttaagacccatgggtacagcatcactttgatcctcatacccacactaggagatagatactatttttatccccattttagaaatgggaaaactgaggtggcccagttatgcagcctaactgacaaaccggagagtatgggtgtggagtctatgctttcaggcagttttcctttgtcacccaggctggagtgcagtggtgtgatctcagctcactgcaacctctgcctctt

SEQ ID NO: 142910 - DNA, 601 bp, Human
ctgctcatcttccaagctcccttggaaccacctgtaaagcccactgcatctttgcaaatgtcaatctttacttttcaaagattgtttaaaaggataaaactctaccctgttaccctgtatctccctattaatcaaaacgttcatctccctctttaaaaacatgtgctgatgacagttttatcctgttcccttgaggcagaactgggtaaaatgcaacagtttcagggaagctggggtgggaggggtgcagttatgacgaaggggagggggctcctgctgttgctccagctcccggagaatkaaacatgaacagtcgcactgtgtaattttaaattgttaattagcacagggttaattaggcagtcctttcacaagaggctgtctggtaggaaaccaagaagggaaacaaaggggaagggaggaaaaacaaagagagaatagaggcagtgagaaactgttgcctccaagaatatcccatgcgggatcactcaagagacatcagccagcaggcaaggatgcctgattccctgggtgatcccctgctctgccggagggagaagcagtgaataccgccttcctacaggcgaccaggcagcataca

SEQ ID NO: 142911 - DNA, 601 bp, Human
ctgagccgggatacaggtgagactgcagggcggctcttcttagggatgcttctgattggctggatgacatctgattgatagcttgggccaaaaaggttggcaggcctgaaggggcgggagggttaacagcccgactgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcrtttaccaattaattggtgggcttctcttgctccgttctcctcttattcctcctcctcttccacaaactatccagccaagaggctgggacttttaaaacctcccttactttgttttctactccaaagcggaagatgtcaggaaagaatgacactgtacccacctatgatggtggctggtgaccctgtggtggtgacactagagcccacccattcacggggagcagcagccatgaggacacgggtcggagaggaggaacccactgcaggacccaagctacctcccctgggcctcctttccat

SEQ ID NO: 142912 - DNA, 601 bp, Human
tctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagccgggatacaggtgagactgcagggcggctcttcttagggatgcttctgattggctggatgacatctgattgatagcttgggccaaaaaggttggcaggcctgaaggggcgggagggttaacagcccgaytgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcgtttaccaattaattggtgggcttctcttgctccgttctcctcttattcctcctcctcttccacaaactatccagccaagaggctgggacttttaaaacctcccttactttgttttctactccaaagcggaagat

SEQ ID NO: 142913 - DNA, 601 bp, Human
gagacaacagctccccctcgggaaaaactggggaaggcaggtttaccagaagtctcagggagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagycgggatacaggtgagactgcagggcggctcttcttagggatgcttctgattggctggatgacatctgattgatagcttgggccaaaaaggttggcaggcctgaaggggcgggagggttaacagcccgactgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcgtttac

SEQ ID NO: 142914 - DNA, 601 bp, Human
tctggccctgctcctacaggcagctcagcacctcgcagagccctgatcctttgcccgtaggtccccagccaccattcccctgctgctcctcctggagaacatgtggctgctcctccacccaccatctcattcacactcagccggtgaaggtttcggccaggtttgatctcacttccctccctgacagcccctatcttctcaatcttttttttttttcatttcttgattattgactgcacaatgagacaacagctccccctcgggaaaaactggggaaggcaggtttaccagaagtctcagrgagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagccgggatacaggtgagactgcagggcggctcttcttagggatgcttctgattggctgga

SEQ ID NO: 142915 - DNA, 601 bp, Human
atgtgccctctgagacctcatgtccctggggagggaggcatcggatcacggccgctctgctcctgcagtaatatcatcgcaggggcgatcattccgtctggccctgctcctacaggcagctcagcacctcgcagagccctgatcctttgcccgtaggtccccagccaccattcccctgctgctcctcctggagaacatgtggctgctcctccacccaccatctcattcacactcagccggtgaaggtttcggccaggtttgatctcacttccctccctgacagcccctatcttctcaatcttttttttttttcatttcttgattattgactgcacaatgagacaacagctccccctcgggaaaaactggggaaggcaggtttaccagaagtctcagggagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaacca

SEQ ID NO: 142916 - DNA, 601 bp, Human
taccgagctggtgagcccgccaaggttcaacagggtgctgggggtcaagagaccagcctggggctgctcggggccagcggcggagcccgctgggagagcttcctccccttccattcgaatgccactaaatttaccataaaaactgtgtccggggcctatgaggttagctgtggaaactaaagggtgttgaaagtttttgttttttggttccagaaaacttacaaggggttccttgtctttgccgatcccttggatgatagcggagatgttcttattgctaagaattttccgctcgtcttcsctcagggtcattcgatggtcatgcaccgcgtgggtcacaaacgaacggacgtacccaaaggagagtttgcacaagaaacacatcaggatgggcttcctcttgccatagagcacaaagccatcgaatttggacaggtccacattgttgggaacatctttggatacgcaggagcttttggcagaaccgtcgctgttcaggtaatccttgttgcttttgtgtcgcacgtcaaacacgcggaagctgtgcaggacggggctgagccccgccagggctgaggtattcgggaaagcctggtctggg

SEQ ID NO: 142917 - DNA, 601 bp, Human
gggatccagctggaatccgctcatcatgaactgggcgtccgaggcagcactgtccatcttcaggttgggcaggttcatgttctgggccaggtagtattggtagagctcggcctcggcgggtgagggcaggctgccgaggcccaggtggcggttgtgttggatctgggtcatgttctgttgcagtaacatcatgttatgcatgtgcttctcactggtcatgtgaatgcggaggttcctggccacgttggtctcataatcacacacctcgcaccgccaggtgggtttggtttttggtttggtsggcgagggggccccgcaggagctactgatattggctgccgccgccgccgcagccaccgccgccgccgccgccccggcagtgtggctgaagacctgctccccccctccattctgcaggttctgcatgttgttgagatgcttgtcagactgcatatgaatactgaggttgcctttggtagttgtggagtagttacacacctcgcagcggaaaggcttgtaaccacacgtgtagctctcgcctcgtgccagccgggggtggggctgcccgcttttgcagtagacacaggagccccccggctcc

SEQ ID NO: 142918 - DNA, 601 bp, Human
cccaaagttttaggtgattatagtgatttttcaaattgaaagaagagacagagaaagagagaatgggaacagaaaactagaggaaacactcacattttaatcctggccccacgtagccagagtacaagcatatctcttttgaatgcataaactcttccatatgtacacacacagttcaagggattcttgagaatacttgattgtaagacactccagtttacacaaaaaccactcgagaagaccagagtcaactgaatccacaggactatctcaccctattcaccattctccctggttaaaytcctatcatgaaaacagacaaacacgtagtcatcctcacctagagcaggcgtcatggcggccatgggcccggcgggatccagctggaatccgctcatcatgaactgggcgtccgaggcagcactgtccatcttcaggttgggcaggttcatgttctgggccaggtagtattggtagagctcggcctcggcgggtgagggcaggctgccgaggcccaggtggcggttgtgttggatctgggtcatgttctgttgcagtaacatcatgttatgcatgtgcttctcactggtcatgtgaatgc

SEQ ID NO: 142919 - DNA, 601 bp, Human
tttcatctctcacacccctcacaacagtgccactggggcaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacactgtggttccgaattcctattattaagatgattgtctctacttaaatcattgaggtaactgtccctagtcctcttattgaratgattgcctcagctacagtttcctgtaagtttcagtaaatattcgatgaaaccccaaagttttaggtgattatagtgatttttcaaattgaaagaagagacagagaaagagagaatgggaacagaaaactagaggaaacactcacattttaatcctggccccacgtagccagagtacaagcatatctcttttgaatgcataaactcttccatatgtacacacacagttcaagggattcttgagaatacttgattgtaagacactccagtttacacaaaaaccactcgagaagaccagag

SEQ ID NO: 142920 - DNA, 601 bp, Human
ttttagcacccaaatcctacactcttgttcctattctagatattgtaagccaattggtaagactgggagcctgaacagagccaaatcagcttctctaaagcagaggtcattcttcctggcaacgaaggctccgctaaccaggatctaactgctattaaaagttaactttccttgatggacaatttttacaacttactcatttttcatctctcacacccctcacaacagtgccactggggcaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacactgtggttccgaattcctattattaagatgattgtctctacttaaatcattgaggtaactgtccctagtcctcttattgaaatgattgcctcagctacagtttcctgtaagtttcagtaaatattcgatgaaaccccaaagttttaggtgattatagtgatttttcaaattgaaagaaga

SEQ ID NO: 142921 - DNA, 601 bp, Human
aagtccattagcagcgtcacgggatgggacgcaggcaggatcctgtttgaagcataccgggtggaggcacgagtggcccaactatcagaaggttctcatgaaacccatctgtagattgttttggcagcagcagctatcctcaaagtggctgtggttcgttctacgtaaaaactcaaagtttttagcacccaaatcctacactcttgttcctattctagatattgtaagccaattggtaagactgggagcctgaacagagccaaatcagcttctctaaagcagaggtcattcttcctggcarcgaaggctccgctaaccaggatctaactgctattaaaagttaactttccttgatggacaatttttacaacttactcatttttcatctctcacacccctcacaacagtgccactggggcaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacac

SEQ ID NO: 142922 - DNA, 601 bp, Human
aaagtcctcactgacactctgttgccaagaacaacctattcccatgtcaataatggcatattgcttaattcaggccattgtcactggtcccacgaagtccattagcagcgtcacgggatgggacgcaggcaggatcctgtttgaagcataccgggtggaggcacgagtggcccaactatcagaaggttctcatgaaacccatctgtagattgttttggcagcagcagctatcctcaaagtggctgtggttcgttctacgtaaaaactcaaagtttttagcacccaaatcctacactcttgktcctattctagatattgtaagccaattggtaagactgggagcctgaacagagccaaatcagcttctctaaagcagaggtcattcttcctggcaacgaaggctccgctaaccaggatctaactgctattaaaagttaactttccttgatggacaatttttacaacttactcatttttcatctctcacacccctcacaacagtgccactggggcaatttaattcccaattaatttccaactattctaatcaccaagtactcatcaaaaataagcaaaaaaaaaaacatctctttcattgagg

SEQ ID NO: 142923 - DNA, 601 bp, Human
ttagaatccaagtcagtggctcatcagagaaaatatttttttcttttttttatgattttcttattgacgctacacaagtcacctcgagtgataagatcagtacaggttctgctaagcagaccagcagctgcgtttgaagctcacggacagtctagcaagccacagaaatcttttgcacatgcattccagaaggcttaggaagctttcggcttgttgtctgtcttcccatctcccctggtgagaggaaccataactatgtcattctttttaggataagaaagaaaaacagaaaggaaaaagaaaaaaaaaaaaagcctaaaagctccatcccttaacggggacgaaggccaggcaacatccaggaaacatactcagtgttcagtcaaagcagaaactgcccggagggtaagacaaggagcaaacatatatttgtttctgatgccaaccacctgaagcatcaaatcgtctccactttttagatttcaccccggcacatcaacatcgctctaaagagaaattcagctgtcacttgctgatgcctgagtgaaaatgagaagtccttggaataagcagaggaacgaagtcccagtttccactttaa

SEQ ID NO: 142924 - DNA, 601 bp, Human
gaacaatctatggctgtgtcatctggtgcagcagtcactggctacctgtgactaataaatacctgaaatatgggtagtgcaactacggaactgaattttcaatgttatttaaatttaggaagctacatggtggtgagtggcgcctgggttggatagtgcatctctaaagcaaagatctggggagtggggctggacgtggtgtctcacacccctaatccaagcactttaggaggccaaggcaggcagatcacctgagcttaggagctcaagaccagtctgagcaacatggtgtacaaaatayacaaaagaaactagccaggcatggtggcgtgtgcctgtagttccagtactcagggactgagatggaaggatggcttgagcctgagaggcagaggctgcagtgagctgagaccatgccactcagctcagccctggtgacagagcaggaccctgtctcaaaaacaaaacaaaacaaaaaaagacttggagagtaatccctctactcctcactgctgccctctggtcaatatccctcccgtcagtcaatgctgccaaccctcccatgtcttctcagtagggctacctgttctctttcctgatc

SEQ ID NO: 142925 - DNA, 601 bp, Human
cctcccaagtagctgggattacaggcacccaccaccacggccagctaatttttgtcttttttagtagagacagggtttcatcatgttggtcaggctggtgttgaactcctgacctcagctgatccaactgcctcggccacccaaagtgctagaatgacaggcatgagccaccgcgcccagccacctctttaatatttcaattcatcccttctctgagatccaagaaaagacagaaatatgtatcattcactggatataacagaatctcaaactgcagaccttccaaaattggaaatgagtyacagctgcaatcgtaacataccaagccttcatggggaaccagaattgggcccagaatgtatctgaggtggcagtgaccaacatgactttctgccaccttgagaacaatctatggctgtgtcatctggtgcagcagtcactggctacctgtgactaataaatacctgaaatatgggtagtgcaactacggaactgaattttcaatgttatttaaatttaggaagctacatggtggtgagtggcgcctgggttggatagtgcatctctaaagcaaagatctggggagtggggctggacgtgg

SEQ ID NO: 142926 - DNA, 601 bp, Human
aacctgatgtgtttcaatctttcctgcggacattctgagatttctggcaggttttgtattttctttctttaggaaaagaacacctagaaaagttaggagccatagcctctttaatatttccttttctttttttttttcccgagatggagtcttgccctgttgcccaggctagagtgcagtggcacaatctcagctcacggcaacctctgcctcccgggttcaagcgattctcctgcctcagcctcccaagtagctgggattacaggcacccaccaccacggccagctaatttttgtctttyttagtagagacagggtttcatcatgttggtcaggctggtgttgaactcctgacctcagctgatccaactgcctcggccacccaaagtgctagaatgacaggcatgagccaccgcgcccagccacctctttaatatttcaattcatcccttctctgagatccaagaaaagacagaaatatgtatcattcactggatataacagaatctcaaactgcagaccttccaaaattggaaatgagtcacagctgcaatcgtaacataccaagccttcatggggaaccagaattgggcccagaatgt

SEQ ID NO: 142927 - DNA, 601 bp, Human
agggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggagcatccgggaaaggagaaatagaaaaaaaaaaaaggaataaagagatggaaaaggagaacagaaagcctaaaggagagagggaaaccacaggagcagaggatgcaaaagagcccatgtaagaaagaaaagaaccaaccctagaggcgctgtc

SEQ ID NO: 142928 - DNA, 601 bp, Human
taagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaamacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggagcatccgggaa

SEQ ID NO: 142929 - DNA, 601 bp, Human
ggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggag

SEQ ID NO: 142930 - DNA, 601 bp, Human
attatgggatgattagagaaaaaggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaaccsaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaag

SEQ ID NO: 142931 - DNA, 601 bp, Human
gttaactgtgctctaaactgattatgcatgtgccgggctaatggattacattagcaagaggaaaaataacatgcaatcaatctccatttactacaggccacaccagggcctagagaaaaagtgactctcaaaccacctccaatccccaccccaaatccgtggaatgacgaaaccttgagagggagccttccttagtggcaagagaagtttgatcttagtcgtactgagggaccaaagggctgagggcgagcactggaatgacaatcccagcggtgtcatccaggagtgagcgggagagctccccgccccctgtggcgaagcccgggcaggcacagggccattcattacccaaggactaatgagactagactaatgacctttggctcctgacggaggcaattctgccctgaacctcaggctggtcactccggggatgtgccggccagatgcaccatttcaggatctctccttcaggtgctgggtccacgttctaccctgcatcccaacgctcaggacccttctacccacgccatctttttgagcaacagtttcctctaccttaaaaaaagaaatgagaaaaaagtcccaggatgacaggcca

SEQ ID NO: 142932 - DNA, 601 bp, Human
gatcccaagacggtaaatgttaggacgtggacatgtgagcattaggggctaggccagagccggccactgtttcaacccaaaagatcccaaggatttcaatcaggagcactttgcagaagtaacctgaggcccagagacaaggtaagggggcttcccccggatgcctcgggccctgcggcattcccctactccactctacttccaggaggtgcaaaagaaaaacaggttgaacctaatcctgatttaaacattagtatcacacaaaaatcaaaacgacaccattccaggcaacgaagacaayatcatcaggttttgtagattagcacaaccctctctcatttctggattaaaaattatctcacgctttcagaaagttcactcttacagcaatctacgcactagcatgcgtgacagcaagggcagtgactccggcccagggtgaggtcagatgacacaccgaaagccatgccactgcttgaatctcctgagaatgcagctctgtctcctccaacatgaaaaaggaacaggaggagaataaaagcctcggctgaaagagaggtctgggagggccaccgggaagccacatacatcactgccactt

SEQ ID NO: 142933 - DNA, 601 bp, Human
agcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaaccatcaagccatggaaatgaaccgcaggcctccagctgctycaggagaaggagggcatgcaggcgaaatctgctaaaattcaccaaaacatctggccttgcacaccttctaaatcacctgcaggaaaacattcctttcctttcattttttggttgaaggcatcaaggtagggagagaaggtggcagaagtatgtacttaaaacaaacaaaaaaaatagtctaataatgagaaaacaaggtttgaggcaactggctccagaatcccgacgcaaaccatatgacactttcaccggagcttcaaacacacagccaagctgggaaggcaggacgggagggaggaa

SEQ ID NO: 142934 - DNA, 601 bp, Human
tggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaaccatcaagccayggaaatgaaccgcaggcctccagctgctccaggagaaggagggcatgcaggcgaaatctgctaaaattcaccaaaacatctggccttgcacaccttctaaatcacctgcaggaaaacattcctttcctttcattttttggttgaaggcatcaaggtagggagagaaggtggcagaagtatgtacttaaaacaaacaaaaaaaatagtctaataatgagaaaacaaggtttgaggcaactggctccagaatcccgacgcaaaccatatgacactttcaccggagcttcaaacacacagcca

SEQ ID NO: 142935 - DNA, 601 bp, Human
actaaaagcatttagaaaaaagagaataaaagtgctatggttaatggttgcaaaactggtttttcaacaggtggtttttaagtactaaacttttttttttcaataggcacaactaataagatttcagttccattatgtggtgtctaaagagtggagtgaaaagatatcactgacctgatcttcttgacatgagggtgtgtaaaatgctctaaccagagtgacccacacaaagcttgtgcctaaagccatcggctgagagtgtgaaatacaacctattggacgaatgtggatgaagataggygggaagcttctggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaac

SEQ ID NO: 142936 - DNA, 601 bp, Human
aagagagagagaaaaaaaacactaaaagcatttagaaaaaagagaataaaagtgctatggttaatggttgcaaaactggtttttcaacaggtggtttttaagtactaaacttttttttttcaataggcacaactaataagatttcagttccattatgtggtgtctaaagagtggagtgaaaagatatcactgacctgatcttcttgacatgagggtgtgtaaaatgctctaaccagagtgacccacacaaagcttgtgcctaaagccatcggctgagagtgtgaaatacaacctattggasgaatgtggatgaagataggtgggaagcttctggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacc

SEQ ID NO: 142937 - DNA, 601 bp, Human
ttttttaagataaatggtgagatccacagtctccattaaggtgccctaaaaacccagctcctctttgcagactctgtttcttctggaaactctctcatcctggagagttcaatgaaggcaaactaatctaagaaattttcttttggggaacatgccagagagaaataggaaaaggtgagaggaaggcgtttggtccacagactccaaatgccaggaaagagagccaggcctttccatcccttcttcttgttccccagtgtctccgaagacagtattccgtaaatatgttctgatttacctmaatctgtggatcattcacaagaggttctgcaagacgtaagagaatggagaatgagaaacagcttttcacaccagctaggaaaggctggttatttaagcaatcgttgtacagctagccattgaatttgaaggaaaataaagagtcctaaatcacactgcatagtcttacaactatacaaaaaatatattcctgaaaagtcacaaatagggccaggcgtgggggctcacacctgtaatctcggcactctaggaggccaaggtgggtggatcacccaagttcaggagtttgagaccagcctgg

SEQ ID NO: 142938 - DNA, 601 bp, Human
ttctttgctgtatttgccaacaccatcccaagtcaccaccctaatgttgctagtttctacagtcgccagtatttctatgagtgacagattttctgccattagaaaattttaactttcattctacatcccggctgctgtaagtgctaaaaatcaatttctgttaagtattaaatatatacttactcaatactaccgaaatggttttcatagtaacagcctttcccaccctacacttactagtatttacagtttcaactgatgtgtaaaacagaataaagtacatggttcaggtggatcatayaattatttaaaaactcttgccttttcctgactatgttcctgacaatgcctaattgttcccttatgatttccctttcaaaacaaaaaaaccagaaacacctgttgggactagacgtattcaaatctgccctttgagtccaagtcctcagcaagttgaaagaattcaacattgagttcacacctttgccccattatgtggcacctgccatattggctttcctgccagagtgtgtttacctaaaacaaccgtaacacaacgcattatcctggaatgcagaagcaacggaatatttgcacaaaa

SEQ ID NO: 142939 - DNA, 601 bp, Human
caaaatcctacttcaatggccagcacaaaatcagtactccacaaatgttgttgacccagggaacgaagaccccttcccagtgatttcagtctcccagaagctgcacagggaaatctgggaaatcctgtgcctcttgggtcctgagggctggggtctgaacccatgggaggagaagaagtcagggtagccaatgcaaggatgccttccacccagaacccagacttctgtctcattctgaggggcagcaggaagacacggatgccccggtgtgacacgtgccaccaagaaaactccacagagrtcagctcagaaggggttagaaaggtccagtcatcctccaggaagagcatactgccagcgacagaagacaggaagagagactcaaaaggaacagcaggtgggtgtaaaccccttcagcaaccccagtgcacaggccggccctgccaaggcaatgtgggtatcactgttgacctaagagactggctatgctttggaggctctcatcctgagtccgggaacatgctccactcattaacaggttacaaaccaaacactatcagtagataaacatttctaaccttctaactagtttgccttttac

SEQ ID NO: 142940 - DNA, 601 bp, Human
ctgtaattccaatactttaggaggctgaggcaggaggatcacttgaggtcaggagttcgagaccagcctggccaacatggtaaaaccccgtgtctgttaaaaatacaaaaaaagttagccgggcctggtggcgggcgcctgtaatcccagctacttgggaggctgaggcaggagaatcacttgaacccgggaggcgaagcttgcactgagctgagatcacaccattgcattcctgcctgggtgacaaggcgagactctctcaaaaaaataaaacagagtagtatccacaagtatgtgagargaagttccagttattaaaattattttagtaccatagccacaggttcagtaagtacaagaatgaatctgcctttgtcctctgtctagttcacctttctatatgattctaccctctttaaatcttgctcaaactccagcttgcccctccctcccagaggtctttttggatctaaccagttgggtgtggctgctccctcccttcaccttcataactcttgtgtccgcatttgacggctcttactgaatgatcaattcctctttgtattacgtatcacagtaatacagtttcttaaactgtgga

SEQ ID NO: 142941 - DNA, 601 bp, Human
agctgctgaaattaatgctttgctgtctattttacagccttctctttatcctgctatcaatgtgccttacatcttttattcattccaaagtaaactgcagaagcagtacactccacccctccccctactccagcatgcacagcctcaactacagttttctttttgtttatgggtttttattgtagttttattattttaatagatcacgtgagcagacttcctgactagcaaaacactaaaaagacccaaactccagtgtgttgttattatgaaatgtttagctcacaactttctttttttytttttttttttttttgagacagagtctcgctctgtcgcccaggctgtagtgcagtgtcgcgatctcggctcactgcaagctctgcctcccgggttcatgccattctcccacctcagcctcccgagtagctgggactgcaggtgccctccaccacgcccagctaattttttgtatttttagtagagatggggtttcaccgtgttagccaggatggcctccatctcctgacctggtgatccacctatctcagcctcccaaagtgctaggattacagaggttagccaccacgcccggccacag

SEQ ID NO: 142942 - DNA, 601 bp, Human
aagccatagccacaatgcagctggacttgaatcactttctaattttcctgagtacttcactagatcactttttgctccattacttaggagaggagatggagatatccctttgggaaaaaaaaaaagtcctacaaacacacacttagtgcttgaaggagacttagtgaggaatccaagctccacctccttcagatgaggccactacagattggccaaggttaaattactggctcaaggtcatttcactaaacatcggtcataatctctcttcagggaaattccatctccctgctccgcaccaaaaaaaaaaaaaaaaaaaaaatccactgacctttccattctccaaaccaacagcgtgtcaagttcaaagctaattaaaaccaaattataaaaataacgtcagttgtgtggtctaagaagacgatgggaaatctaatgcagaaaagcagagtccttaacacctttctgatgctatatgcagactgcgtctaggtgcatttcatgtattatctcatttaagtcattcgagagtcctatcaaagcaagtcattctattagcccattttacagatgatgaacaaacaggaattaagtcccagga

SEQ ID NO: 142943 - DNA, 601 bp, Human
gttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacactcttcagctttcaaaagaggtcgggggaaggtagaaaacaatcatgacttcagtagccaaggagattaacttccaacgtaccgacagggaagaggagggatgcaccatttaaaaaaaaaaaaaaaaaagtttcagctggagaaaaattttggaatattttaaattaatgggtaacaaagggttgccatggaaacagttttgcatacttgactgcaggtgctccctacagtgaagggagattgggatgatacagccacaagcaaggacactgatgtgaacattaaagtgagattcctaaggcaatgttaagtcatccgagccacggacactgtggttttcgatacaaatgaactcacttatgcaacgagggtatgtgagctttgcaacaccagctaacactcacttgcgtcc

SEQ ID NO: 142944 - DNA, 601 bp, Human
gtttttcaagtatactttccagatccacttatgcatctaatcatcaggcaggtcatgagcttggtgagattttgtttctgttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacactcttcagctttcaaaagaggtcgggggaaggkagaaaacaatcatgacttcagtagccaaggagattaacttccaacgtaccgacagggaagaggagggatgcaccatttaaaaaaaaaaaaaaaaaagtttcagctggagaaaaattttggaatattttaaattaatgggtaacaaagggttgccatggaaacagttttgcatacttgactgcaggtgctccctacagtgaagggagattgggatgatacagccacaagcaaggacactgatgtgaacattaaagtgagattcctaaggcaatgttaagtcatccgagccacggacactgt

SEQ ID NO: 142945 - DNA, 601 bp, Human
ttgcaaccttaacatgtttattgccactgatttgcatttcatttcataggtgaaagtttccaaacataagctgtggacttatttcttatacacctcttgacaccagcatgaaacgtatgttgccaaaactcagtcctcctagtacccattcaattcaccattcacattacaaagagctgctctgtttttcaagtatactttccagatccacttatgcatctaatcatcaggcaggtcatgagcttggtgagattttgtttctgttgcacatacttcgcacatcgtttcagatgttaaagayggtttcgcattaagttctccttctttcaaatcaagaagggaggcatttcctcccacttgttgactcagagctgtaatcagagattctgggattagccatttatttcattacacacacacacacacacacacacacacacacacacacacactcttcagctttcaaaagaggtcgggggaaggtagaaaacaatcatgacttcagtagccaaggagattaacttccaacgtaccgacagggaagaggagggatgcaccatttaaaaaaaaaaaaaaaaaagtttcagctggagaaaaattt

SEQ ID NO: 142946 - DNA, 601 bp, Human
gccctgtggctcttgccccagaggatgcctggggccacgcgggctgcgacagggccctccacgcaagctggctgtacataaacagtaacacctcattctctcttctacctcattaaccgaaacacattaaaacaagtgtgcactgggagcagaaaatgagactgttaaaccaagctgacataatcctcatcagctgtgggaaaggagaccgcatcaattatgctgaaccgaatgcagtcacatggatgtgctgggctcccagccccccagcatgaaaaggaggacaagaggaaaagaaacrttcacttaaaaaagaaaacaggctgggcgcggtggctcacgcctgtaatcccagcactttgggaggccgaagtgggcggatcactggaggtcaggagttcaacaccagcctggccaacatggtgaaactccgtctccactgaaattacaaaaattagccaggcgtggtggcgggcgcctgtaatcccagctacttgggaggctgaggcaggagaatcacttgaacacgggaggtggaggttgcagtgagctgagatcttgccactgtactccagcttgtgtgacaagagtgaaactcagt

SEQ ID NO: 142947 - DNA, 601 bp, Human
caagaccccatctctaccataaaataaaaagtttagctgggtgtggtggtatgtgcctgtagtcccagctgctcaggaggctgaggcaggaggatggcctgagcccaggaggttgaggctgcagtgagctaaaattgcaccactgcactccaggctggacaacagaatgaggcttggctgggtgcgggagctcatgcctataaccccagcactttgggaggccaaggtgggcagatcactaaaagtcaggagttcaagaacagtcaggccaacagggagacactccatctctactgaaaayacaaaaatcagctgggtgtggtggcacacacctgtaatcccagctactcaggaggctgaggcagaaaaatttcttgaacctgggaagtggaggttgcagtgagccgagatggcgccactgcactccagcctgggcgacagagccgccagaccctgtctaaaaaaaaaaaaaaaaaagagtgaggtaaaaaatcaaattcttactgcttaactccacctggatttttgatattggttctacctatatgttaaattaactgacccttgcttggggagaggtccacccgggggtgagggactg

SEQ ID NO: 142948 - DNA, 601 bp, Human
gagagatcgagagaggaaagggcttaaggggaagatggaaagagcgggtaggaggtaggagaacaggtctttccacaatgtgtgcccaattgacaaaatggcttgggttggtcccaaagagggaaagttgctgttgtacccctgatattccctttgctgtccatgcatccaggactggagatttgaatacatgcaaaagcccccccaccacaacccctcggcccaagtcttggtttcctggctgttctctggcagcacccggctcaccaaggcaccctaaggaggggtcagcggtgtttaygataggcccccaaactctaggcccaagctccacagataagcaagaaccaagtcatgacccaaaccagatgcctgttcatataagattacccctggaagactctttgatctcttttacctccctcaccagtagcactgttctgatccacgtaagataaaatacaaattcttaggccagatatagtggctcaggcctgtaatcccagtagggaggatggcttgaggtcatgagttcaagaccaacctgggcaacacagcaagaccccatctctaccataaaataaaaagtttagctgggtgt

SEQ ID NO: 142949 - DNA, 601 bp, Human
ggaggagggggagcgagggggagcgagggggagcgagggggagcgaaggggagcgagggggagcgagagagagagcaagagagagcaagagagacagcaagagagatcgagagaggaaagggcttaaggggaagatggaaagagcgggtaggaggtaggagaacaggtctttccacaatgtgtgcccaattgacaaaatggcttgggttggtcccaaagagggaaagttgctgttgtacccctgatattccctttgctgtccatgcatccaggactggagatttgaatacatgcaaaagcscccccaccacaacccctcggcccaagtcttggtttcctggctgttctctggcagcacccggctcaccaaggcaccctaaggaggggtcagcggtgtttacgataggcccccaaactctaggcccaagctccacagataagcaagaaccaagtcatgacccaaaccagatgcctgttcatataagattacccctggaagactctttgatctcttttacctccctcaccagtagcactgttctgatccacgtaagataaaatacaaattcttaggccagatatagtggctcaggcctgtaat

SEQ ID NO: 142950 - DNA, 601 bp, Human
gctggcagcaggccctccgcacagccccccgcccctccggagccgcccgggggagctgcagcagcctctctgcgccaggcacactcccagcattgtgctccctccagcgcgctctcccccaccaaaaaccctgaggcctccggagtgtacactaaccacaagcctttgagtggctcatgtatttacaaactgaggcatgtcgaaatcaaaggggataccacatgacataattcgcattaaaatgtcaacaggctgacaatttatagagtcaatccacggaaggtggggaggactaagactyagtaattgtttaattcctgctgaaacccacggccactgtgcctttgggaagctgggatgcgccagaggcctccaggctgcacagtgccccctggggctggcaccgtgccaaggccaggcaacgggtttaaccatttagggtgctcaatgatgtggaggatggggagaggggagggggaggggaggagggggagcgagggggagcgagggggagcgagggggagcgaaggggagcgagggggagcgagagagagagcaagagagagcaagagagacagcaagagagatcgagagaggaaag

SEQ ID NO: 142951 - DNA, 601 bp, Human
cccgaccacccatgggcatcaaagatcccatgacatttctgtaaatcagccaaattccaacacagacagcaggcccagcagttgctgtattcagatgaggggcgattacatgctcctgcctctcctacacaaagcagagaccaatgtttctactcctggcccgttctctgggtctatcctggccaacctcctctgggcacagcccatcagacctccagatggctagttctctctagaccactgacatcctacacacaaaggattaccaagaagccagctcccccaggtttacgaaatttayaggaaagtctccaatcaagaggtcaggagacagagaacagggtgttaggaaccatgagctggaggagagtcccagcataggggcttctcagctgttctcacttgaaattacctctaaaaatctatttccatatttcttccctggaatttcacttttagaatttgaacattcagaaccttcaggtctccactccttcttcacttggtcagagaatttcacttggtcagtttcacttggtcagacattggttaaaataaaataatttccatttttaaacagtagtaaaaaatttttatttaa

SEQ ID NO: 142952 - DNA, 601 bp, Human
gtcactgtttcttttaatttggaaacacatctatcaactgaaacctttaaaaacttaacaaggaataatgttgttatgggtcatgattattctaatgtcttatcattttattttgcatatgcccttatagctaaactcaaactagatgctagaatataattgcccatagtaaccaactaaacagttcccctaagcaatgtgtatttttgcgtctctgtctctctcacactctcactctatcctgcccgcccactcgctccccttcccaagtaacaaaagccagataaatccatggaagagstgaaagagctacagcgactccactttccaaacacttgtgtgtattacaactctttaaaaatgaattacagaatccactttgaaaaacatattcgggcccttgtggaagttaccagtcctttctcaaatgagctggaagtgtctctgatcaacatgaattggggttccttcttccttttcggagtatggatactaattgttttaatatgggcattattcgcacatgaaactagaattgctcagcacgtgggagataggtcccgaccacccatgggcatcaaagatcccatgacatttctgt

SEQ ID NO: 142953 - DNA, 601 bp, Human
ccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagttcaacacaaagaaccttgaggtccctaactctggaaagggcaagagaattctagaggcccctgaatgccaggaaatttcaggaggtacaggcatgtcacaggtcaggctaaatggtccccaaccaccgcagcaatgctgcatacgcacrctgtggggtcaaggacaggtgatcctgatggtcacatttcccaggtttgctaacaggcagcccatacctgtgtccacttaaccccgtcccgtgtctttcccttatcttgagttgcctttcactttgaagcaatgaggaaaaaggaatgaatgaaagcaaatggacccgcacaatcatctacaatagtccagaatttgtctaatttatagggctgggaaaccaagtgtcaccttcgggcctactccttccctgaccaaactgcccagaggggctggaacgggcaccagccaagggtgggca

SEQ ID NO: 142954 - DNA, 601 bp, Human
tttctcttcttattaaactaacctcctgggttttcttcctctgggcacttctctcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgtggtcaactgccaatgccggtgatacctggatacattgtacaatctgtgctttgtgtgctrtgcaaataacctgtggggctggagcaagctggaatgtggagttaacacaaagccattgctgtgctatcgaaatcggtcgtgaggctgcccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagttcaacacaaagaaccttgaggtccctaactctggaaagggcaagagaattctagaggccc

SEQ ID NO: 142955 - DNA, 601 bp, Human
attgtcagaaacccttctcgttcactctcgtttagcccccgcctccctttaacttccttttttctcttcttattaaactaacctcctgggttttcttcctctgggcacttctctcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgyggtcaactgccaatgccggtgatacctggatacattgtacaatctgtgctttgtgtgctatgcaaataacctgtggggctggagcaagctggaatgtggagttaacacaaagccattgctgtgctatcgaaatcggtcgtgaggctgcccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagt

SEQ ID NO: 142956 - DNA, 601 bp, Human
gtgagatggtaccaggcccacagagaggccgcggctgggtgcgcagaactacgacaccagccctaagaagccaacaggctgttgaatgccaagcctgaactattaatttgcatatgacatcaattctgctgtcagtgtgttaatgtgtgattaattctgtcatgggttagagcaaggagaattagttaattgtcagaaacccttctcgttcactctcgtttagcccccgcctccctttaacttccttttttctcttcttattaaactaacctcctgggttttcttcctctgggcacttctstcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgtggtcaactgccaatgccggtgatacctggatacattgtacaatctgtgctttgtgtgctatgcaaataacctgtggggctggagcaagctggaatgtggagttaacacaaag

SEQ ID NO: 142957 - DNA, 601 bp, Human
gagacctgtctcagaccagaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggtggtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcactca

SEQ ID NO: 142958 - DNA, 601 bp, Human
tgagacctgtctcagaccagaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggaagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcactc

SEQ ID NO: 142959 - DNA, 601 bp, Human
gtgagacctgtctcagaccagaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttgttagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcact

SEQ ID NO: 142960 - DNA, 601 bp, Human
agtgagacctgtctcagaccagaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggtagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcac

SEQ ID NO: 142961 - DNA, 601 bp, Human
accttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcctaaccatccccgcattaggacggtgaggcccccctgtcccagacaaacaaccttccctttggcctctgtcacttgttagttctctatcagcygaagttcatctcatcctattccacccattatgccagtgtcaagagggaggtgtggcaatgaagaggacaaatccttacctctagcacagacagaaagggccaccatcaaggatggctttagcgtcacagaaagaaatccacctgcttgtcaccctcaacccagggaccatggtgacagccagtaccacacgaacctgagtgtggccaaacctacctacagccttatggaacgaccgtcactcccagcgctctcttcgtacctggctttcttcctatgaaattgccttgtgtgatcaaaaa

SEQ ID NO: 142962 - DNA, 601 bp, Human
ctcagccctgcagcacggtaggcacgccgtgaagcccacactctgccactgagtcaccgaaacagcagaccttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcctaaccatccccgcattaggacggkgaggcccccctgtcccagacaaacaaccttccctttggcctctgtcacttgttagttctctatcagctgaagttcatctcatcctattccacccattatgccagtgtcaagagggaggtgtggcaatgaagaggacaaatccttacctctagcacagacagaaagggccaccatcaaggatggctttagcgtcacagaaagaaatccacctgcttgtcaccctcaacccagggaccatggtgacagccagtaccacacgaacctgagtgtggccaaacctacctacagccttatggaacg

SEQ ID NO: 142963 - DNA, 601 bp, Human
gaaaagggggcagtgcctggctcggcgcccagcgtgctgcatgctggtttcaggccccaggaagctggcgggggccttgtcctgagccaggaggagacaggccttggccggtttcctagcaaccctcaccggcagcaggcagtaccccaggcaaggctgtccagggaaaaatgaaaatggccacacgcacagatgcaaaacgaaagcaggcctgcctcccagccgggtgcggaggcaccaggggcccctgccagacagctcccacaccaaactccttggagaaacatctgggggcaccagycatggagggggtctcacttccttctcagccctgcagcacggtaggcacgccgtgaagcccacactctgccactgagtcaccgaaacagcagaccttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcc

SEQ ID NO: 142964 - DNA, 601 bp, Human
actcagatactcagagtgtcctcgcagaacatctaggcattcattcacttaaggacggagctcatttctgaattacagaccctgctctccctctcccgccacaccctacatcatgcttagagagctggagggtaaccgggtggtgtcatcaacgaagcttctaggagatgcagcttctaggaacttggacaagtgcttcacagaaatgtgatcgtggttacttccttcctagaccccatggcgaaaaatgcttgcggctttcctgttcttcaaagggcatcagacacgactatcgctcagsatgaaggagatacatagggctaagtgggaagacggcgcaatgcaaaagggcagaggactgaacggggatttgggatgcttgggtgctagccaagaaagactccagaaaacaatcagagggaatctcactttcatttggctttggggctattcttattctctgatgaaagcaccttaacagtacggtgagaagcatgatggagacagttggcgtggcctcgccttcccccaatgcttcgtgcagcaaatgatcactgcatgtacagaaggggatcgaggagtctggagagaaaggacgggg

SEQ ID NO: 142965 - DNA, 601 bp, Human
gcttttaaagcaaatccaggctgggcaaggtggctcatgcctgtaatctcagcacttttggaggccaaggtgggatgatcgcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctaggcattcattcacttaaggacggagctcatttctgaattacagaccctgctctccctctcccgccacaccctacatcatgcttagagagctggagggtaaccgggtggtgtcatcaacgaagcttctaggagatgcagcttctaggaacttggacaagtgcttcacagaaatgtgatcgtggttacttccttcctagaccccatggcgaaaaatgcttgcggcttt

SEQ ID NO: 142966 - DNA, 601 bp, Human
cttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggatgatygcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctaggcat

SEQ ID NO: 142967 - DNA, 601 bp, Human
tggacttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggaygatcgcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctag

SEQ ID NO: 142968 - DNA, 601 bp, Human
gaatataatcaacttaaagaaacacaccaaccaggtgcagtggctcatgcctgtaatccaagcactttgggaggccaaggcggtggatcacctgaggtcagaagttcgagaccagcctggccaacatggcgaaaccccgtctctactaaaaatacaagaaaaaaaaaaattatctggacttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggatgatcgcttgaagccagtagtttgagaccagcctgggtaagaaagtgagaccccccatatctacaaaaaataaaataattagccaggcatggtggtgtatgcctgtattcctagccacttgaggggc

SEQ ID NO: 142969 - DNA, 601 bp, Human
tcagctcagattctgtactttttttttttttagagacagggtctcactctgttgcccaggctggagtgtgcagaggtatagtcacagctcactgcagcctggaactcccaggctcaagcgattctcccacctcagcctcccaagtagctaggactacaggcgtgcaccaccacacctggctaatttttgtatttttttgtagagatgggggtttcaccatgctacgcaggctgttcttgaactcctgagctcaagtgatctatctgccttggcctcccaaagtgctgcgactacaggtgtsagccagtgtgcccagcatattttgtacttcaaagggttctctcactgattctgacgcacagctaggtttaagaatccttgagccaggtggtatctttatttttaagaaagatctgttttgttttttttttaaggcagtacagaaagaaatgtataaatcatcacattctatcactaatgtgaacattttttaccaatatccatcttgatatctcctgtctatctatctaaaatatacctccaattttacataaacgcaatgatctgtatatgtaacatttttatactatgttgagagagg

SEQ ID NO: 142970 - DNA, 601 bp, Human
ttctaagcttaacaaagcagaagaaggccaggtgcagtggctcacacctgtaatcccagcaccttgagaggcccaggcaggtggattgcttgagccaaggagttcgagaccagcctgaacaacatggtgaaaccccatcgctacaaaaaaaacacaaaaattagccaggtatcatggcacgcgcctatagtcctggctattcaggaggctgaggtggaaggattacttgattccagaaggccgaggctacagcgagccatgatcacaccactgcactccagactgggtgacagagcaacamcctgtctcaataaataaataaacaaacaaaggagaaggaagcaaaaatgagaagttttcgccatgtaaaatttcgaaactttggaatctcaaaacataccataaacagcaaaagataatgataaactgggggaaaggtagacagtaacacaaatacataaatacatgtttaacacctttgatagagaaagagctattttaatttgtttatattatccatctatgaacgtttaatttataacagtgaaaaactggaaacaagccgactatcaaacgcccagtaactaaattgcagcacctt

SEQ ID NO: 142971 - DNA, 601 bp, Human
tgatcccatcagtgactgggcagacagcagatcttccatcaacacctagactcgcagaacacatcaaacagaaggctctcgacacccagtgtccgggatcagcgtggcgggcctctgctccaacctgtccacccaactagatctcaagaggaaaacagaattgccacctctcaagactgaggctacgtgcagtggctcacacttgtaaccccggcactcctggatgccaaggctcaagaggagcccaggaagtcgagaccagcctgggcaacaaggcaagatccagtctctacaaaaaataaaaaaaaattagccaggtgtgtggtacatgcatgcctgtggttccagctactccggaggctgagggaggaggatcacttgagcccaagaggtcaaggctccagtgagccgtgtttgtgccactgcactccagcctctgtgacagagcaagactctgtcataaaaaaaaaaaaaaggctgaatttcattgtgattttaaaagcacatataatcattttataaaatgcagaaaagtgttattaataagttaatctctgagtgcttactatgtgccaggcacagttccaacgcccattctaag

SEQ ID NO: 142972 - DNA, 601 bp, Human
tgatgttctgacattaaaaaagaaacaaggaagctcttgcttctagagaaacaagaaaggaacaaggaatgtttgggtaagaactgctgcattcttacccaaaagaataacataggctaggctgggtgcggtggctcatgcctataatcccagcactttgggggctgaggcaggcaggtcacttgaggtcaggactttgagacaagcttggccaatacggtgaaaccctgtctctactaaaaatacaaaaattagttgggtgtgatggtgtgcgcctatagtcccagctactcgggtggckgaggcaggagaattgcttgaatctgggaggcagaggttgcagtgagctgagatcacactactgcactctagcctgggcgacagagtgagactccatctaaaagcaaacaaacaaacaacaacaacaaaaacacataggctaacaagtagcctacgttattcaaaattcaaaattccagtactgatctttaccatcatcctgtccacagagaaaagatgatgaagtgtgtaggaagcaacaaatgtcccctacctgcacacccgccccacactggattctccaaatatctggcatttattt

SEQ ID NO: 142973 - DNA, 601 bp, Human
tggcccctgcaggcatctgggtttgcaatccctgggtccgaatgtgaaagagaatgtggctggcaagtaggagtcacagaagtcaaccctgggatctaccattcctcggctggggtttgtcagcccgtgctgtgctactccgtgaataacccagcacaaagattcccctacaaaacatcatgttgctgcctgggttgcacactgcaaaacagaaggtgagaagctcagcttcaccagacttgggcagtaagggagtcgagaatgagtgtagcttcacaagggaagccagcttaattctgcmacaggagttaatatttgttaattggtagaaaaaggtaaaattaatgaggaagttagcatagctatttaaaaacagctccatgtttcccccactgtaacacatggaactatcaggaagtaattgagggaaaaggacactgtcaattctcaattatctgcatgaatgaagcgctcagtgacacggataatccaagtcacttacatttggatttagaaagtaacatctttttccttcggaaaacttaccttcctaattagggcttgctgaatgcagtggcgaaatcagtttaccttctcggtc

SEQ ID NO: 142974 - DNA, 601 bp, Human
ctttctcctctgtttaatggacacaggagagagataatctagagatggcaaattggcagtggctgagaagcctgcaggtgggagcttcataaccctcgggagtttttaaaaatgcttaattaatggtgaacatttaaaaatctgccaatttcccatacaatcaagattttttgcctctttagacattaaaaaacaaaacaaaacaaaaaaacagggtttctggctgtacattccctcatgtcagcaattacctagaaaagatggtgcaggagccctccagccccacaccagttacccactkctgatacctgtatggcccctgcaggcatctgggtttgcaatccctgggtccgaatgtgaaagagaatgtggctggcaagtaggagtcacagaagtcaaccctgggatctaccattcctcggctggggtttgtcagcccgtgctgtgctactccgtgaataacccagcacaaagattcccctacaaaacatcatgttgctgcctgggttgcacactgcaaaacagaaggtgagaagctcagcttcaccagacttgggcagtaagggagtcgagaatgagtgtagcttcacaagggaagcca

SEQ ID NO: 142975 - DNA, 601 bp, Human
taagggttaaggttatacacttattcagagcttaacaatacctgtaactgacgccactttgaacgaacctagtgatggaattactaacaacaacaaaaatgtggccttctgagtctacgccttccagtagctgaaaacaatccagttttaaacagccagggaggaaaaaatgagaaggtgaaaaatcaggtcattatcatccctgcgtcatgccatgctcttgcttccttcctaagatgctcttaagagctgacgctaggacatccaagaatcttggatcctgacatctaagaacaagtgrtcaggaaatctggattgagaaaaatgaagtatttaggtgttttctcaataacatcatcttacatgtacacagtcctgcgtagatttcaaagggtttggccattacacagctcaaatgattctcataagcaccttgagacattaggcagtggatggcagcgtggcagatggctttctcctctgtttaatggacacaggagagagataatctagagatggcaaattggcagtggctgagaagcctgcaggtgggagcttcataaccctcgggagtttttaaaaatgcttaattaatggtgaa

SEQ ID NO: 142976 - DNA, 601 bp, Human
tgtctcaaaaaaaaaaaaaaaaaaaaaaattaaaaagccaggcttgcaaacttcatatgcaaataagctgtttcaacgtgaaagtcaacacctatttaagagccatttaactttcaattacgaaatgaattcagaacaattcaacttcactgcttgttttcaaggctttcgaacctaactttctcgtcagtgtgctcagtcacagggcactggttctcaggttctgcatctcactctacaatcaaggtaaataccaccacaggaataagggttaaggttatacacttattcagagcttaayaatacctgtaactgacgccactttgaacgaacctagtgatggaattactaacaacaacaaaaatgtggccttctgagtctacgccttccagtagctgaaaacaatccagttttaaacagccagggaggaaaaaatgagaaggtgaaaaatcaggtcattatcatccctgcgtcatgccatgctcttgcttccttcctaagatgctcttaagagctgacgctaggacatccaagaatcttggatcctgacatctaagaacaagtggtcaggaaatctggattgagaaaaatgaagtattta

SEQ ID NO: 142977 - DNA, 601 bp, Human
ttaacatttagaataatacccactgtttcaggttgagaaagcattcagattttagctaaactgaaggctgagcacatccactaatgagcactgtccttcccatagaaacggcgaaagctactcagtctgctgaataaaatgactagcaggacattagcgagaagcggatgcaggtttagttaccatgaaaccagggccattgcattcaacatctaataagcaaattcttacgatcacagaaataagccagagcctaccgagctgacaacaattgcatgaaaagcggtttggggagaataaygtcttagtcccagttttcctagaattcataagaatacagcctcttagaaggcacgtttctaaaatgtaggcaaggggtcagaaaactttttctgtaaatattcagagggtaaaaaagcttaggtttttaaggcccgtaccatctctgtctcaactactcaattctgccacggcagcacataaaagaataggcatgactgtgttccaataaaactttatttatggagacaaatggctggctgtattccctcctctggcagtgatatgctgttccctgacctaaaaccccgtaacaaattta

SEQ ID NO: 142978 - DNA, 601 bp, Human
accttcagcaagttacccgcccgtccctgctccagtgctaaaatcagcacggcgatacgagaacctacttcaaggcatcatcatgaggaacgatgatgaagcagctaataatgactgggaaacactttgtctttgtaaagagccatattacttaacatttagaataatacccactgtttcaggttgagaaagcattcagattttagctaaactgaaggctgagcacatccactaatgagcactgtccttcccatagaaacggcgaaagctactcagtctgctgaataaaatgactagcagkacattagcgagaagcggatgcaggtttagttaccatgaaaccagggccattgcattcaacatctaataagcaaattcttacgatcacagaaataagccagagcctaccgagctgacaacaattgcatgaaaagcggtttggggagaataatgtcttagtcccagttttcctagaattcataagaatacagcctcttagaaggcacgtttctaaaatgtaggcaaggggtcagaaaactttttctgtaaatattcagagggtaaaaaagcttaggtttttaaggcccgtaccatctctgtc

SEQ ID NO: 142979 - DNA, 601 bp, Human
tcattctgcagtgagaacatgggaatgggagtgagcagccgtggagaagagggaggactgacgctgagctttctcttccattgtaaaaggaggaatagggccacctacctcaccaggggccatgaggcttgagtgagaaaatcagtatgaatgaacttccttaaacaataaagcaaaattaaaacaaaacagctgctcaggtgacgacaatgggtggaaaggggaacttgaagattcaggacgcctcccctgccatctgatttcatcagggtcctaggactgactacacaaagaggaattrattacttgatcgtccgttcacttaccttgctaatgaaatcattgggtttttctggggaagaacctgttaggaggactggcttgcctctgggtgtcagtcccgctggtgccagctgcatccccaatgccaacatgactcatgcgatgacacaaattgccattgggctttgttattatgtgaccttcagcaagttacccgcccgtccctgctccagtgctaaaatcagcacggcgatacgagaacctacttcaaggcatcatcatgaggaacgatgatgaagcagctaataatgactgggaa

SEQ ID NO: 142980 - DNA, 601 bp, Human
ggaggttacagtgagccgagatcatgccactgcactccagactgggcaacagagcgagactctgtccaccccccttccccccctcaaaaaactaatgactgggaaaattttctttgagcaaaatggtaggagttggggaggagcaaaggaggtgggtggaagcgaggactagagagaggactgcccagaccctgccaggtggaaagcatcaggacacatcacgcatgctacaagtttttatgtgacgcgtgcacagtggcatgtggacacagacctggccgtgctttctcccggggctacrgtattaagatgcagtcaatcgctcaccatcacaccagtgggcaagtgatgtctttttggaatctcaaatccagtagcctgctctgctagccttaatctagtcagtctatggacgcttttatattagtaggtattttaaaggcttaagtcttaaaacacaaatctttcgatgacctttccagatgactctataatagcataaggccagaggaaacagcagcagccagtctcaggttctggtagcactggtatttttataatggtctttcttccggctttgattcattcattcattccccgt

SEQ ID NO: 142981 - DNA, 601 bp, Human
ggagaatttcttgaacacaggaggtggaggtcgcagtgagccgagatcacaacccactgcactccagcctggcaacagagtgagattctgtctcaaactaaataaataaataaataaataaataaataaataaataaataaataaataaaaattgtgggctgaaagtttgaacagatgaagaaaatccttctaaagctccactattcctcctgggtcttcagcttgcctttcaagacctatctaatccagtccaaattcacttcccccatctcagatttcaatcctccactccattccacktgcaattagacttgtgtcagttcccaccttccccaccaactatgatctttctggtctcagtgccttttcttgctgggaaaccctcccagataactctgacccatgctgaaatgcctcacatctcctacggcaggctggtggcacctgcgcctggaaggctttatgcattgcacctgagctaaaacagtggctccttgcctgtgggggggggtcccacagcaccaggtggtcccgatcagggcccaccacaaagcattctcttttttctttctttctgagatgggagtctcactctgtcac

SEQ ID NO: 142982 - DNA, 601 bp, Human
tcatggcagggacttaaaaactgtagtggctcacgcctataatcctagcactgtgggaggccaaggtgggtggatcacttgaggccagaagttagagaccagcttggccaacatggcaaaaccccacctctaccaaaaatacaaaaattagccgggcgtggtggcaggctcctataatcccagctacttgggaggctgaggcaggagaatttcttgaacacaggaggtggaggtcgcagtgagccgagatcacaacccactgcactccagcctggcaacagagtgagattctgtctcaaamtaaataaataaataaataaataaataaataaataaataaataaataaataaaaattgtgggctgaaagtttgaacagatgaagaaaatccttctaaagctccactattcctcctgggtcttcagcttgcctttcaagacctatctaatccagtccaaattcacttcccccatctcagatttcaatcctccactccattccacttgcaattagacttgtgtcagttcccaccttccccaccaactatgatctttctggtctcagtgccttttcttgctgggaaaccctcccagataactct

SEQ ID NO: 142983 - DNA, 601 bp, Human
ccatttgttttctggaaggttgaaagagacagacttgtcggagggaagcaagggaccaacagtgaaatgagaaagatggttctttgaggaaggacagaagagtctgcttcaagaggccaggagatggctgtatgcagaacggacggccacgtggcgagagggccacagttctgcaaacgatgacactgctcatttcccagctctgcttttgggttcccccataaataacccagacaaacaccccatgcactgggttctgccctccttcccccaccccctttttaagtctcattaaaagccratattgttccgcctcaagatggagagctcagcatggattttactgaacgttaaatcaaccagcaagcgcagccagcaaactctgtggcactttaactttaaataatgcaataattattgaatttcctttttataactgaagtgctggaatgtaaacaatggggctgtaattgcaggaaggggggatcaatagaggcaatcgttttcaaccatgttaattgtaaatacaattgctccaagatgtcagccttgttcttcttgctcccagaatcatcctaacggatgacagagtccaactttc

SEQ ID NO: 142984 - DNA, 601 bp, Human
ctgcctcgtacaaggggcttgattttttattttattcttctcttaaaagagagaatgagaaagtgacggggcgaggcagaaaaactccctctaaatcaacacttctggcgtcgatcactctggctgatgcagacatttcactttttctccttaaattccatttgttttctggaaggttgaaagagacagacttgtcggagggaagcaagggaccaacagtgaaatgagaaagatggttctttgaggaaggacagaagagtctgcttcaagaggccaggagatggctgtatgcagaacggayggccacgtggcgagagggccacagttctgcaaacgatgacactgctcatttcccagctctgcttttgggttcccccataaataacccagacaaacaccccatgcactgggttctgccctccttcccccaccccctttttaagtctcattaaaagccgatattgttccgcctcaagatggagagctcagcatggattttactgaacgttaaatcaaccagcaagcgcagccagcaaactctgtggcactttaactttaaataatgcaataattattgaatttcctttttataactgaagtg

SEQ ID NO: 142985 - DNA, 601 bp, Human
cctgggtgaggagcagggaagggaggagagttcggctgaaatgcctggaagacacttccccgattctccaaatccactcaagaatttgcttatttgtatctccaatcccatgacagtcaatccagcagaaaaaaacacgtgtctactggtcaaaacgggtgtgctacttcatctataacctggagatattttacttgccctgtcttacacaaagcaattttaaaaaccgcatgagaaaacttccacatatgtgaaaatccttcggaacatgtgaagaactacccaaatatttgagacagtsatggtctttctactgtaagtccagatgttgcttcgtcgcttctgatgggcacgtacagccaggtgggcttggtgatggatgatgccactggtgttccagctcagtggttctctaacttgagcgtgcatcggaagcacctgggaggcatgctacgccctagatcgctggggccatcccaagggtttctgattcagagggtctggagtgagccccaagaatctgcatttctaacagtctcccaggtcatcatgacgccgatctgggaccacactttgagaaccgatgctctggccaggacag

SEQ ID NO: 142986 - DNA, 601 bp, Human
ccctgaggaaggggcctaccagatcataatgtcacaagcaaaatgaggactggtttccacaatggctgagtgagtgtgcacagagctcagaagctgaggggggtatgtaggtggataaaacaacaaagtgggtcccaccaagctaacctcaaactactctccagaaacaacctagagcttccagaatctgacaatcacctcttcactaggatatcatatcaggaacagcaactttcttcatttgtaagatgtacttcttccctagcactattttccagctttcccaaatttaggtccccayacaaaaataaaagcctcctgatatagtttggctgtgtccccacgcaaatctcatcttgaagtgtagtccccataatccccatgtatcatggtagggatctggtgggaggtaactgaatcatgggtgcagttacccctgctgctgttcttgtgacagcgagttctcatgagatctgatggttttataaagggcttccccactccttcactctgcacttctcttcctgctgccatgtgaaaaaggacatgtttgctcccctttccatcatgattgtaagttttctgaggcctccccagccat

SEQ ID NO: 142987 - DNA, 601 bp, Human
agctctcaccttctacaccactctcatgctgctgcaggtgctgcaagtaacaaaagagaaagacatgccttgggtaagccactcgaagcggccactggcatcagcccacaccatcctggtcacagccagaggcatgcctccaggggacacatctccacagccaaacaggacagtctttgatatggtttggctgtgtccccgcccaaaatctcatcttgaattctaatctgaactgtaatccccacgtgttggggataggaccttgtgggaggtgattagaatatgggggtggttcccccaygctgttcttgtgatactgagttctcatgagatctgatagttttataaggggcttttccctacttcactcagcacttctccttcctgctgccatgtgaagaaagacatgcctgcttccctttctgccattattgtaagtttcctgaggcctccccacccctgcagaactgtgagtcaatttctttcctttgtaaattacccagtcctaggcagttcttagtagcagcacggtaatggactaatgaggtcttcaactgtgagattccttagagggtttttttttttttttcccccagagtac

SEQ ID NO: 142988 - DNA, 601 bp, Human
cagtgcctgtgtatttgtgggtagagtgagggtgcgtgtgggatgcatgtcagtgtgtgtggggtgtgtgggggtacagtgtctatgtgtttatgatgcttgcatgtggggggtgcagtgtatgtgggggaggtgcacgcagatggggcgtgtgggtgtagtatatggcttgtgtgggtgtgtgagtgtatacagggggtgtgtgtgtgtacaacgtatgtgggtatggtgtcttgtctgtgggctgtgtatgtgagcgtggatggaatgtgtaggatgcagagaaagtgtatgtgtgtgygcgcacgtgcgagaacgtgtatgaggtatcgggctggtgtgtgtgccgtctgcgtgagtctgtggttggggtatgggtgtaggtgtgtacacgggtgggtttgtggaacagcacactggtgaaattctcatctgcccaggtagaaagccaagaggtaacatctaaaacttaaaaacaagaaacagtcgtagaagtatgagaagaaacatggaaataagtaacaaaagaaatatctgaaagttgaaagctgatcccctggaaaagggggtgggagagggccatgctcttctccataaagtt

SEQ ID NO: 142989 - DNA, 601 bp, Human
agggagtccaactgttgtgtggggggtgcaggagtgtgcggggcagtgcctgtgtatttgtgggtagagtgagggtgcgtgtgggatgcatgtcagtgtgtgtggggtgtgtgggggtacagtgtctatgtgtttatgatgcttgcatgtggggggtgcagtgtatgtgggggaggtgcacgcagatggggcgtgtgggtgtagtatatggcttgtgtgggtgtgtgagtgtatacagggggtgtgtgtgtgtacaacgtatgtgggtatggtgtcttgtctgtgggctgtgtatgtgagygtggatggaatgtgtaggatgcagagaaagtgtatgtgtgtgcgcgcacgtgcgagaacgtgtatgaggtatcgggctggtgtgtgtgccgtctgcgtgagtctgtggttggggtatgggtgtaggtgtgtacacgggtgggtttgtggaacagcacactggtgaaattctcatctgcccaggtagaaagccaagaggtaacatctaaaacttaaaaacaagaaacagtcgtagaagtatgagaagaaacatggaaataagtaacaaaagaaatatctgaaagttgaaagctgatcccct

SEQ ID NO: 142990 - DNA, 601 bp, Human
aggcactggtgccgggctgcatccacggaagcactacattccaaaacagggaactgtttgttccaggtcaccgactctgggtgaaatggcagctgtacactgtttagtgtggggcacctcattaatacaaaaggaattctgagcagagtaaaagaaagaattgaagggtgaaatggaccagcttttaacagatgattaaaacaatgatgtatgcagagctggccaaaaaaacaccccaaacaaagcacaaaccctgagcaagaaacaggtctaggtgtgttggtagaaagaaggagaatcyggggaatgactcaacagtgcactaatgcagagcagcggatcaaacagaggccacaatccctgggtggggcacaggctcccctacagccagatggcccaggggcctcagcctcaggcccatcctcgtcccttactcctgagagtgctcccatgtagacggatgggatcagaggcaaagcagaagctccaccaattaaggtgtttcaactttaaccagaagaggcatttgaaaaacacatggaagggacagtcttgcagtgaccttcaagtgacaaaaattatcccggtacccaacagccct

SEQ ID NO: 142991 - DNA, 601 bp, Human
catattcactttagggtggagtttcagattttcaagtttcttggatacacctttcgaaggtgacttgggatgtttcgaaataaaggtttcacagaaagaacacttggtatgacatgatgtcctgtggctcccttgggggtccccatgtcactgggctctgatgagccaacgggggtctctggcatactcacacccctaaaaagaggacccccgcccaatgctcacccctcaacaaatgcaaacacacccatatactgtctctcctaattccaggaaccatcagcaggtacccctttttccttttttttttttttttttgctgtgccaaaaaaaaccctctctgcagtgagtggccacagtatcaatgcttctcccagtgggcagcgttgggcacgtgctgccacccactcatgaagatagcatggaagacagcctggagcccttgaccaagaacaacactaaccagaagggcagtgtacagctggtgccacgtgtcatatgctgaaacaacacgcacaaaaccctggtagcttcatcatcccagaaaaataacgcaacgaatgaatggtggatctagaacatcaaagaatgagtgaatacg

SEQ ID NO: 142992 - DNA, 601 bp, Human
tataggatgtaagtagccctagaaatggattctttggacattcctaaagacggtacaggtacaaatcattatttctcgagaaacatccattcaggcagtggagaaagtgtgaactccagaggctaggataggggatccatatgggaggggtctgcacacatggcaggagacagcagaggacggctgccacttcctgctacactgtcggctttaggaggtctctcccctccagtgaaatccagggacagcacccccaaatccagggacagcacccccaactcccagcccagcacaaacaccyactgactggctagctatccatattcactttagggtggagtttcagattttcaagtttcttggatacacctttcgaaggtgacttgggatgtttcgaaataaaggtttcacagaaagaacacttggtatgacatgatgtcctgtggctcccttgggggtccccatgtcactgggctctgatgagccaacgggggtctctggcatactcacacccctaaaaagaggacccccgcccaatgctcacccctcaacaaatgcaaacacacccatatactgtctctcctaattccaggaaccatca

SEQ ID NO: 142993 - DNA, 601 bp, Human
actgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtcctaatcatacagagacacaccagggggactcacagagaccaggctatatgagaccaaggcctcgggagaagccaaacctgccggcacctggatcttgaacctttagcgtccagaactgtgagaaaatacacttcttttgtttcagccarccaatggaaacggggggtgaaaaatacacacattcttttttgactttataatatgacaatttttgataaaattttgggttgaaacaacagatggccctgtaccaggaaaatcacacattgtctgatttttgatattctaattagagcagaggtcaaagatcttttaaaagcaataaatggctccttttattaacatatacacaaaaggtctcaagatagtcttgaggcataaaactataaaaacccatttaacatccactctgaaaaacacatctttacaaagtcctttcaaagtccctc

SEQ ID NO: 142994 - DNA, 601 bp, Human
tgccccacccaaagtgaccacagaaaaggaaacaagaaactggcttcagatatcagaaagtctgggtaatagactgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtcctaatcatacagagacacaccagggggactcacagagaccaggctatatgagaccaaggcctcgggagaagccaaamctgccggcacctggatcttgaacctttagcgtccagaactgtgagaaaatacacttcttttgtttcagccagccaatggaaacggggggtgaaaaatacacacattcttttttgactttataatatgacaatttttgataaaattttgggttgaaacaacagatggccctgtaccaggaaaatcacacattgtctgatttttgatattctaattagagcagaggtcaaagatcttttaaaagcaataaatggctccttttattaacatatacacaaaaggtctcaagatagtcttgaggc

SEQ ID NO: 142995 - DNA, 601 bp, Human
acagttctgtccgaggcgacttccaggatctccatgacctcccttcatctctcccaccaccttctgtcctaccctcctgccccacccaaagtgaccacagaaaaggaaacaagaaactggcttcagatatcagaaagtctgggtaatagactgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtyctaatcatacagagacacaccagggggactcacagagaccaggctatatgagaccaaggcctcgggagaagccaaacctgccggcacctggatcttgaacctttagcgtccagaactgtgagaaaatacacttcttttgtttcagccagccaatggaaacggggggtgaaaaatacacacattcttttttgactttataatatgacaatttttgataaaattttgggttgaaacaacagatggccctgtaccaggaaaatcacacattgtctgatttttgatattctaattagagcagag

SEQ ID NO: 142996 - DNA, 601 bp, Human
tccagcaatggatcacactgttatctagacacaaagaatcccacccctggggcaaagtgctacttgtcccgtggatgagtttgtcagcctgcagcaaggaggccagacgcagtgggaagagcacagccctgggccctgggcctctgtaccaagtccctactctgctgctgtctacagcagccctgtcctcaggaaccttctccagggaaggaaatggcttctgtctgcacatccaatacagcagccactagccacatggcactgagacagatgggccgctgcaatgggaacctagcgacaygagacatccaagattgccaggaagggtccgagttcgcctctgctttatgctcgtgcaggacaggaacggccctgtggaggctgccctcgaggctcacatcacaggctcaatctgggaaagaccagccatgggaagcaggatgtgacttgccctggaagcgcaagtgaaggacgggctccgaatgaaagctacacaaggtaacaatatacacactgggatctttatattatgtccagcctggagtatataacacagggtaaggaaaaaccaaggaattaaaagtccttcaggtacttcgag

SEQ ID NO: 142997 - DNA, 601 bp, Human
gtggattcttcaaagttcaggtcaactcaggcccctcctccttgcagtcagccctgtactcaaggttgctggagacatggcgcctctattccctgcccaaagaagcccccttaactgggggccacgggttgagtggtgaaggaggcaactcacacctgaattatagtgggcttgtaaacctgaacagggcaagtcacaactttgggaggctgaggcaggaggatcacttgaggccaggagttcaagaacagccctgacaacatagtgagaccctgtctacaaatgaaaaaattagccaggygtggtggtgcatgcctgtgctacttggaagactgaggcaggaggatcacttgagcccaggagatggaggctacagtgagccatgattgtgccactgcactccagcctgtgtaaagaccctgtctctacaaaaaaagaaaacaaaaacaaaaacaaaaaaacaaaaaaaactcacctaccaaaagtccagctgacatctactacaaaattcccattattgccataaaaacatgtgggctgggttcaaggctgcatagcagatggccaggctacatcctcatcacacacgcacttcactggt

SEQ ID NO: 142998 - DNA, 601 bp, Human
tgttaaggcactgtgtaggtttttctgttgttgttgttgttacaatatctaatagtgagatcaaattcttattgtggaaataaacatcacggtcttctgtatgaagatggtctgcggaaagtgaccacgcatcagagtgtccagcgtaggaggagaatctcaatttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcrgtgagtcactaggaaaggatttggtttttagaaaaaaaacttctgatccctgggctaaaacagagagccccaaagagctatgttgatcccagacaagcacgtgcgtggattcttcaaagttcaggtcaactcaggcccctcctccttgcagtcagccctgtactcaaggttgctggagacatggcgcctctattccctgcccaaagaagcccccttaactgggggccacgggttgagtggtgaaggaggcaactcacacctgaattatagtgggcttgtaaacctgaacagggcaagtca

SEQ ID NO: 142999 - DNA, 601 bp, Human
tcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgttgttgttgttacaatatctaatagtgagatcaaattcttattgtggaaataaacatcacggtcttctgtatgaagatggtctgcggaaagtgaccacgcatcagagtgtccagcgtaggaggagaatctcartttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggtttttagaaaaaaaacttctgatccctgggctaaaacagagagccccaaagagctatgttgatcccagacaagcacgtgcgtggattcttcaaagttcaggtcaactcaggcccctcctccttgcagtcagccctgta

SEQ ID NO: 143000 - DNA, 601 bp, Human
aatagtctacattcctgattaaagcaaagctcagagaaaacagcccggtatggcacaaatctccccggtcttatgtgttctgaggaagtcttcagatccgcccagggtctgggcacaggtccgcagggaatcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgttgttgttgttacaatatctaatagtgagatcaaattcttattgtggaaataaacatcacggtcttctgtatgaagatggtctgcggaaagtgaccacgcatcagagtgtccagcgtaggaggagaatctcaatttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggtttttaga

SEQ ID NO: 143001 - DNA, 601 bp, Human
aaaatagtctacattcctgattaaagcaaagctcagagaaaacagcccggtatggcacaaatctccccggtcttatgtgttctgaggaagtcttcagatccgcccagggtctgggcacaggtccgcagggaatcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgktgttgttgttacaatatctaatagtgagatcaaattcttattgtggaaataaacatcacggtcttctgtatgaagatggtctgcggaaagtgaccacgcatcagagtgtccagcgtaggaggagaatctcaatttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggttttta

SEQ ID NO: 143002 - DNA, 486 bp, Human
gaggacagctaaatataccttgtgatctaagatattcttttcatacaaaggatattattaggaaaatttgaataaggactataataacctaatagttttatagcaatgttagttctctgattttgatcattgttctgtggttatgtaaaatatctttgttcttaggaaatacacactaacttattttgatgtcaaggggcaccatgtgtgaaatttactctgaaatccttcccaaaaaaatggcaatgtgtatatttctatttattctccgtctttatggagagagtaagattatgaatgygagagagaagtcaaaaaaggaaatgtggtaaaatgctaatatttggggaatgcaggtgagagaattttcttactatgtaaagtacattacttttctataagtctgaaattatatcaacattttatttatttatttatttttgagatggagttttgctacttgacgcccaggttggagtgcaatgg

SEQ ID NO: 143003 - DNA, 601 bp, Human
ggaccagccagccagagccctcgccaaccagaggctcagttatagcagaacacactgatgagagctaaaggtgtttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttttaaagttctrgcctgctgaatttcctgatcatctagaaaaccgggaaggggagtataggctaaaaataaaccttaatgaccaccactttcatttgccaaatatttctccctattgatttttattagccattttttcaaaacaatctcatttaaacaattcaattccttattaaatcatctccaagcatatcctcactagattctcattaattacaaagggaaaaatagtaacttcagaatggataaccccagaaggaaccaccataactaactgaccaaagctgatgcccgcaatcaagagacaaatcaa

SEQ ID NO: 143004 - DNA, 601 bp, Human
catccttcaaggaccagccagccagagccctcgccaaccagaggctcagttatagcagaacacactgatgagagctaaaggtgtttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttytaaagttctagcctgctgaatttcctgatcatctagaaaaccgggaaggggagtataggctaaaaataaaccttaatgaccaccactttcatttgccaaatatttctccctattgatttttattagccattttttcaaaacaatctcatttaaacaattcaattccttattaaatcatctccaagcatatcctcactagattctcattaattacaaagggaaaaatagtaacttcagaatggataaccccagaaggaaccaccataactaactgaccaaagctgatgcccgcaatcaaga

SEQ ID NO: 143005 - DNA, 601 bp, Human
cccctctgccatcatccttcaaggaccagccagccagagccctcgccaaccagaggctcagttatagcagaacacactgatgagagctaaaggtgtttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttttaaagttctagcctgctgaatttcctgatcatctagaaaaccgggaaggggagtataggctaaaaataaaccttaatgaccaccactttcatttgccaaatatttctccctattgatttttattagccattttttcaaaacaatctcatttaaacaattcaattccttattaaatcatctccaagcatatcctcactagattctcattaattacaaagggaaaaatagtaacttcagaatggataaccccagaaggaaccaccataactaactgaccaaagctgatgc

SEQ ID NO: 143006 - DNA, 601 bp, Human
ctagccaaggtgaaaagtagcgaacccccagagtagactctttgacaggggaaaaaaaaaaagaagaagaagaagggatgctgtctgtgcccaggcactattttcttaaggtggcagctttcctcttctaatgatacctctggtcactgcaccaaccagttgagtcggtttttctggaaagttctcaccaatcactgaaaagggtgtttgtggaggccaaaaatggtgacaatatcaagagccgcacagagtctgccaaggaacccacggggctccgacaagatggcgcccaaggaagcawggaactaactgagccactgacgaatgggatagattctggacaaaagtaatgtaagacatgatccctgccccaagatgtttccaattttagggatgaatagtaagcaaatactaagtaatcagccaaacgaggctgtccaatctttttggaataacatgagatacataagtaatacataaatataattgggtgcaagggtcagtggtacagattcactgctatattcatttacaaaagtggggaatgagggaggtatgtgtggttttgatgataacatcattttcaccctcccttcttacc

SEQ ID NO: 143007 - DNA, 601 bp, Human
aaagctttgaaatctttctctaaacttgtgaatgaagcaccaaataccatggacagagcagcagttgacctctcaggtggcccacactcttgggcctcactgcatggccacccatgttatcgatcagttgatcacatactggcacatcaggaccaccaattccaatcccaacagctatggcctatatcagaatccaaccaagaatgaaagccatcaatcatctacatagcaggctatttggaaacatccagatgttagagttttgaagatgatgcctagcgcaatctaatggaagtgttgytcaatttatgagccgtgatgatgccacctgaaaaatgagactgtcctgtaatcctggaggatgcaaataaagatgtgggccagtgcatttccagccaggatagcccaaatgggtgttaggtgaggccaatattcctctaccaatgaggctattttaaaaagtggattttgcattcctgcctactgtcaggatagtgacagccggctgaaccaccctaatgaattattttaaacagaagatgaaacattaacttaggaacctgagagagaggctttcactttcttaagatgaacctgtgac

SEQ ID NO: 143008 - DNA, 601 bp, Human
ctctacaacaggtacctcaacaacccctagtcacccatcttatgtttgattttaattctttacctgacccttatatttttttcttttgatttactcctcataaacccttcttgatgtaagctgcacaagagctggggcctggccacccacattgaccaccatgtctctagggctttgaagatacctggcacatgggaagcttcattaaatacacattagaaaacatagaagcacatgtacaaacaagaccacatcaatcattcagtagcaactcagagcgtcgtgctctcttgtctttgtmggaagtcttgagggggcgttcatcccccttcttaggaagatgtgaaagtattcccgggccacccaaacagtttaagcattgtatcttggcaacagactgtcatgtatcgatagacacacaagtaaagctttgaaatctttctctaaacttgtgaatgaagcaccaaataccatggacagagcagcagttgacctctcaggtggcccacactcttgggcctcactgcatggccacccatgttatcgatcagttgatcacatactggcacatcaggaccaccaattccaatcccaacagcta

SEQ ID NO: 143009 - DNA, 601 bp, Human
agaacctgcctctacaaaaatgaaaattaaaataaataaaaataatccatgtattagggaatttttaatatgaactcaatatttgatgattccatgaatttataatttttaggggtctgatattgcagtcttgttaataaaaaaagagagatacaggtcaggcatggtggctcacacctgtaatcccagtgctttgggaggtcggagtgggaggattgcttgagctcaggaattcaagaccaacttggacaacacggcaaaatctcatctctactaaaaaaaaaaaaaaaaaaaaaaaaawtttagccaggcatgatggtgcgtgcctgtagtcccagctactcaggagactgaggcaggaggatggcttgagcctggaagatcaaggctgtaaagagctatgatcgcgctactgcactccaacttgggtgacagagacagagagagagagagacagagacagagacagacagagagagagagagagaaagaaatagggatgaaatgatataaccaagatttgtttgaaaataattgagtaaacggaagcagggagtgaggggtagtgtatagatgaaacaggactggctgtgagtgggta

SEQ ID NO: 143010 - DNA, 601 bp, Human
cagagagcctcccttgagaaacagcacagataactgaaactttccaggaagaatttaagaacttcacatctcttaagtggacaaaacactctcacatacatttgactggctattactactacacaggcacaaaaaagataatgtcccaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaagtttccttttttwaaaaaaagagggagaggggctacttctgttctctgtaatgttgaatgctcaagagtggcagttgataacctaaccagacagaacgctccccatggtagttttctcctccaaagaaaagagcttagaagctttctctttggaacagaagagtcctctattcctttatttgctcactaagtcattagttaaactatccgttcatgcctcctaggtttcagccattctggatccaactggacaagtgagtcacaagcctgccctcatggaacttaccctccagtagatccactttaggtaaca

SEQ ID NO: 143011 - DNA, 601 bp, Human
taactatagttttcaagccttttgaaacattgtttatatactaggtccaaattcgtttgcattttttttctaaaagagggctccgctaataaaattttacaaaccaccgctctatctgatgtctatttctagattaaaagtggagcgcactcctcagagagcctcccttgagaaacagcacagataactgaaactttccaggaagaatttaagaacttcacatctcttaagtggacaaaacactctcacatacatttgactggctattactactacacaggcacaaaaaagataatgtccyaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaagtttcctttttttaaaaaaagagggagaggggctacttctgttctctgtaatgttgaatgctcaagagtggcagttgataacctaaccagacagaacgctccccatggtagttttctcctccaaagaaaagagcttagaagctttctctttggaacaga

SEQ ID NO: 143012 - DNA, 601 bp, Human
acagaaattgtctaaaacaaaatatagaaacaaaacagaagcttagttgatactatttaactaccttccacaattcttaattttgatctgttgatcaactctgttttgttctaattttttaacttaataagtaaatgttaaaaatctgaactcctaaaataactatagttttcaagccttttgaaacattgtttatatactaggtccaaattcgtttgcattttttttctaaaagagggctccgctaataaaattttacaaaccaccgctctatctgatgtctatttctagattaaaagtrgagcgcactcctcagagagcctcccttgagaaacagcacagataactgaaactttccaggaagaatttaagaacttcacatctcttaagtggacaaaacactctcacatacatttgactggctattactactacacaggcacaaaaaagataatgtcccaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaa

SEQ ID NO: 143013 - DNA, 601 bp, Human
ctcaatttcatttaaaatgctgtaataataaggcatgctcaaatgtgatatatgccaaaatttaacacactggcggccaggtgaactagttacgtggccaagttaaacagcttttgcgtagactttagcataaaacttctgccattttcacttaatggaagactcttctgggattgcaaggcaggctattaaaaccagtcctgtttggaactacttctgtatgaaagaggattatacagaaattgtctaaaacaaaatatagaaacaaaacagaagcttagttgatactatttaactaccytccacaattcttaattttgatctgttgatcaactctgttttgttctaattttttaacttaataagtaaatgttaaaaatctgaactcctaaaataactatagttttcaagccttttgaaacattgtttatatactaggtccaaattcgtttgcattttttttctaaaagagggctccgctaataaaattttacaaaccaccgctctatctgatgtctatttctagattaaaagtggagcgcactcctcagagagcctcccttgagaaacagcacagataactgaaactttccaggaagaa

SEQ ID NO: 143014 - DNA, 601 bp, Human
attccagatttgtttctaaaagcctaaaattaaaaaaaataataaatcaaaaaaggaagaaaaatcactactcaatgatgctagagctattaataaactctgcaagcaggaacatttgactcaaggggagggggtgcaagcaacgaaaactggtgggaagcagatggggttggggggagaaagtagctttgggccaagtggtgacagggcccaggagcctgactgaggctgcggtgcagggacataattctcagcgtctgaaagcatggctcggggtttctaggataaacagcagaaatayttcctttcacttataaatagaaagtgccatttttttccacatggaacgtcatcacttccatgttcacagtacggaggagaggagagtcctgagcagacagggcagggaccagagagagatgccccagccagatgttacactctcagggtggggaccaacagataccaggaagaagagggacaagaggcctccaaggggaggccaagacctctgcaatccacgaagtgactttacatgaaacaggattgcacattctatgcaaaggtcacccaatgtgggtgacagggagataccccgaca

SEQ ID NO: 143015 - DNA, 601 bp, Human
aaaaggacttaccacaggacgaacgaccatcccactgtcactaccaagtgtgcagtaaatctgtgcacacaagtgctattttcatgtgtgttgaaatacacatagtcaatcatttcaacagcacttatatcactgtagagtcgaagttggggaaaaaatttctctgggcagcgagaagtttttagggacattgattagaggaggctcaaggaactggggatatagggtgggtccacagaaccatggaccatggtagagctggactactgatgaccagtgatcaccagggcattaacaccakagcaaagaggccgggctcggccaggcccacagctttgggaggaaacgtggaggatgcctccccctaagatgtgctttgggctcaaaggattgactggagtttgccccagatgggagcagcttgaaatattattccagatttgtttctaaaagcctaaaattaaaaaaaataataaatcaaaaaaggaagaaaaatcactactcaatgatgctagagctattaataaactctgcaagcaggaacatttgactcaaggggagggggtgcaagcaacgaaaactggtgggaagcagatggggt

SEQ ID NO: 143016 - DNA, 601 bp, Human
tgcttggcaaacaacccactgatgtcatttcaaaaaaccaggggggaaggaaaaaggcacagcttcaaatcatctgtttctccttctttctttcgtctagcaaaatttttcttcctaatgaagcccgggggtgggggatgttaattactttaccactcactcatggttcccagaagaggccaacgcccgccctccaggagcacagggcagtgcgtgtgagccactgacggagagtgtccctggggacagtgtgcccagctgggactggaatgacccgggaactcagtcattccatttacgcccctaacagcccctgagagacttgcgtgggaaagctctgcagccagaggagctgcaagagaaaaacgtggcttggtctcctcccagcaggtagggggacaaaagcagggctcagccatactccagcctggggcccagccggctcagcctgacttctctctctgccaggaggttgaaatgtgcttacgtttggaataaacctgcctgaagatgaggccacgatcctgccaagatggtgcccacgatcctgcctaagtcccaacccatgccctgcccactttccacactgccactcatggca

SEQ ID NO: 143017 - DNA, 601 bp, Human
ggctggcagggctgcagccacgcccggccctgaaccaggcctgcgtgggctctccgcccccaactcacatcactgccccacgccacgtgctcccacgctctgtgtcacggcacccccgtcctgccccaggagcctgtgttctggctgccatcttctttgccccaatcccaaatgttctgaccgcaaagcatctgtgacccagaccaatcagtacaaaacactgacgactttccctttctcctgcctgtgtagaccccttcaccaccaagagcctgatcacaaaaaccaataccacgcgccyggaaagcctccattggcttaagtcattagcaagtatctaacaatagcaacacaatcatcactcagctgaagtagatagtattaggactctcatttcacagatgaggctcagagaggttaaattactggtgaaggtcacatagctaggaggtgacagctgatgccaaggaccatatgcttaatggctacctctagaggcaccaaccatggtggccttcacaggagaacacacacttgtgcttgtgctgtctgtccatccatccgcccacccatcacatatccatgtggcacctaccccagg

SEQ ID NO: 143018 - DNA, 601 bp, Human
gcgcctgtagtcccagctacttgggaggctgaggcaggagaatggcgtgaacccgggagacggagcttgcagtgagccgagatcccgccactgcactccatccagcctgggcgacagagcgagactccgtctaaaaaaaaaaaaaaaaaaaaaaaaaagccacacagtgaggaaacctgaaggagggtgtctaaaggaggatgaaggccatcagctgtgtagggaagaagtgctcggggtgacgcttacacagtcaaacaagacagaagccatgggcagtgtgggcggtgcagcctcacaycctgctccctgggtgctggctctgcgggaatcttccctccatcaaggtggtgatgttgaggcaggtggattctaataatggtaccatagttgttcaaagcaatgcctaatttttctttacagtttaagacaaatggcatggcaaggataaaaaatgaactcaccaaaaccaaagcaaaccccacgatacacaaaacaaaaccagccaatcctgtttccaggcacctggtaccctgttaacttcctgcccagtggcaacatgaagccccaaataaaagcatcacatttaaagaaaggacaa

SEQ ID NO: 143019 - DNA, 601 bp, Human
aaagccacacagtggggccaggcacagtggctcacacctgtaatctcagcactttgggaggccaaggcaggcagatcatgaggtcaggagatcgagaccatcctggctaacacggtgaaaccccgtctctactaaaaaatacaaaaaattagccgggcgtggtggcgggcgcctgtagtcccagctacttgggaggctgaggcaggagaatggcgtgaacccgggagacggagcttgcagtgagccgagatcccgccactgcactccatccagcctgggcgacagagcgagactccgtctaaaaaaaaaaaaaaaaaaaaaaaaaagccacacagtgaggaaacctgaaggagggtgtctaaaggaggatgaaggccatcagctgtgtagggaagaagtgctcggggtgacgcttacacagtcaaacaagacagaagccatgggcagtgtgggcggtgcagcctcacaccctgctccctgggtgctggctctgcgggaatcttccctccatcaaggtggtgatgttgaggcaggtggattctaataatggtaccatagttgttcaaagcaatgcctaatttttctttacagtttaagacaa

SEQ ID NO: 143020 - DNA, 601 bp, Human
ctgtccccttcctctgtaggaagggacatttttcaacagagcagacctgcctgaaagctttttaacattccaggtgtgaggctgagcagtccctacaagcatctgtctttcaataacaacctgccggaaataaacactgccaggtttccatgctgggaggggagaagacaagacagataaacacacatgagtgatagagagtaaattaaaaaatttaacagtttccattaaagaagactggtatctccttctgaatcaaaactgacttggcttgtcagagagagatcttatgcttaatgcaaaaaaaaaaaatccgtttccttatttatttatttttaattggaaaatactggaaatatatggatgaaaaaaagtcaaggagggcctgtaagtgtacttaagcatctatatacaaatgaaggtgtatgggaaatgaacaggatgtaccagaactgatattaaatgatggtgattagaacctaatgggcataagtgaaaccttgtgggatggctctcgtaacaggagcgtcaacggtgatggatgcaatctatacaagaacgacagccagggaaggagagatggaggggcggccatgcaggc

SEQ ID NO: 143021 - DNA, 601 bp, Human
ttttttggcatcaggctctaagaatcaacactctgaaagcaactctgggtattattaaaaatgactaattggagaatagagaccatttatgcttttgtatatttgaagatcttaccactgtttacagaaacaagaaaaatggggattgtgtggcaagaggcagcctgggaagggagggccaggctgcagcctgcgtgttcggcccctgctgggcagagtatggcccagctcaacaagaatgcaagcctgggggagcctctccatttgcctttttactttacctcacctccaacttgagcaytgacaggagagagcctgttacgagtccaaagtggccagggcctattaaggcctccccgagaaaatttcccctttcagccgtccctcctgtgggaacagcacagaacgccagagcatgaagtgaaaaatgctgccgttgtgtggtgagggacgggtcctgccatttttcctctcccaggcaaggccacttggccatttgaacaatttgtcaaaaccgcacaagaattacgggggtgggtgggggtcaagagaggagaaaaagggaggaaacgcctagagccagtattgcaacaagttccat

SEQ ID NO: 143022 - DNA, 601 bp, Human
cgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactacaggcacatgccaccacgcctagataatttttgtatttttagtagggatggggtctcactatgttgccyaggctggtcttgaactcctggcctcaagtgatcctccttccttgacctcctgagtagcagaactacaggtgcactccaccatccccaaataattaaaaaaaaaaattctagagataggggtctcgctgtgttgcccaggctggtctcaaactccccagctcaagtgatcctcttgccttggcctctcaaagtgttgggattacagatgtgatccactatgcctggacctacaaactctttttcacatggatcctttaagtaatcattttaccacaagaattctttttaccactagatggt

SEQ ID NO: 143023 - DNA, 601 bp, Human
ccttttccattttctcacccacttaatctctctgccatgtgaaagacctctctccacctgctggactaaacagtcagaggtcagcctaatgctcctacaggtaattttcccaccctggtggcttaccaaaacaaagtggccaaactgctaacaaactgctagcttgttttaaacaaaactgccttctcaaagatgacaacgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactacaggcacatgccaccacgcctagataatttttgtatttttagtagggatggggtctcactatgttgcccaggctggtcttgaactcctggcctcaagtgatcctccttccttgacctcctgagtagcagaactacaggtgcactccaccatccccaaataattaaaaaaa

SEQ ID NO: 143024 - DNA, 601 bp, Human
cattcatgcccatttgctctctgcgtgtatgataagcaaatgggcctcccgcactcctgcgggcctctagaagctgcctcttcagtaggaccgaagtgcaccaagtcaatgggacagagtgtgggaaaaacagaggcaggtctccctccaggggcgccattgccttcatccttttccattttctcacccacttaatctctctgccatgtgaaagacctctctccacctgctggactaaacagtcagaggtcagcctaatgctcctacaggtaattttcccaccctggtggcttaccaaaamaaagtggccaaactgctaacaaactgctagcttgttttaaacaaaactgccttctcaaagatgacaacgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactac

SEQ ID NO: 143025 - DNA, 601 bp, Human
cacaagaggaagggcctgggatccaaaccagcactgatgagtgggacatattgagctaactaaccctatggtagtccaggcaggaaacctcgaaggggtgaagactgagtgcagatgtgtgtgggagggtgggggcaggagaaagcaggcaggggctctacagctggagcatctatttactcatcagaagtgtaatattttcccaccttctcaggatgtcatttcttttccaatgggcaaactccagcgcatgaataaagctcgagacattcatgcccatttgctctctgcgtgtatgatragcaaatgggcctcccgcactcctgcgggcctctagaagctgcctcttcagtaggaccgaagtgcaccaagtcaatgggacagagtgtgggaaaaacagaggcaggtctccctccaggggcgccattgccttcatccttttccattttctcacccacttaatctctctgccatgtgaaagacctctctccacctgctggactaaacagtcagaggtcagcctaatgctcctacaggtaattttcccaccctggtggcttaccaaaacaaagtggccaaactgctaacaaactgctagctt

SEQ ID NO: 143026 - DNA, 601 bp, Human
tcctggaatgaggtttaccagaaacaagttttaattgtatataggacctcttctttgaaaaacaaaataacctatctgcttactttgaagatagagttaaagcttttcctttctccattttcaacctaattaacccaaggacgaccactgaagcaggtgggaaaggcggggtacactctgaccatcaagactgacacggaggatggcagctacaagtggcgtttgctggtgtctctgtggtgggtggaaggaaggactcggggatgtgcctcgctctcgttcctctaactcctgtgtaggkgcggcatcctgagactcattgtataccctgaccaatcacttgtcttctttaagccttggctggcacaactggaaaacgagggcagaacactctagcgtgtccaatcctcttggcattttgttatcaatgggaaacctctactggctgcaaatattctacagaatatgcaggctttattttgcaaatacaggtcaaatcaaatcccacaatataaaagatgactactaaggcctagaccacttatttcaaataaaatccagtgcgttataattctgctacaatagaaacttttaacggaac

SEQ ID NO: 143027 - DNA, 601 bp, Human
ggctagcataaggcagcacatagagtagggactttgcaagtggtggctcctgtttattatttccgtagtgcccttagcacacaaaatgcacgaaacatacgcaccaaacatcattcgcacgatcccattaaatgcttgtatgttgcttctccctcagctcaaaattcccaggagccacatgctgccttgcaacagaggacccaaagagaaactgctaccagttttcctcatcttatatatcactaaaccattaaacaaacaaacaacttacatagagcttacaacatgccaagcactgttyggagcttcccatagtcaaataatcctcgtagcaatcctacagaaataggtactatttttaatcttcatctcatctgaggaaaatgaggcacagaaaggtcaaggtaccttgagtggggtcacacagctaatgagtggcagagccaggattagaaatcaagcacccaaatcgtgacaacaaaggacagatggctcagaaggtcacccagtcttcaaactgtgtttgtgaaatccttttccccagctcacctggcgatctgtttaattgccgtgtgaaccatttgtttagctctcattcaac

SEQ ID NO: 143028 - DNA, 601 bp, Human
ctttaatagcaatcttctatagattcaaatcagggacgctccactgcactaattgctgtgttaggtgagcatcatagatttaaaaaaattaataaagtaaaatcccttcaggccaatcctttagaaaaatgaaaacactcaaactaccattctaactcaaaaatttacaaaaatatgaacgtcagggatttttgaagcattattgtggtgtcatttcaagttgagctatttccctgcttcccctccaacccgcatttttcaaaagcaccaataccctctggtcatctcgtcccaaattacyttaactagactcagcctggtactctgtggctggaaaccatgacgactacaggaattaaataaccatcttgctatgattctttgccaagagttcaatttttcccctaattattggtgataaagcatcacattaattgtatatcacttaacttattgcaaataatgattaattggataatcactgcattaatcattgctcagttgctgacacggggggctcttcattcgagaatacacacattcaaatctattctggtaaaagagaacaagggtcattttcatgtttcaaaagagaaaacca

SEQ ID NO: 143029 - DNA, 601 bp, Human
actcctggaggtggtaatcaccgaagtgctgatcctcttcctttttggcgtcctgaggtgagcccactgagggtctgggatgctgcctgacacttgaaccttgtggggaatccaaaggcagccaccacccccacctctcaaccatcagactcttagctaaaaagtaccactgacagcccctccatctaaatttccatctcccaaaccagcaacataatggaggagccaattaaatgattattaattcatgctactttccgtaagccagaggttctcatcgccttacattccgtaaaccagcttgccacctgccccagaaatttacagcaatcttttctctatctccgttgactagcgaaaaaagaaattcacatagctccatacttaatgtctgagttgggataactattccaacacacaagacacagatgtatcaccagatctgaaaatggtccttcagctcataattataattaaatggaaggtgaaatgtgtgtttcccatagctcctctctctcagcttctcatacctcatgctcccactagacagcagaaatgcaatgtttccagagggtcatctgtgcttttggattttgtgatc

SEQ ID NO: 143030 - DNA, 601 bp, Human
ctgctccttacaaatggcatcaagtcagttaacatctttgagcctcagtttccttatctgctgatgggaatgtgtcaaaaaaatttttttttctttctttttttaaagagatagagtctccctctgttagccaggctgcagcgcagtggcctaatcatagctcactgcaacctcaaactcctgggctcaagtgatcctcccaattcagcctcccaagtagctaggacaacaggtgcatgcaccactgtgccttgctaattttaaagtatgttttgtagagatggggtctcattatgttacmtaggctggtctcaaactcctggcctcaagcaatccccccaccacggcctcccaaagaactgggattagaggtgtgagctagtgtgcctggctcccttttacaacaaaaacagagtttgttatgaggatgaaatgagacataatgaaggtaagagcaatctagttcatgacctgctcagtaaaggtttgaagaatttgaataatgatttcttcatataaatggttagctaatccatgcctctgtcccctgagggcagagaggatgataagggaggttgagaaacacatgttcagcactttg

SEQ ID NO: 143031 - DNA, 601 bp, Human
tctgctcactgcaagctctgcctcccgggttcacgccattatcctgcctcagcctcctgcatagctgggactacaggcgcctgccaccacgcccggctaattttttgtattttatttttcagtagagacagggtttcaccgtgttagccaggatggtctcgatctcctgacctcgtgatccacccaccttggcctcccaaagtgctgggattacaggtgtgagacaccgtgcccagccttttttttcttttttcttttgagatggagtcctgctgtgtcacccaggctggagtgcagtagygcaatgtcagctcactgcaacctctgcctcccgggttcaagtgattctcctgcctcagcctccttagtagctgggattacaggaacccaccaccatgcctggctaatttttgtatttttagtagagacagggtttcgccatgttggccaggctggtcttgaactcctgacctcaggtgttccacctgccttggcctcccaaagtgttgggattacaagtgtgagcccccacgcctggccaggaaatgactttcatagcagcaccaacatagtcaaaagtaggacatcaccatcactggca

SEQ ID NO: 143032 - DNA, 601 bp, Human
aaatggaatagaaaatgcctggaggtgatatgtctgtgacctgcacattataacgtgcagttgtgaacagactacctctctgggaatcttcacgtgaaaaggcaatcaaattaacttattactccactgctaaaataatgctaagaaagaggtgagaataattctctttggtggtttttcctctaatgatcaggaaagggctttttttttttttttttgagacggaatcttgctctgtcacccaggctggagtgcagtggcgcatctctgctcactgcaagctctgcctcccgggttcacrccattatcctgcctcagcctcctgcatagctgggactacaggcgcctgccaccacgcccggctaattttttgtattttatttttcagtagagacagggtttcaccgtgttagccaggatggtctcgatctcctgacctcgtgatccacccaccttggcctcccaaagtgctgggattacaggtgtgagacaccgtgcccagccttttttttcttttttcttttgagatggagtcctgctgtgtcacccaggctggagtgcagtagcgcaatgtcagctcactgcaacctctgcctcccgg

SEQ ID NO: 143033 - DNA, 601 bp, Human
agtccctagactagatttatattaaaatagcaaaaataatcacctgagtaaaagaaaaatgtaggtcagtattgacaatgcttccctccccacatctctttctgttctttcaggctcccatggttctaggccatcagatgggaagtacaatgaggcctgttacttccaaggatgatgagaaagctgaggaaaccagtaacacagaaacccactggtccacagaaggaggttttcacttacagagaatctttacacactgttcaccagctgatttgaaaatacccacagaaagttaatttatcttcaaagatctctgaaaggcaactcatggctaggtcacctttgagcttcccattggctgctaaagttctcttgatgcatcatcaattatatattcttcatgactaaacatcacttacaacgttattcattaacgtttgcagaaccaaatggaatagaaaatgcctggaggtgatatgtctgtgacctgcacattataacgtgcagttgtgaacagactacctctctgggaatcttcacgtgaaaaggcaatcaaattaacttattactccactgctaaaataatgctaagaaagaggtg

SEQ ID NO: 143034 - DNA, 601 bp, Human
gcccgtgtctgagatacgggactagtctcccactctgacatttgggaggggctgctgaaatatataatttcttggtagaatctggagttataaggaacaccatcctgccacttatgccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagatattatttatttatttatttatttatttttcagatggagtttcgctctgttgcccaggctgaagtgcaatggcacaatctcggctcactgcaacctccgcctcccgggttcaagtgattcttctgcctcagcctcccgagtagctgggattacagatgtgcaccaccacgcccagctattttttttttgtacttttaatagagatggggtttcaccatgttggccaggctggtctcgaactcctgaccttaagtgatctgcccccatcagcctcccaaagtgctgggattacaggtgtgagc

SEQ ID NO: 143035 - DNA, 601 bp, Human
agcccgtgtctgagatacgggactagtctcccactctgacatttgggaggggctgctgaaatatataatttcttggtagaatctggagttataaggaacaccatcctgccacttatgccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagattttatttatttatttatttatttatttttcagatggagtttcgctctgttgcccaggctgaagtgcaatggcacaatctcggctcactgcaacctccgcctcccgggttcaagtgattcttctgcctcagcctcccgagtagctgggattacagatgtgcaccaccacgcccagctattttttttttgtacttttaatagagatggggtttcaccatgttggccaggctggtctcgaactcctgaccttaagtgatctgcccccatcagcctcccaaagtgctgggattacaggtgtgag

SEQ ID NO: 143036 - DNA, 601 bp, Human
gaaggaaatccatgtactcaagtgaactgcccttgatctactaggagaggtaacatataggttcataaatacatagttccaagctcttcctagtttggttcattattattttggattatgttctaatgcttttcaagattctatgaggtgagtggaccctaaagcctcaagggcacaccttatacagcccgtgtctgagatacgggactagtctcccactctgacatttgggaggggctgctgaaatatataatttcttggtagaatctggagttataaggaacaccatcctgccacttaygccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagattttatttatttatttatttatttatttttcagatggagtttcgctctgttgcccaggctgaagtgcaatggcacaatctcggctcactgcaacctccgcctcccgggttcaagtg

SEQ ID NO: 143037 - DNA, 601 bp, Human
ggttgctgattcttgaagggctctctttaacttatgcaggtgggagacagaattgtagtgtactagcaggatattcttttgagtgaaagattccttgcagacggtacacttgtaagggcgagaagggtctaggaacttttccatagtaaaattgggaccttttctgaaaggcagagctctctttggctctgagcccgagtcttcttgtactgacccagagtcactgcccgttgggctctgtttatcttccaagtcactctcttcctccttgtcttcctcaacaattatggtatggtcctcwgccagagtggggtctcccattgccaggaggtccccattggccagcaggccaccataaagctgttggatgtcagcctcactcagctccaggtggcttgtctcaaggtgcttcttcagagcctggaaagttcggaaactgcgctgacaaagacagcacatggtggcagctctgatcacatggtactgagaatggagctgcaacttttcaatggtcttgaaggccaggctacactgattacagcggtacttgtacacatggcgatctgacaccggcagctgaggcctcttggcatgcacttca

SEQ ID NO: 143038 - DNA, 601 bp, Human
ggccagttcctcagcctccgctgtaagctgcaagaaagcggaggaagctgtattattggctgatggtgctggggcgctgtaagcctgtgagggcatcggggtactgcaggatgagctggtaggcgtcaggatttccatggcatccatggaatcctcattttggctgtcgtcctgcccctcctcatcctcatccttgtaacacagcttcttctggtgcttgatgagatcaaagatgcgctgaaacaccaggctacattttttgcactggtagttcaagttgcttgttcgaatgtatctatcrtttgtaagctcacgccgctctccatctttgccctctccctgattctcataattcttcctggccttctgtcgggcattctgaaaccacaccactatcactcgggttggaaggttcagtaaattagagagttgctcaaattcatcatcctttgggtaagcattggcatcgaagaagtcctgtaagaccctcagctggtagtccgtaaaccttgttcttgaagacctcttgcttccccagtactcctgctttggaggttccggcgaagggggccgggagtcaatcttgagctcctccaggctg

SEQ ID NO: 143039 - DNA, 601 bp, Human
caagtagaacggccatcttgttaaaaacagccactattgttctggctagaagagaaccccaacattaaggatctaccacataagaccttctggtagttcttttttttttctttttttgagacagtctcgctgtgtcacccaggctggagtgcagtggcacaatctcaaaccactgtctgcctccagggttcaagcgattctcctgcctcagcctcccgaatagctgggactataggtgcataccaccacacttgggtaatttttgtatttttagtagagatggggtttcaccatgttggcmaggctggtctcgatttcctgaccttgtgatctgcccgcctcggcctcccaaagtgctgggattacaggcatgaaccactgcacccggccctgatagcagttcttttgccaccgtagctctctcaagaaggcagggaccccaggtgagggcaaagagttgatttaaatgctcttggaccagttttcttagggcataatccagaattagctaggactaactcaggtgtcttatatttacaacaaatatctagacaggatcagcatttccacaaggactgaatgaaagggtctatgataaaaa

SEQ ID NO: 143040 - DNA, 601 bp, Human
ccatttatagatttgccaactatatgctaagaaaaatactacagttaaaccaatgtgaaactagcagctgttaagaaaatgtaattaacagtggcttttgtctttccttagcatagggttgtatttctgtgtcacacatttgctagtggttaaaaaatacttcttgaagaccaaggaaatgagagtgtgtaagtgatgcacttgtaactccttaggagaaaatgactgaggaggtttgaaatggagataaaaattctcaagtaaaatctttctcattcagtcctcctctattcattcattkattttgagacagggtctgccgaggctggggtgcagtagcacaatctcagctcactgtagctagcctcaaactcgaccttctgagctcaagtagtccctgcacctcagtcccccagccccaagtagctgagactacaggcacatccccactatgcccggctaagttttgtattttttgtagacagggtttcgccatgttgcccacgctgcccatgctcgtctcaaactcctgagctcaagtgatctgcccacctcagcctctcgaagtgctgggattacaggcatgagccactgcatccgg

SEQ ID NO: 143041 - DNA, 601 bp, Human
tggcttttgtctttccttagcatagggttgtatttctgtgtcacacatttgctagtggttaaaaaatacttcttgaagaccaaggaaatgagagtgtgtaagtgatgcacttgtaactccttaggagaaaatgactgaggaggtttgaaatggagataaaaattctcaagtaaaatctttctcattcagtcctcctctattcattcatttattttgagacagggtctgccgaggctggggtgcagtagcacaatctcagctcactgtagctagcctcaaactcgaccttctgagctcaagyagtccctgcacctcagtcccccagccccaagtagctgagactacaggcacatccccactatgcccggctaagttttgtattttttgtagacagggtttcgccatgttgcccacgctgcccatgctcgtctcaaactcctgagctcaagtgatctgcccacctcagcctctcgaagtgctgggattacaggcatgagccactgcatccggcctactccatcatctttattccaaaaaagatttcaggatgggaaaagtttaaaggtgaaggaaagctgcaaagaaaaagtaaagttaaatg

SEQ ID NO: 143042 - DNA, 601 bp, Human
ccagacacacccacgcccccctctccagcctccttgccagcgccactcacctctaccaacccctcatctacacactcgcgcgcaatctctccgttcccagacacagacacacacacacacacacacacacacacacacacactcacctagtcccttctgcacccacgtccagcgcgcacccctgccagcggcgccagctgggattcggagacgacgccaggaaacgctatcctggtattttttcggaccgtctcatcgcccccttcccgacctccagaaccccaatccccagctagggggragatgaatgggaccctgtctttttttcctccctttccgtaattgaaccccccacttcagcggtgtctgcacccaaagccccctcgcgcccgcgccccggggtgaccgcgcacttgcagctccggggcgcttactcctggagtacgcggggctacaaagggcggtcctggcgctccagcggcaccgcacgggcggcccctttctgctccgcgtcgcgcctgggagaagagggcgcgggcttacctaacgcgagggagaaaggaaaggacggtgccgaggctggcggcccagcgccccgcgg

SEQ ID NO: 143043 - DNA, 601 bp, Human
cccagctccagctactaatttgacagaggcgtgacagcgtgtttcccccagaaccagccgcattccccaagcccagcccgaaatctcctcccgaggctgaatcagagaccgcggcggatcccccaggaacgtcgaagtaattccagctgttttcccccgtggagggcaggagcggccagcaccagaggcaggggaggggaggaaagcgggggagggtgggcggaggcgaaaatgacgccactcctagctccagccagctcaaggggccgccaaatgtccgcgagacccctctcgcccaggycacttctcccacgccgccgatgcgccaatcccgggttcctccgggggcgcaccctgcccagtggcgctcgcagacacttgctccggctcgcgtgttgcactgtgacacaccctggaccctccccccacacacacgcttacactcacacatgcacaccgccctgtgtgtgctacgggactgaagcgccaccagcctctcggatccacacccgttcccgacccagtctgcaagccagacacacccacgcccccctctccagcctccttgccagcgccactcacctctaccaacccctcatct

SEQ ID NO: 143044 - DNA, 601 bp, Human
acaatgctatctttctttcaggtccatgaggaggcaagttcaggccagcggatttcaacgtaacccaggggggccctcagctcagttgagatctgtcttctgtcatggggggggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcaatgaagatgcaatttcctttcgccyctccatagcaggcaggcaaaatcctgccaggaaccctttccactgccttcagtcccacccaggagcctctcacaaagctgagctccagctcagttcggcctgggcacatccctccccatccctgtgcctcattttccatctgtaaaatggaaagaagttggactaggtaggtcctgtgtgagttttttattccattccaaatgatcaaactttgttgctccaaaagaacttcctcacaagagacccaaacagacactccaggatccctcaaaagcaaaagccaacacctccacccatgca

SEQ ID NO: 143045 - DNA, 601 bp, Human
gcagctttgggccacccgaaaaacacaatgctatctttctttcaggtccatgaggaggcaagttcaggccagcggatttcaacgtaacccaggggggccctcagctcagttgagatctgtcttctgtcatggggggggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcartgaagatgcaatttcctttcgcccctccatagcaggcaggcaaaatcctgccaggaaccctttccactgccttcagtcccacccaggagcctctcacaaagctgagctccagctcagttcggcctgggcacatccctccccatccctgtgcctcattttccatctgtaaaatggaaagaagttggactaggtaggtcctgtgtgagttttttattccattccaaatgatcaaactttgttgctccaaaagaacttcctcacaagagacccaaacagacactccaggatccctcaaaagca

SEQ ID NO: 143046 - DNA, 601 bp, Human
gggagagagatgtcgtgtccctccctggccttccttccaggctgagtcaaacctgaaccctgcttgagtctcagatgctgagtcatcacgctttctctcccaggacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatgggggsggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcaatgaagatgcaatttcctttcgcccctccatagcaggcaggcaaaatcctgccaggaaccctttccactgccttcagtcccacccaggagcctctcacaaagctgagctccagctcagttcggcctgggcacatcc

SEQ ID NO: 143047 - DNA, 601 bp, Human
tggagggagagagatgtcgtgtccctccctggccttccttccaggctgagtcaaacctgaaccctgcttgagtctcagatgctgagtcatcacgctttctctcccaggacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatgtggggggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcaatgaagatgcaatttcctttcgcccctccatagcaggcaggcaaaatcctgccaggaaccctttccactgccttcagtcccacccaggagcctctcacaaagctgagctccagctcagttcggcctgggcac

SEQ ID NO: 143048 - DNA, 601 bp, Human
ctggagggagagagatgtcgtgtccctccctggccttccttccaggctgagtcaaacctgaaccctgcttgagtctcagatgctgagtcatcacgctttctctcccaggacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatggggggggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcaatgaagatgcaatttcctttcgcccctccatagcaggcaggcaaaatcctgccaggaaccctttccactgccttcagtcccacccaggagcctctcacaaagctgagctccagctcagttcggcctgggca

SEQ ID NO: 143049 - DNA, 601 bp, Human
tctgaagtccaactgtccgggttcaaagtctggctctcccacctgagccatatggcaacaggcaaatcctgaaactctcctggcctcagttgcctcatccattcaatggagcaatacgatccaggcaacgttcttgcgaggatgaaggcagatggagggagacagtggctgctctggagggagagagatgtcgtgtccctccctggccttccttccaggctgagtcaaacctgaaccctgcttgagtctcagatgctgagtcatcacgctttctctcccaggacaaggcctctgagtcacrtctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatggggggggggcagccccattcagtcaaaggccaactcagggggctgcagcctctaagcccctgcccttcaggctggctttgctaatctctcaagaacacctgatttacacttaaaaaaaatcattccg

SEQ ID NO: 143050 - DNA, 601 bp, Human
cccaacatgttgtcatggaaaaaaaacaaaggctctgaagtccaactgtccgggttcaaagtctggctctcccacctgagccatatggcaacaggcaaatcctgaaactctcctggcctcagttgcctcatccattcaatggagcaatacgatccaggcaacgttcttgcgaggatgaaggcagatggagggagacagtggctgctctggagggagagagatgtcgtgtccctccctggccttccttccaggctgagtcaaacctgaaccctgcttgagtctcagatgctgagtcatcacrctttctctcccaggacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatggggggggggcagccccattcagtcaaaggccaactcagggggctgcagcctctaagcccctgcccttcaggctggctttgctaatctctcaaga

SEQ ID NO: 143051 - DNA, 601 bp, Human
tatttacacattctgatggcatcatgtctgttactctcattttacagaaaagcaaactgaggcatggagctcctgactgccttttcatttgagcctgatttcttcaggcgccccaacatgttgtcatggaaaaaaaacaaaggctctgaagtccaactgtccgggttcaaagtctggctctcccacctgagccatatggcaacaggcaaatcctgaaactctcctggcctcagttgcctcatccattcaatggagcaatacgatccaggcaacgttcttgcgaggatgaaggcagatggarggagacagtggctgctctggagggagagagatgtcgtgtccctccctggccttccttccaggctgagtcaaacctgaaccctgcttgagtctcagatgctgagtcatcacgctttctctcccaggacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgag

SEQ ID NO: 143052 - DNA, 601 bp, Human
ttcatgacactattatgcaacctacataagcttagcaaaaagcaatacctaggtcaagcatttgcaggcactttcacagccttgggtaggtttaggacaaagggtcccagactctgcctgccaagaagatgccttgagaatgtcttctgcgggtgctactgacggcaaacacctacacgctgttttccacatgctcagtgctgttctcaggttacacagattaatatttacacattctgatggcatcatgtctgttactctcattttacagaaaagcaaactgaggcatggagctcctgaytgccttttcatttgagcctgatttcttcaggcgccccaacatgttgtcatggaaaaaaaacaaaggctctgaagtccaactgtccgggttcaaagtctggctctcccacctgagccatatggcaacaggcaaatcctgaaactctcctggcctcagttgcctcatccattcaatggagcaatacgatccaggcaacgttcttgcgaggatgaaggcagatggagggagacagtggctgctctggagggagagagatgtcgtgtccctccctggccttccttccaggctgagtcaaacctg

SEQ ID NO: 143053 - DNA, 601 bp, Human
gctccttctcaaaaggtgggcccagagggtgtgggtggcctccaagcgcaatgttggagggtggaaagggctcaggaggctcaccttgggcagaaccccactcactggactctggacagaagagtcaccagcctgagcctcaattttctgacctgagaggtggaaagaatgtcttctacctcagttagctgatgtgatgcattgaacctccaaggcactatagcaaacaagagctatttactgagcactcactaattccctggcactgtggacacagggtggcctgaaggtacagcggcaygtatgactacaccttccttcttctctcccctgtcattccagagcagaggttctcaactctgtctgcctgcaggataccccattcccaacccagccaaaggagctttgaaacaacagcatatcccctgatggagagagaatcgcaggagaccgggcctggaaatgtgcatttcagacaagattttcatgacactattatgcaacctacataagcttagcaaaaagcaatacctaggtcaagcatttgcaggcactttcacagccttgggtaggtttaggacaaagggtcccagactctgcc

SEQ ID NO: 143054 - DNA, 601 bp, Human
gcagccgccttcctgtggggcctcagtgtccccagcccttctgcctacctgcctgggctaagttctcagccaagaccgctatctagcctgcctctatctccaagttgaaagataaaaagcaagtggacacgcagtacttccatcacacagccatcaagggaggcaggaacaacagcctggggtggatccaggaaacaagctccttctcaaaaggtgggcccagagggtgtgggtggcctccaagcgcaatgttggagggtggaaagggctcaggaggctcaccttgggcagaaccccactsactggactctggacagaagagtcaccagcctgagcctcaattttctgacctgagaggtggaaagaatgtcttctacctcagttagctgatgtgatgcattgaacctccaaggcactatagcaaacaagagctatttactgagcactcactaattccctggcactgtggacacagggtggcctgaaggtacagcggcatgtatgactacaccttccttcttctctcccctgtcattccagagcagaggttctcaactctgtctgcctgcaggataccccattcccaacccagccaaaggag

SEQ ID NO: 143055 - DNA, 601 bp, Human
aagatctgggtcaaagagacctgcttatggccccgattgtgtaatccattcccattctgtagtgctggggcttacgccccacccgagggagcccaggtttcttttcacatggcccccaccccgagaacacggctccaggttggcacctactcatggccctctacctctgcagccgccttcctgtggggcctcagtgtccccagcccttctgcctacctgcctgggctaagttctcagccaagaccgctatctagcctgcctctatctccaagttgaaagataaaaagcaagtggacacgcrgtacttccatcacacagccatcaagggaggcaggaacaacagcctggggtggatccaggaaacaagctccttctcaaaaggtgggcccagagggtgtgggtggcctccaagcgcaatgttggagggtggaaagggctcaggaggctcaccttgggcagaaccccactcactggactctggacagaagagtcaccagcctgagcctcaattttctgacctgagaggtggaaagaatgtcttctacctcagttagctgatgtgatgcattgaacctccaaggcactatagcaaacaagagct

SEQ ID NO: 143056 - DNA, 601 bp, Human
ctccccacagatttaaagaaaggaaagattaaactgctggggagggcactcaaggcccccagactgttaaggagcctcactttctaccagctcagttgcaagaaaacccgctggactcaaaaggtcagagatggagcccaggcaggtagggcataggcaggtctgcaaacaatgttaggtgggaaagtcaaagatctgggtcaaagagacctgcttatggccccgattgtgtaatccattcccattctgtagtgctggggcttacgccccacccgagggagcccaggtttcttttcacatrgcccccaccccgagaacacggctccaggttggcacctactcatggccctctacctctgcagccgccttcctgtggggcctcagtgtccccagcccttctgcctacctgcctgggctaagttctcagccaagaccgctatctagcctgcctctatctccaagttgaaagataaaaagcaagtggacacgcagtacttccatcacacagccatcaagggaggcaggaacaacagcctggggtggatccaggaaacaagctccttctcaaaaggtgggcccagagggtgtgggtggcctccaa

SEQ ID NO: 143057 - DNA, 601 bp, Human
agaggccatagacccacctcttaaatggccctctcacatccatatttgaagagggttacttggaatcttcttaggttccgtgggggtggggcagagggtgaaggcaggagaacaaggtggagacctgggcccccacccacctctcttcaaacagaactctatgcagatttaaaatgtatagctgcagaaagtctccccacagatttaaagaaaggaaagattaaactgctggggagggcactcaaggcccccagactgttaaggagcctcactttctaccagctcagttgcaagaaaaccygctggactcaaaaggtcagagatggagcccaggcaggtagggcataggcaggtctgcaaacaatgttaggtgggaaagtcaaagatctgggtcaaagagacctgcttatggccccgattgtgtaatccattcccattctgtagtgctggggcttacgccccacccgagggagcccaggtttcttttcacatggcccccaccccgagaacacggctccaggttggcacctactcatggccctctacctctgcagccgccttcctgtggggcctcagtgtccccagcccttctgcctacctg

SEQ ID NO: 143058 - DNA, 601 bp, Human
agagggaggtgtcaggaatctcgtcagggcccacctcttttctgcaatacaaccgagatcttcctggagattctcagtggagttttggcagcacgagtaatttgtttggcagacagaagacgaccgtctgaggggacgaggtgaataactggaagtccaaaggaggacactggtctccttagaggattattttgtgaaattgcaagacaggcatgagctgcgctggatggtctgagataatttgtggaaatcacacaaacggagccagtgttagcagaggacgaggaaatggcttcctcayacagaaccctttgtcccgagatgggatgctagccacgctaacaggatccttccccagaatggtcttgcagtttccaccctccggaatgggcctccgatcttgtctatgcaagatggtccaagttacttccttaatcagtggagatgtcctttccaccaccactaacacaacacctactaaggacaggctctcaggtttcatgggagacatggacaggtcccaggaaggacccaacccagcctcccctccagcagaggacagccaaggaggcctttctggagaaaggaggagagttccatg

SEQ ID NO: 143059 - DNA, 601 bp, Human
agcaccatttctgcctgaacctcaaggaaaaccaccttgagataggccctggatagccctgccttactgtggatacaatcctttgtcatttctttgcccaaagagattttgaagtcaagctacaaagcagttcatgggctctcttggtgttttctggcccttctgaaactcaaggccctggggagggtgaggaagttggcagtcttcacgaactgtctttcttaactaatcaactcagcaaacaatatgggtggattcactggaccttcaagaaagttccctagtttagaggttagggaamtgtatcagagcaatcagaatcaaggaaacagtacaaatgtcagagaacaaaaccacagtaggaactcctcgagggcccctgtactttgcagtggagcctgaaacccaggaggcatcagtgatgtttgatattcaaggaatgaaaaagggatcactaagaaggtgaaccccactgtctccctctcaaacaagccaaagccgcattcactccctgggtgtgggtccagaggggctggagctgaaactgaactgctgtgtgttcaacttgagcacagcaccagggaggtcagcaagagtgtcc

SEQ ID NO: 143060 - DNA, 601 bp, Human
aatgctttggaaaagcattcactcagcacactgtttcacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggaggccttcagtgaagcagataaagggagagcaggcgggaaytgctgacaagggtagcatcgattgtcaccaacagcaactggcccagattccaccctctgtaacatgcctggttttaaggccacatgaaagccagtgttctctccagcacattgtgctctttatagaacagatttttaaaaggagggaaaaaatcaacatgtgctgtggctgtttgctgtagcaacttccccagaaaattgccgagaacagcaccatttctgcctgaacctcaaggaaaaccaccttgagataggccctggatagccctgccttactgtggatacaatcctttgtcatttc

SEQ ID NO: 143061 - DNA, 601 bp, Human
ttcagctcccccatagtaccttcctaagacggccaactcaatgctttggaaaagcattcactcagcacactgtttcacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggargccttcagtgaagcagataaagggagagcaggcgggaattgctgacaagggtagcatcgattgtcaccaacagcaactggcccagattccaccctctgtaacatgcctggttttaaggccacatgaaagccagtgttctctccagcacattgtgctctttatagaacagatttttaaaaggagggaaaaaatcaacatgtgctgtggctgtttgctgtagcaacttccccagaaaattgccgagaacagcaccatttctgcctgaacctcaaggaaaaccaccttgagataggccctgga

SEQ ID NO: 143062 - DNA, 601 bp, Human
taaatatatccacagtcctcaccaccacccgtggcccagatacaacgttgtaaggtgggctgcacgtgaccatgaggctttcagcgtgtggaggtcagctgggacagtcacatgcctctcctccaccctgcagtcaccactgagccatcatgagcaggcttgagcttttggcaaaaccagcatcttgaacttttctcccttcacaacacccagaaggttctctgttttcagctcccccatagtaccttcctaagacggccaactcaatgctttggaaaagcattcactcagcacactgttycacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggaggccttcagtgaagcagataaagggagagcaggcgggaattgctgacaagggtagcatcgattgtcaccaacagc

SEQ ID NO: 143063 - DNA, 601 bp, Human
cacattgccctaaatatatccacagtcctcaccaccacccgtggcccagatacaacgttgtaaggtgggctgcacgtgaccatgaggctttcagcgtgtggaggtcagctgggacagtcacatgcctctcctccaccctgcagtcaccactgagccatcatgagcaggcttgagcttttggcaaaaccagcatcttgaacttttctcccttcacaacacccagaaggttctctgttttcagctcccccatagtaccttcctaagacggccaactcaatgctttggaaaagcattcactcarcacactgtttcacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggaggccttcagtgaagcagataaagggagagcaggcgggaattgctgacaagggtagcatcgattgt

SEQ ID NO: 143064 - DNA, 601 bp, Human
caatgatctcacattgccctaaatatatccacagtcctcaccaccacccgtggcccagatacaacgttgtaaggtgggctgcacgtgaccatgaggctttcagcgtgtggaggtcagctgggacagtcacatgcctctcctccaccctgcagtcaccactgagccatcatgagcaggcttgagcttttggcaaaaccagcatcttgaacttttctcccttcacaacacccagaaggttctctgttttcagctcccccatagtaccttcctaagacggccaactcaatgctttggaaaagcrttcactcagcacactgtttcacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggaggccttcagtgaagcagataaagggagagcaggcgggaattgctgacaagggtagc

SEQ ID NO: 143065 - DNA, 601 bp, Human
taaagcaaccttaaagggaatgttgacaatgatctcacattgccctaaatatatccacagtcctcaccaccacccgtggcccagatacaacgttgtaaggtgggctgcacgtgaccatgaggctttcagcgtgtggaggtcagctgggacagtcacatgcctctcctccaccctgcagtcaccactgagccatcatgagcaggcttgagcttttggcaaaaccagcatcttgaacttttctcccttcacaacacccagaaggttctctgttttcagctcccccatagtaccttcctaagayggccaactcaatgctttggaaaagcattcactcagcacactgtttcacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggaggccttcagtgaagcagataaagggagagc

SEQ ID NO: 143066 - DNA, 601 bp, Human
cagcaccaggaacagtatctgtggcactaactggactctaaacccggtacttcctttaagcctcacagaaaccctaggagggaggtgccagcatgtcaccatttaacagacggggaaactgaggcatcaagaggttaagatgtgtgccccaagtcagcaagcatcaagctggctgctttaaggttaaagcaaccttaaagggaatgttgacaatgatctcacattgccctaaatatatccacagtcctcaccaccacccgtggcccagatacaacgttgtaaggtgggctgcacgtgaccrtgaggctttcagcgtgtggaggtcagctgggacagtcacatgcctctcctccaccctgcagtcaccactgagccatcatgagcaggcttgagcttttggcaaaaccagcatcttgaacttttctcccttcacaacacccagaaggttctctgttttcagctcccccatagtaccttcctaagacggccaactcaatgctttggaaaagcattcactcagcacactgtttcacttgctcctcaaggaggttgccccgggagaggctgggtattatacccagttcacaaatgggtaacctga

SEQ ID NO: 143067 - DNA, 601 bp, Human
gagacagggtcttgctatgttgcccagactggtctcaaactcctgggttcaagtgatcttcctactccggcctcctgagtagctgagattacaggcatatgccaccatgcctggctatctaacctctttgcctcagtttgcttgtctgtcaatgggcatgctaactcctgctcccaatgatcagcagtggggcttaaattcaagaatggcatggagaattaagcaaacagttgcttaattcatcaacatactttcctttcagggttgccttggagatgccaggacatctgtgaggatgtgkcctgggtttcagtcctagagtcccagcgaggagagggacacatggaaaatgctcagcaaatgccaccaaggtttctgattatcaggcccagtgcgtcaccactggggcccttctctccaccagcactgtctgtcaatgagtaatgagggcccaagaggggctacacaaatacccttccagtccagcagacccaggagagtcagaggagagctggatcacaggtgccaggcaaagccaaggccaggatctgcccgaggaagaaaagaacgtgacccgtgaccctgggacctgggagggcag

SEQ ID NO: 143068 - DNA, 601 bp, Human
cctgagaatcatggaaggacccagttctggcagaagctgctgtcttctggtgtctgtgatctccttctgccagcaggaaatggcaggtgatacgtgacctggtttggcggctcgagctggtgcttccactcctgctccctcctcccgggcacctgaggccctcacggcttagcaagtgtggcaggtggagcctgtccctgggcttgaggtccttgctggactccagctcctgccctccctctgcctcatgcaaagtcctaatcacagaatgttgggacccactagaaagcatcaaagaggwcctccagcaggtggggtggcaaggcagggccacacacagcatggcgggggaaccagggctgactcctagcccaccagccccacctttggagtggcttgggactgacaaaccgtgtctccatctccaaggccatctttgctccccaagaagcacagaagaaacccctccagcaggtctccttcagctaaaacccagcttagcaccaaaaacagggctccaggtcacagcaccagctgccagcctgtatcttcacttcttttcccatccacctgcctgggaggaattccgagaagaccaatg

SEQ ID NO: 143069 - DNA, 601 bp, Human
acctgagaatcatggaaggacccagttctggcagaagctgctgtcttctggtgtctgtgatctccttctgccagcaggaaatggcaggtgatacgtgacctggtttggcggctcgagctggtgcttccactcctgctccctcctcccgggcacctgaggccctcacggcttagcaagtgtggcaggtggagcctgtccctgggcttgaggtccttgctggactccagctcctgccctccctctgcctcatgcaaagtcctaatcacagaatgttgggacccactagaaagcatcaaagagrtcctccagcaggtggggtggcaaggcagggccacacacagcatggcgggggaaccagggctgactcctagcccaccagccccacctttggagtggcttgggactgacaaaccgtgtctccatctccaaggccatctttgctccccaagaagcacagaagaaacccctccagcaggtctccttcagctaaaacccagcttagcaccaaaaacagggctccaggtcacagcaccagctgccagcctgtatcttcacttcttttcccatccacctgcctgggaggaattccgagaagaccaat

SEQ ID NO: 143070 - DNA, 601 bp, Human
agagatcctcagctcagcactgctgacatttgggccccacaagcagcctctgccttaggggctgccctgagcacgggaggaggctcagcagcatccctggcctctgcccaccacatgcccacagcatacaccccacgctgcgaccagcaaaagaatctgcaaacgttgccaaatgtcccctggtgcgacatccaccctcctctggaatagctgattttagtaattcctagtaggtaacagtatccagaaaatgtcagttggatgcattcttatttaatctagtgcatgcgtgcacacacgaacacacacacacacacactctcaaatgcactcacacattccctcacactgacacacttgcaaactttcattctcacactcagacattctcacattcacacacttatactcacacatacatacattctcacaaacacactcattctcacatactcacactttcttacacactgatacattctcactttcatggactctcacatccacagtcatttatactcacacgcactcacacgcacacgtgcactccccaccaccttcattcacggaggagggggctgggcccaagcggctgccagct

SEQ ID NO: 143071 - DNA, 601 bp, Human
ttctatgtgcccaacacagagctcagaacaaaaataacaccagctatggtgatgagactggctatgggactcatctggggatcatgagcaaacagacccagttcctgcccccacggagctcacagtcccgaggggacaggcactcccttgggctcactcatcaggctgcatctgggctgtgtccactgtctgtctgtccccctggagggcagagcagatgctgtctggacagcatccaggacagcatctgtgcctcctggacagagatcctcagctcagcactgctgacatttgggccccrcaagcagcctctgccttaggggctgccctgagcacgggaggaggctcagcagcatccctggcctctgcccaccacatgcccacagcatacaccccacgctgcgaccagcaaaagaatctgcaaacgttgccaaatgtcccctggtgcgacatccaccctcctctggaatagctgattttagtaattcctagtaggtaacagtatccagaaaatgtcagttggatgcattcttatttaatctagtgcatgcgtgcacacacgcacacacacacacacacactctcaaatgcactcacacat

SEQ ID NO: 143072 - DNA, 601 bp, Human
ggccagcctgtagggtgggaggagagcggctccctcacctcagttctcccgagttgggcccatcaagcagcccttaccttgtccctgatgcctcaaccaaaaaacttttcaaactttttttgcaggagcttttatccaaaggaaatcatgtaaggaagttcaacatataaaaatgttaaaaaataaaaattttaaaatttaaaaagccaaggtgcttcggctcaagccagggaaaggggcctgaaccccactccaccccaggacttggctccctacaatctgcccactcccagcccccacrccaccaggctggccctcaaagaacatctgagttcacggaagcaggatggaaaactcaggatttattcagaggtttctacccactaggttctatgtgcccaacacagagctcagaacaaaaataacaccagctatggtgatgagactggctatgggactcatctggggatcatgagcaaacagacccagttcctgcccccacggagctcacagtcccgaggggacaggcactcccttgggctcactcatcaggctgcatctgggctgtgtccactgtctgtctgtccccctggagggcaga

SEQ ID NO: 143073 - DNA, 601 bp, Human
gcttccagaaaccgtgatcacattaggacatagtgtctgtcagtctccaccagctctctcgttctccagaacagaaaagacagaaatgtccaccttccccgtttcctctatctggtgaaacctctttaccctacccggcaccttttttattcctacagcttagcttcccagaccacatgaggcaatgggttaaaaaaatcgctgtgtgtcctagaaatatcaagttcttgagcatctgcttttgggagctggtggggccttctctgacccagccccctcactgctaaaggcctttgggaagtccagagataaaactgctgaggatgatcacggggtatatctaaactaggggggattttctctcccaggggacatttggcaatgtctagtgacattatttattgtcccccaaatgattccattgattttgaaccatttaggaagtgtcctagactctgaagtctgccgggagactggataaagctttgcactagtctggggggactgtgggggctgcaggcctcggggtagcctgcatgttggtcgcgtcctgcaatactaaggccgcatgaaccaaggactgcagaaggtgctctctgca

SEQ ID NO: 143074 - DNA, 601 bp, Human
ctatgtgcacatgtgcctgtgatggggtagccaggaagatctccactcacctcccctttctccaccaaaggcttcacctcagcgaggtctacatcctgcatctcccgagacatgtccctgctgtcacctgcctgcaaggagacaaaggccaaaaggtcaacacttcctgctgagaggtttcctaaaggaagcaaatccaagaccaatggcaagaaggccaggcctgcgctctgcccagcagcttcacctccctcgtgatgcactgcaggggatgaggaggccccttgtacacacagcccayggacccaacccagtcttcccattggggccagcgcagtggatttcctgggagaggatactgaggctcacagacaccaccctcccaatgaaatggatagatcagcctcacaaacaggtccccataccaagttcaggcccacccaccatacccaggatgcagctcactgcattctagaaggggacctgcattgctgatcccaaagtcaggcagcccccgtgtgacaatgaaaggggaacacaagctcacacgatgcttaccacgtataggcatagtgcaagcttcagcctcacagttagccct

SEQ ID NO: 143075 - DNA, 601 bp, Human
tccggtgtgcctgtgtgtgtctatgtgcacatgtgcctgtgatggggtagccaggaagatctccactcacctcccctttctccaccaaaggcttcacctcagcgaggtctacatcctgcatctcccgagacatgtccctgctgtcacctgcctgcaaggagacaaaggccaaaaggtcaacacttcctgctgagaggtttcctaaaggaagcaaatccaagaccaatggcaagaaggccaggcctgcgctctgcccagcagcttcacctccctcgtgatgcactgcaggggatgaggaggycccttgtacacacagcccacggacccaacccagtcttcccattggggccagcgcagtggatttcctgggagaggatactgaggctcacagacaccaccctcccaatgaaatggatagatcagcctcacaaacaggtccccataccaagttcaggcccacccaccatacccaggatgcagctcactgcattctagaaggggacctgcattgctgatcccaaagtcaggcagcccccgtgtgacaatgaaaggggaacacaagctcacacgatgcttaccacgtataggcatagtgcaagct

SEQ ID NO: 143076 - DNA, 601 bp, Human; identical to SEQ ID NO: 33940

SEQ ID NO: 143077 - DNA, 601 bp, Human; identical to SEQ ID NO: 33941

SEQ ID NO: 143078 - DNA, 601 bp, Human; identical to SEQ ID NO: 33942

SEQ ID NO: 143079 - DNA, 601 bp, Human; identical to SEQ ID NO: 33943

SEQ ID NO: 143080 - DNA, 601 bp, Human; identical to SEQ ID NO: 33944

SEQ ID NO: 143081 - DNA, 601 bp, Human; identical to SEQ ID NO: 33945

SEQ ID NO: 143082 - DNA, 601 bp, Human; identical to SEQ ID NO: 33946

SEQ ID NO: 143083 - DNA, 601 bp, Human; identical to SEQ ID NO: 33947

SEQ ID NO: 143084 - DNA, 601 bp, Human; identical to SEQ ID NO: 33948

SEQ ID NO: 143085 - DNA, 601 bp, Human
gaagttctgacccagccctcggctgagagagcccagcccgttctcctgagagcctattcttggacacagctgagctgcaccccctggcccaccctgcaatcctgagtgggaatggagatacttcagttctgggccagtaaaccacagagaaggctggtttcagtttcccaagtggagccaagaacatcaagcttttgcttccgttccctcccctcacagggtcccaagccagcccagcatcacaccattttccccacacacgccccaccgttctggccagctctttgggactgaaacaggyggtgtctctgtcctgctttcgtgggaagtgactggttcctgattctctggccagcactcaagtcagcttctgtctgggagcagcagctgagggtgaggacctagctgagaccactgccttctctccccttgcccgcaatgtttgcacaatgatctacttaaaccaatggaaagaaaaaggaaaaagagaagacgggatgaggaaggggaaggaaagccacatcctctacttgcctggacatcaaactcttgcaggaggccggtgatggtctgtgaaaagacaaaaaaaattgtcaatttc

SEQ ID NO: 143086 - DNA, 601 bp, Human
ttagatttcctgaagttctgacccagccctcggctgagagagcccagcccgttctcctgagagcctattcttggacacagctgagctgcaccccctggcccaccctgcaatcctgagtgggaatggagatacttcagttctgggccagtaaaccacagagaaggctggtttcagtttcccaagtggagccaagaacatcaagcttttgcttccgttccctcccctcacagggtcccaagccagcccagcatcacaccattttccccacacacgccccaccgttctggccagctctttgggrctgaaacaggcggtgtctctgtcctgctttcgtgggaagtgactggttcctgattctctggccagcactcaagtcagcttctgtctgggagcagcagctgagggtgaggacctagctgagaccactgccttctctccccttgcccgcaatgtttgcacaatgatctacttaaaccaatggaaagaaaaaggaaaaagagaagacgggatgaggaaggggaaggaaagccacatcctctacttgcctggacatcaaactcttgcaggaggccggtgatggtctgtgaaaagacaaaaaaaa

SEQ ID NO: 143087 - DNA, 601 bp, Human
cctcgcctcgggatggatgggggagcattcatgaaatcagagattcaagaggaaaagcggagttgttttgaggtaaggaggtagaatagaggagtgagatgcagagtgcagaatgggtcccaaactggggacacctgtgcaacacatgggtagcggttcaggtgagaacacctcagccacctctggctctctggctggtccaggagtgcgcctctcctccttcaaggagaccacaagctcgccatatgctcaggctttctgccccaccctccagaggccagcacagcatgggacccacccsagcttggggctaacgagtccaggacttagatttcctgaagttctgacccagccctcggctgagagagcccagcccgttctcctgagagcctattcttggacacagctgagctgcaccccctggcccaccctgcaatcctgagtgggaatggagatacttcagttctgggccagtaaaccacagagaaggctggtttcagtttcccaagtggagccaagaacatcaagcttttgcttccgttccctcccctcacagggtcccaagccagcccagcatcacaccattttccccacacacgcc

SEQ ID NO: 143088 - DNA, 601 bp, Human
aggtcagggtgatctctagggacagcctgacacaaccaggatgatgagaaaatacacaccttggtggtggtatagaaagcctcgatcatctactagccaatgcttccagcccctctcccatcctttcctttccttccaaagacagtgcaagattcctcgcctcgggatggatgggggagcattcatgaaatcagagattcaagaggaaaagcggagttgttttgaggtaaggaggtagaatagaggagtgagatgcagagtgcagaatgggtcccaaactggggacacctgtgcaacacaygggtagcggttcaggtgagaacacctcagccacctctggctctctggctggtccaggagtgcgcctctcctccttcaaggagaccacaagctcgccatatgctcaggctttctgccccaccctccagaggccagcacagcatgggacccaccccagcttggggctaacgagtccaggacttagatttcctgaagttctgacccagccctcggctgagagagcccagcccgttctcctgagagcctattcttggacacagctgagctgcaccccctggcccaccctgcaatcctgagtggg

SEQ ID NO: 143089 - DNA, 601 bp, Human
agccctcaccaacatcattaaaacctacacaagcagcaaggggagcactcagggctggaagaggtgaggcccagagtctggcaccacttccccaatcactgctgagtgaccccaggcaagtcacttcccagtgctgtctctcttcttcttttttttttttttttttttgagacagagtttcactcttgttgcccaggctggagtgcaacgacgtggtctcagctcactgcaacctctgcctcccaggttcaagcaattctcctgtctcagcccccaagtagctggggttataggtgcttaycaccatgcctggctaatttttgtatttttagtagagacagggtttctccttgttggccaggctggcctcgagctcctgacctcaggtgatctgcctgcctcggccttccaaagtgctaggattacaggcatgagccactgcatctggcccttcttcttaaacactgaggtcagggtgatctctagggacagcctgacacaaccaggatgatgagaaaatacacaccttggtggtggtatagaaagcctcgatcatctactagccaatgcttccagcccctctcccatcctttcctttcct

SEQ ID NO: 143090 - DNA, 601 bp, Human
tatatgtcccccaaaactgaaagcaggatctcaaagagatatctgtacacatgttcacagcagcagtattcacaatagcccaaagtgcccaaagtgtccaccaacggacaaatggataagcaaaatgtggggcatacatacaacagaatatgattcagccttaaaaaggaaggaaatgctgacacctgctacaacagggatgaaccctgaggacacgatgctaacttataccagccagacactggcaaagaacaaatcaatgcaaattaatacagttttataataataatatagtgtatgmctgcacttgtatgaggtacttagaggaatcaaaatctagagtaatcaaaatcacagagacagaaaatagaaggatgactgcctaaagctagaatgaggagttgtttaatgggacagagtttcagttctgcaggttttaaagttccaggggtacagtggctcaagcctgtaattccagcactttgggaggctgaggcaggtagatcacttgaagtcaggagttcgagaccagactggccaacatggaaaaacccatctctactaaaaatacaaaaattagcccggtgtggtggcgggcacc

SEQ ID NO: 143091 - DNA, 601 bp, Human
ttagccgaccccagcctgagccacataggttgaccttccctgggagtaggtcagttgcctgtgtcctgagatgggagaatgtaaaagtgttttgcagactttccagagaaacaaaaatgtgaggaattatcttcacagggagcagataaactatgctttctaggtttctcagaattggtaaccaagattttaaaatccaaaataaccatatgatccagtgatagggtttggctgtgtccccacccaaatctcatcttgaattgtagctcccataatccccacgtgtcgtgggagggaaccmgtgggaggtaattgaatcatggggtcaggttttgcctgtgctgttctcgtgatagtgaatgagtctcaagagatctcatggttttataaagagcaagagatctcatggttttataaacggcagttcccctgcacacacacactcttgcctgccgccatgtaaggcgtgccttggttcctccttcaccttctgccatgaatgtgaggcctccccagccatgtgaaactgtgagtccattaaacctctttttctttataaattacccagtttctgatatgtccttatagcagcttgagaatg

SEQ ID NO: 143092 - DNA, 601 bp, Human
atagggaaaatgctccgacctcataggacagcttggggaattaactcagacagctcagcccaggctggtgcacaatgctgggaaatcttatcctgacctctgctctatccttccaaaggcttctctgtgtggcccccactttaatgatgtcctaaggggcagcgccttagccgaccccagcctgagccacataggttgaccttccctgggagtaggtcagttgcctgtgtcctgagatgggagaatgtaaaagtgttttgcagactttccagagaaacaaaaatgtgaggaattatcttcrcagggagcagataaactatgctttctaggtttctcagaattggtaaccaagattttaaaatccaaaataaccatatgatccagtgatagggtttggctgtgtccccacccaaatctcatcttgaattgtagctcccataatccccacgtgtcgtgggagggaaccagtgggaggtaattgaatcatggggtcaggttttgcctgtgctgttctcgtgatagtgaatgagtctcaagagatctcatggttttataaagagcaagagatctcatggttttataaacggcagttcccctgcac

SEQ ID NO: 143093 - DNA, 601 bp, Human
ccctaacctctctgtgcttcaggtcctctctctccgtaggatggggacaggatcgccgtaagcacacgtggggcacatttggcatgctgccagacacattctgtgctcggcagtgctgagctattattccagaatttaggttcctgaaaacacaggtcactgcctgtcatgctcatcactgcatccccagcacctaaactaatgccaggcacaaagtgggcatttgttaaagaaataaaggaaggcacaatagggaaaatgctccgacctcataggacagcttggggaattaactcagacrgctcagcccaggctggtgcacaatgctgggaaatcttatcctgacctctgctctatccttccaaaggcttctctgtgtggcccccactttaatgatgtcctaaggggcagcgccttagccgaccccagcctgagccacataggttgaccttccctgggagtaggtcagttgcctgtgtcctgagatgggagaatgtaaaagtgttttgcagactttccagagaaacaaaaatgtgaggaattatcttcacagggagcagataaactatgctttctaggtttctcagaattggtaaccaag

SEQ ID NO: 143094 - DNA, 601 bp, Human
aacagggctatactcaagcatcacggttgagagaactgtctacgtcagacagccctgggctcaatgtggctcacttcacagctgccgcccctgggaaagcctcagtttccttatctgtaaaggaaggatgatggtacaggtccccaaagattcagcaagagggcgtgggaggccctcagtgctggcctggctcatcagaggacactgaagtgcatggcagacaggtgctgtcctgtcgctttgctgcaactcccatgtgaatctgaggtcagattatgctgaccagtccccgggctgataygccctgtaggcccccttgaccaaagctctgtccttctcagttcctggccctggaacccatcaggccccagagagcttccgtcgtcacactgcactgcatcttctgaaggaaattctacagcaaccctacacccaagattttggagactgctgaaaatctgggggacgctttcatcaatctcttgagtccctaacaccttccaatctaagaagccaaatctaaatgaatacagttttagacaaagattttcttttggtaacaaccttgaaaagtgtcattcaacactcagatttcagctca

SEQ ID NO: 143095 - DNA, 601 bp, Human
tgtccttcctgcaacccggacacctaggccagcagcccgcccaccccgtgccctgagggttctggaatcttttcaggaaccagagccaggtgggggcctgacagcgctggcagaacctcatatgcaaatcaccaatcactttgcccgaacatcacccaggacaaaacaaagagaccgcctaaaggcgatgccagtgatggagagataaggcctgatgccatctgctctggcaggcgagctgtctccagagacaggccacccagcagctcaatgcagactccgccagcagctcctcagtgcygagctctgggctcagtgtgtgtgttttgattcatttaaaaaacaaaaacaataaaagcctaaattattgactacattggtaaaggaagtaggaatctgcctgagttagtcaaagtgctgaagcagtaattatttttcaaggaatgacatcggctgctttcagatacacaaaataaagcgactcagactccttagactggaccaggagggaagctatgcccagggcaagaactgcccaggagggagccctattttaacaagcaggtaagaaaccaactaaatgaatagataaaattcattt

SEQ ID NO: 143096 - DNA, 601 bp, Human
aattctagccaaagaaaataagctggaacccaaaatactccccccctccctactcatcaaatctgcaaacacaattgcctaaaacctgatgctggaggcctctcagccgagccagatcagaccgtgtccttcctgcaacccggacacctaggccagcagcccgcccaccccgtgccctgagggttctggaatcttttcaggaaccagagccaggtgggggcctgacagcgctggcagaacctcatatgcaaatcaccaatcactttgcccgaacatcacccaggacaaaacaaagagaccrcctaaaggcgatgccagtgatggagagataaggcctgatgccatctgctctggcaggcgagctgtctccagagacaggccacccagcagctcaatgcagactccgccagcagctcctcagtgctgagctctgggctcagtgtgtgtgttttgattcatttaaaaaacaaaaacaataaaagcctaaattattgactacattggtaaaggaagtaggaatctgcctgagttagtcaaagtgctgaagcagtaattatttttcaaggaatgacatcggctgctttcagatacacaaaataaa

SEQ ID NO: 143097 - DNA, 601 bp, Human
gggtcacatcagctcatttcccacagagccctggtgagcacacaaacacagattcccatggaaaccaaatcaaatctaaccatctgaataactcaagatccaggtggagggaattagaagcagcaaatccaacagaaaaagcaatttgaagccacagaaagtcactcggcccacgaggtacaatttatcggtgatgaagtcaactctgctgtcccttccccaaaactcgttaaatgaactttggctccagacgtgtggattgaatcagctttcaccatctatctcaccatggcgtgacacygggcaaatccctccagattttctgggcctcgtatcttcaacataaaacaaggatggcaaggatagatggcaaggatacctccctcaacaaggtttcatgaggatcacatgagcggatgcaggaaaatagcccagcacggtttctgacgtacagcagagctcaagagaggccagccattacgacttccatgactataacatttttcggaagcagatggatctaagtctaggactatctctacagtaccctttggcaagttccctaacatcttcaaatgggtctctcatctgcaaaagaggc

SEQ ID NO: 143098 - DNA, 601 bp, Human
aaaaggagggaaaacagcccccccaccgaatgggattgtacatccctaagaccagctcagctctgctgaacaagaggccttgcagcagaacgggagccagacctccagagccctgcccggccctggtgctgccccagccccctccaccactccacacggaggccctgtgggtcacatcagctcatttcccacagagccctggtgagcacacaaacacagattcccatggaaaccaaatcaaatctaaccatctgaataactcaagatccaggtggagggaattagaagcagcaaatccaacagaaaaagcaatttgaagccacagaaagtcactcggcccacgaggtacaatttatcggtgatgaagtcaactctgctgtcccttccccaaaactcgttaaatgaactttggctccagacgtgtggattgaatcagctttcaccatctatctcaccatggcgtgacactgggcaaatccctccagattttctgggcctcgtatcttcaacataaaacaaggatggcaaggatagatggcaaggatacctccctcaacaaggtttcatgaggatcacatgagcggatgcaggaaaatagccc

SEQ ID NO: 143099 - DNA, 601 bp, Human
acttctcgcttcattccccagtcttcttttatgttgacatcaggtcaagagaattaaacaaagttacagagggtcagggaacaggctgcagtgggcagaaggtgtcagcctgggaatacagcatgcaactggaacccacgctgaagacctcagttctccaaggaaacaagaattaggaagaacatctttgtttggattagggtgaagagatggagcagaccccatcatccatggagcaggggagggcgacaaagacctgtgagctgagcccgctgctgtgtgcattcagtgtttgcaatgygctcagggacagcgatgctccccactgtttcacagattaggaaactaagccccagggaggtcaagcgagtggccaaggacacgcgagtagcaaatgacagggctgggtctgcactcgctgccgctcactgcaccctttctgggacaccaggagatgagtgaggtcagcctggcagagcctggcctggacacacctcggaggcctgggtatgagccccacctctcctgttccattggagggtgctcctaggaaacccacagcagaattgcagaagtatgctgtgtttattttccaaagtct

SEQ ID NO: 143100 - DNA, 601 bp, Human
tctgataaagccagctttgtctcctgtgctatatcatgacagccattgaacagcctttggggctgaagtataggtgcccaatgagataacagaattaagattcaagatagataggtccttgggcttccaaagccaagactcccctgcaagcctcacacaatggaagaccttcaagaggtcaagctgggcctgtcacttctcgcttcattccccagtcttcttttatgttgacatcaggtcaagagaattaaacaaagttacagagggtcagggaacaggctgcagtgggcagaaggtgtcagcctgggaatacagcatgcaactggaacccacgctgaagacctcagttctccaaggaaacaagaattaggaagaacatctttgtttggattagggtgaagagatggagcagaccccatcatccatggagcaggggagggcgacaaagacctgtgagctgagcccgctgctgtgtgcattcagtgtttgcaatgtgctcagggacagcgatgctccccactgtttcacagattaggaaactaagccccagggaggtcaagcgagtggccaaggacacgcgagtagcaaatgacagggctgg

SEQ ID NO: 143101 - DNA, 601 bp, Human
gagcaagtctgataaagccagctttgtctcctgtgctatatcatgacagccattgaacagcctttggggctgaagtataggtgcccaatgagataacagaattaagattcaagatagataggtccttgggcttccaaagccaagactcccctgcaagcctcacacaatggaagaccttcaagaggtcaagctgggcctgtcacttctcgcttcattccccagtcttcttttatgttgacatcaggtcaagagaattaaacaaagttacagagggtcagggaacaggctgcagtgggcagarggtgtcagcctgggaatacagcatgcaactggaacccacgctgaagacctcagttctccaaggaaacaagaattaggaagaacatctttgtttggattagggtgaagagatggagcagaccccatcatccatggagcaggggagggcgacaaagacctgtgagctgagcccgctgctgtgtgcattcagtgtttgcaatgtgctcagggacagcgatgctccccactgtttcacagattaggaaactaagccccagggaggtcaagcgagtggccaaggacacgcgagtagcaaatgaca

SEQ ID NO: 143102 - DNA, 601 bp, Human
gtgtgatggctcacacctgtaactttgagtttgagaccagcatctgcaacataatgagacctcctttctacaaaaaataaaattagccaggcatggtggctcacgcctatagtcccaactactagggaggctgaggtaggaggatcacttgagcccaggaggtcacagttgcagtgagccgagatcacactactacactccagcatgggcaacaaagggagaccctgtctaaaaaaaaaaaaaaaaaaaaaaaaaaaaggagtaaagaacacataaagtaccagagataaccaggggaggtgtgtgtgtagccaggaggaacacgataaaaagacagccacccacttactgagcaagtctgataaagccagctttgtctcctgtgctatatcatgacagccattgaacagcctttggggctgaagtataggtgcccaatgagataacagaattaagattcaagatagataggtccttgggcttccaaagccaagactcccctgcaagcctcacacaatggaagaccttcaagaggtcaagctgggcctgtcacttctcgcttcattccccagtcttcttttatgttgacatcaggtcaaga

SEQ ID NO: 143103 - DNA, 601 bp, Human
aggtgtgatggctcacacctgtaactttgagtttgagaccagcatctgcaacataatgagacctcctttctacaaaaaataaaattagccaggcatggtggctcacgcctatagtcccaactactagggaggctgaggtaggaggatcacttgagcccaggaggtcacagttgcagtgagccgagatcacactactacactccagcatgggcaacaaagggagaccctgtctaaaaaaaaaaaaaaaaaaaaaaaaaaaaggagtaaagaacacataaagtaccagagataaccaggggaggtgtgtgtgtagccaggaggaacacgataaaaagacagccacccacttactgagcaagtctgataaagccagctttgtctcctgtgctatatcatgacagccattgaacagcctttggggctgaagtataggtgcccaatgagataacagaattaagattcaagatagataggtccttgggcttccaaagccaagactcccctgcaagcctcacacaatggaagaccttcaagaggtcaagctgggcctgtcacttctcgcttcattccccagtcttcttttatgttgacatcaggtcaa

SEQ ID NO: 143104 - DNA, 601 bp, Human
acaccgcctggaagctgtcaagtggggaaacaggacctaacaccaagcatgccttaaagatttcatctctttggctgtcaaccctggcttgggagctttaaaactatggcagactctgttggttggcatcccaaacatctgttgttcccttctttttgaggatagaattccaactgatgtactaagcagcaaagtgcctgataaagtggtccccttccttactcacctcccttgtaaccaaagatggtcaggaggttcagttctggccaatgaaatgccagcagaaaattcctgtagcttcaaggagagttttttaaaaagggtcaaacttgaccttttgattcttgtcctttcaccctcctgcctgcatcctacttggaacatggatgagatgcttgggggttcggtggctatcctaccaatctgaggaccaaagccgcatgctcaggtgacagtaggaagctgtaaggactaactccagctgggctgggtgacattcatagctggggtgttagctttctaggttggtgagaatagcaaacatttccttggcacagcactgttttttgagcaatacttatcctaatgatataaccaccac

SEQ ID NO: 143105 - DNA, 601 bp, Human
ttataggtaaagaagttgaagggactctcccaaggtcataggtttgtggtggtagaactaggattcgaactctctccgctgggcccttgctcctttgtgccagggtctgctggcccccatcggtcctccactcagttcctggccccccagcacacacaggaggaggaggaaaaaagcaagtgttgtcatcttccctgtacccaagtcccatcccctaagtcacacacacacacacacacacacacaacaaacacacccaccaacaaacacacgtgcacgcacgcggttctaagccagtcargaagactgtctgagattgaatgggagaattacaacactcacaaacacaggcctttgtcctattcagtcccaaaggaatgttctgtccttctgtccctgcggggatcaatcactcagtgttctggagagaggaacccatcccgtgtcttctatgttttcccaaagagaaagcacaaggaacccagaacatcagaactgcaaggtgcactgttcgtcctcttgcctgagagagcaaattgcctgtctcgaagctcatgagggaccccccaacttctggctgggacaaggctggcaacacaaa

SEQ ID NO: 143106 - DNA, 601 bp, Human
caggggttcccgacactcacttggagaaccccgaagccagccagccccaggccaccatcgtgcttctgcagaaaggagacaagcaccccagctcactcatggaccaatctctcacctgccatgttcatctaaactcctgcagagggtggtcgtgactctttctcaattgccacttcactcgcctgccctgggtttccgccctcctcaaggttacctaaaagttccctgttcctgaatggcacagggacgcagcagtggttaccaggtgagggtggtgacacataaagaggcactgtacagrgccaggcccagccccctgggagcacccgggcccgcccagcacggggtcatcctggcacctgcattagcccccaacaccgttaagtcccctggcacacagagctcagccccatctcccttctcccctctctgcccctcagggcccaacacttctttcctgcccataacaggcactggaaaaatccatagatgagggagcagtggcccagcttccagggggccggagatcatctgctgggcccagcccagccctgaagccactgtgggaacaaaggtccatttgtttgtgggggcacattct

SEQ ID NO: 143107 - DNA, 601 bp, Human
tcccttaagaccaacgattctcaacctgaggaacaagttcaaaaataaagaaaaatggcatccaattcccaggttcccccgcagcgtatgaaagctccgtactgagtttccaacaagaactcaccacctccccctccccagcggaggagtgcaggggttcccgacactcacttggagaaccccgaagccagccagccccaggccaccatcgtgcttctgcagaaaggagacaagcaccccagctcactcatggaccaatctctcacctgccatgttcatctaaactcctgcagagggtggycgtgactctttctcaattgccacttcactcgcctgccctgggtttccgccctcctcaaggttacctaaaagttccctgttcctgaatggcacagggacgcagcagtggttaccaggtgagggtggtgacacataaagaggcactgtacagggccaggcccagccccctgggagcacccgggcccgcccagcacggggtcatcctggcacctgcattagcccccaacaccgttaagtcccctggcacacagagctcagccccatctcccttctcccctctctgcccctcagggcccaacac

SEQ ID NO: 143108 - DNA, 601 bp, Human
cagttcctctgggtcctctgagaaaggagaaagaggatttaacccactggggggttgctgggaatgggaccaggaaagcctcctgaatcccttaagaccaacgattctcaacctgaggaacaagttcaaaaataaagaaaaatggcatccaattcccaggttcccccgcagcgtatgaaagctccgtactgagtttccaacaagaactcaccacctccccctccccagcggaggagtgcaggggttcccgacactcacttggagaaccccgaagccagccagccccaggccaccatcgtgyttctgcagaaaggagacaagcaccccagctcactcatggaccaatctctcacctgccatgttcatctaaactcctgcagagggtggtcgtgactctttctcaattgccacttcactcgcctgccctgggtttccgccctcctcaaggttacctaaaagttccctgttcctgaatggcacagggacgcagcagtggttaccaggtgagggtggtgacacataaagaggcactgtacagggccaggcccagccccctgggagcacccgggcccgcccagcacggggtcatcctggcacctgc

SEQ ID NO: 143109 - DNA, 601 bp, Human
agaagaagggatgggacagatcaccacttaggcaccctgtgggggcaagtcacctcctccccagcttgaatctttaaaacaggaacagcctggcccttcctacctcctagaggtgctgaaggcccagagaatgtaggctgctccatctgtgagtgaccccccgtgaagtggtacgaggcagccacccccacgccatccacacccgctggtgatcggattccacctctgctacttcttacccctgatacttaaggcagttcaatttcatctgagaaacattcattaggcacctattgtatgscaggtcccctttgtccccgcagggacgagtgggtgacaactcacaagctagtgggggcagtggaaatggccccggggggctgcagttcctctgggtcctctgagaaaggagaaagaggatttaacccactggggggttgctgggaatgggaccaggaaagcctcctgaatcccttaagaccaacgattctcaacctgaggaacaagttcaaaaataaagaaaaatggcatccaattcccaggttcccccgcagcgtatgaaagctccgtactgagtttccaacaagaactcaccacctcc

SEQ ID NO: 143110 - DNA, 601 bp, Human
tctgtagcagccacattgtcaccgtgaggcaagggcctgcctgaaagtatggccagcccagggatggaaaagagtgaaagacggtttggggatggcatccaccacctgggattttcagttacacggcccaccaacttccaatcccatgtaagccatgttgagttgaccaaaagattctgaatgataccatgcccatcctccctcctgcccttccttcttgttgagccagatggttctttgggtcaaggccaactctccagctcggccagtgacccccagccagcttactcccagtcatccstgcacctctccgcaccaaaccttcctaacagctgaagacctgctcacctttcttcctctggaaaacaaaaaaaaaaggcaccctgccttggttccaagcaccccagctcactcatggaccaatctgtcacctgccatgttcatctaaactcctgcagagggtggtcgtgactctttctcaattgtcacttccactcacccttcaccccatgcctaccctgggcttccgccctcctcaaggtcaaccagaagttcccgaggaccccagtcactcatctcccttgagcaatttccacatctg

SEQ ID NO: 143111 - DNA, 601 bp, Human
agcaaggttgggagggctggatctgtagcagccacattgtcaccgtgaggcaagggcctgcctgaaagtatggccagcccagggatggaaaagagtgaaagacggtttggggatggcatccaccacctgggattttcagttacacggcccaccaacttccaatcccatgtaagccatgttgagttgaccaaaagattctgaatgataccatgcccatcctccctcctgcccttccttcttgttgagccagatggttctttgggtcaaggccaactctccagctcggccagtgacccccagycagcttactcccagtcatccctgcacctctccgcaccaaaccttcctaacagctgaagacctgctcacctttcttcctctggaaaacaaaaaaaaaaggcaccctgccttggttccaagcaccccagctcactcatggaccaatctgtcacctgccatgttcatctaaactcctgcagagggtggtcgtgactctttctcaattgtcacttccactcacccttcaccccatgcctaccctgggcttccgccctcctcaaggtcaaccagaagttcccgaggaccccagtcactcatctcc

SEQ ID NO: 143112 - DNA, 601 bp, Human; identical to SEQ ID NO: 33949

SEQ ID NO: 143113 - DNA, 601 bp, Human; identical to SEQ ID NO: 33950

SEQ ID NO: 143114 - DNA, 601 bp, Human; identical to SEQ ID NO: 33951

SEQ ID NO: 143115 - DNA, 601 bp, Human; identical to SEQ ID NO: 33952

SEQ ID NO: 143116 - DNA, 601 bp, Human; identical to SEQ ID NO: 33953

SEQ ID NO: 143117 - DNA, 601 bp, Human; identical to SEQ ID NO: 33954

SEQ ID NO: 143118 - DNA, 601 bp, Human; identical to SEQ ID NO: 33955

SEQ ID NO: 143119 - DNA, 601 bp, Human; identical to SEQ ID NO: 33956

SEQ ID NO: 143120 - DNA, 601 bp, Human; identical to SEQ ID NO: 33957

SEQ ID NO: 143121 - DNA, 601 bp, Human; identical to SEQ ID NO: 33958

SEQ ID NO: 143122 - DNA, 601 bp, Human; identical to SEQ ID NO: 33959

SEQ ID NO: 143123 - DNA, 601 bp, Human; identical to SEQ ID NO: 33960

SEQ ID NO: 143124 - DNA, 601 bp, Human; identical to SEQ ID NO: 33961

SEQ ID NO: 143125 - DNA, 601 bp, Human; identical to SEQ ID NO: 33962

SEQ ID NO: 143126 - DNA, 601 bp, Human; identical to SEQ ID NO: 33963

SEQ ID NO: 143127 - DNA, 601 bp, Human; identical to SEQ ID NO: 33964

SEQ ID NO: 143128 - DNA, 601 bp, Human; identical to SEQ ID NO: 33965

SEQ ID NO: 143129 - DNA, 601 bp, Human; identical to SEQ ID NO: 33966

SEQ ID NO: 143130 - DNA, 601 bp, Human; identical to SEQ ID NO: 33967

SEQ ID NO: 143131 - DNA, 601 bp, Human; identical to SEQ ID NO: 33968

SEQ ID NO: 143132 - DNA, 601 bp, Human; identical to SEQ ID NO: 33969

SEQ ID NO: 143133 - DNA, 601 bp, Human; identical to SEQ ID NO: 33970

SEQ ID NO: 143134 - DNA, 601 bp, Human; identical to SEQ ID NO: 33971

SEQ ID NO: 143135 - DNA, 601 bp, Human; identical to SEQ ID NO: 33972

SEQ ID NO: 143136 - DNA, 601 bp, Human; identical to SEQ ID NO: 33973

SEQ ID NO: 143137 - DNA, 601 bp, Human; identical to SEQ ID NO: 33974

SEQ ID NO: 143138 - DNA, 601 bp, Human; identical to SEQ ID NO: 33975

SEQ ID NO: 143139 - DNA, 601 bp, Human; identical to SEQ ID NO: 33976

SEQ ID NO: 143140 - DNA, 601 bp, Human; identical to SEQ ID NO: 33977

SEQ ID NO: 143141 - DNA, 601 bp, Human; identical to SEQ ID NO: 33978

SEQ ID NO: 143142 - DNA, 601 bp, Human; identical to SEQ ID NO: 33979

SEQ ID NO: 143143 - DNA, 601 bp, Human; identical to SEQ ID NO: 33980

SEQ ID NO: 143144 - DNA, 601 bp, Human; identical to SEQ ID NO: 33981

SEQ ID NO: 143145 - DNA, 601 bp, Human; identical to SEQ ID NO: 33982

SEQ ID NO: 143146 - DNA, 601 bp, Human; identical to SEQ ID NO: 33983

SEQ ID NO: 143147 - DNA, 601 bp, Human
agctttctcaccttcacagaagggatgcctgcctcacagagtcattctgaaactagatgagaaaatgctgtggtccttgtgggggcttgaggcacgttagttcccagctcttgtcaagaaggctggagaaggaagaatggaaacagaacaaaccaggaagggagcccctgacagagcgaggctaaagagccctgtacattatccaactaggaaatcgaaggaggaaggagaaagaagacagaagagtcaacagccttagtcatactcctatgcgatttatgctgagggacattttataccmattgcaggccttattttgcatcttctactcaaaacaaacagctcaggtgctcctggaaaggatgattgttctttctctgagtaactgacaacaatcctcgactctctaatctgtttagcagctccccaggcacattgggcagcacaacctaaggcagcggctcaaatcttaaggaagcccaaaaataccccgtgtgcgttgttactggatgccccgtcccttacggctcaggagatgtgtttttgatacaccttgcagcggcttctgaaatgtgatccatccacttaacacatcctgaga

SEQ ID NO: 143148 - DNA, 601 bp, Human
actgttaggagcataaaagtccctaaacactttctcagtaggctgtactgatactgtgggttgcttgaggaagcaatagagcagcggttctccgccgtggttgcactttctttttcttttttatttttttagacggagtctcactctgtcacccaggctggagcacactggagcaatgtaactcactacaacttccgcttcccgggttcaagtgattttcctgcttcagcctcctgagtagctgggattacaggtgcctgccaccacgcctggctacattttcatatttttagtagagacrgggtttcaccatgttggccaggctgctccggaactcatgacctcaagtgattcatccaccttggcctcccaaagtgctggaattacaggcgtgagccttggctgcactttctaatcacccagagagaaactgaaagtcccagtgcccaggccacaccccaggccagtttctgcagactctgctggggagttgaaggcatgggtagttcaggtgatgccaaggtgtgtctgagattcataaccatcaacctctgggaggtggtcagtgatgcgtctacctggcaagagctctgacctcaag

SEQ ID NO: 143149 - DNA, 601 bp, Human
gtgactgttaggagcataaaagtccctaaacactttctcagtaggctgtactgatactgtgggttgcttgaggaagcaatagagcagcggttctccgccgtggttgcactttctttttcttttttatttttttagacggagtctcactctgtcacccaggctggagcacactggagcaatgtaactcactacaacttccgcttcccgggttcaagtgattttcctgcttcagcctcctgagtagctgggattacaggtgcctgccaccacgcctggctacattttcatatttttagtagasacggggtttcaccatgttggccaggctgctccggaactcatgacctcaagtgattcatccaccttggcctcccaaagtgctggaattacaggcgtgagccttggctgcactttctaatcacccagagagaaactgaaagtcccagtgcccaggccacaccccaggccagtttctgcagactctgctggggagttgaaggcatgggtagttcaggtgatgccaaggtgtgtctgagattcataaccatcaacctctgggaggtggtcagtgatgcgtctacctggcaagagctctgacctc

SEQ ID NO: 143150 - DNA, 601 bp, Human
tgacctgagttccagtgactgttaggagcataaaagtccctaaacactttctcagtaggctgtactgatactgtgggttgcttgaggaagcaatagagcagcggttctccgccgtggttgcactttctttttcttttttatttttttagacggagtctcactctgtcacccaggctggagcacactggagcaatgtaactcactacaacttccgcttcccgggttcaagtgattttcctgcttcagcctcctgagtagctgggattacaggtgcctgccaccacgcctggctacattttcrtatttttagtagagacggggtttcaccatgttggccaggctgctccggaactcatgacctcaagtgattcatccaccttggcctcccaaagtgctggaattacaggcgtgagccttggctgcactttctaatcacccagagagaaactgaaagtcccagtgcccaggccacaccccaggccagtttctgcagactctgctggggagttgaaggcatgggtagttcaggtgatgccaaggtgtgtctgagattcataaccatcaacctctgggaggtggtcagtgatgcgtctacctggca

SEQ ID NO: 143151 - DNA, 601 bp, Human
gtgacctgagttccagtgactgttaggagcataaaagtccctaaacactttctcagtaggctgtactgatactgtgggttgcttgaggaagcaatagagcagcggttctccgccgtggttgcactttctttttcttttttatttttttagacggagtctcactctgtcacccaggctggagcacactggagcaatgtaactcactacaacttccgcttcccgggttcaagtgattttcctgcttcagcctcctgagtagctgggattacaggtgcctgccaccacgcctggctacattttmatatttttagtagagacggggtttcaccatgttggccaggctgctccggaactcatgacctcaagtgattcatccaccttggcctcccaaagtgctggaattacaggcgtgagccttggctgcactttctaatcacccagagagaaactgaaagtcccagtgcccaggccacaccccaggccagtttctgcagactctgctggggagttgaaggcatgggtagttcaggtgatgccaaggtgtgtctgagattcataaccatcaacctctgggaggtggtcagtgatgcgtctacctggc

SEQ ID NO: 143152 - DNA, 601 bp, Human
aagctatcagcctgtgatcatagcagccttggataccatgggttgagaagcacattcctttatcctagttggcttcttcaagtgccctggtgaagagccactgctatagaatgaagctgcctatgataagatccaggagtgtatatgaatgaggtggtgacatggaatactgatgctgagaaaggtggcagacacagagtacttctgccctgactactaaagtatatattcttgcaaatggaatacatgtcattgtgacctgagttccagtgactgttaggagcataaaagtccctaaacwctttctcagtaggctgtactgatactgtgggttgcttgaggaagcaatagagcagcggttctccgccgtggttgcactttctttttcttttttatttttttagacggagtctcactctgtcacccaggctggagcacactggagcaatgtaactcactacaacttccgcttcccgggttcaagtgattttcctgcttcagcctcctgagtagctgggattacaggtgcctgccaccacgcctggctacattttcatatttttagtagagacggggtttcaccatgttggccaggctgctc

SEQ ID NO: 143153 - DNA, 601 bp, Human; identical to SEQ ID NO: 91948

SEQ ID NO: 143154 - DNA, 601 bp, Human
tggcagtttttttttccctttcacttgggcctttgggttggatttaaaaaaaaacaaaaaaacttttagcttggggttggtctgaacaaaagaacattaggagtttaatgaatcacagtcaaggtagccaagtaaacttttagccctcgggctgctctgctcctctttcaatgtaaattctaaatacttccataattattactaagtacagcttccttccgcaagaatgtaaaagtcagagtgacagtcttctgagtcgttgatttcctcttcctttttaaaatttttatttaaattttaygatttctaaagatgagggtctcactgtgttgcccaggctgatctcaaactcctaggctcaagcgatcctcctgcctcagcctcccaaagtgctgggattacaggcatgagccactgtgccagcctgatttcctcttcctttaagaagggaagtcaaaaatgtacttagcatgataaatcagcataccttagtaatttttatgaaattatcccctttatatatttttagtttagcttcatcaaaatcaaacacctttttaacatattttcccaccctatttatttatttattattattatt

SEQ ID NO: 143155 - DNA, 601 bp, Human
gatttctaaagatgagggtctcactgtgttgcccaggctgatctcaaactcctaggctcaagcgatcctcctgcctcagcctcccaaagtgctgggattacaggcatgagccactgtgccagcctgatttcctcttcctttaagaagggaagtcaaaaatgtacttagcatgataaatcagcataccttagtaatttttatgaaattatcccctttatatatttttagtttagcttcatcaaaatcaaacacctttttaacatattttcccaccctatttatttatttattattattattwttttttttttttttttgagacagagtctcgagctgtggcccaggctggagggcagtggtgtgatcttggctcactgcaacctccgcctcctgggttcaagcgctactcgtgcctccgaatagctgtgattataggtgcgggctaccacacctggctaatttttgtttttttagtagagatggggttttgctgtgttagccaggatcgtctcaaactcctgacctcatgtgatccgcctgcctcggcctcccaaagtgctgggattacaggcgtgagccaccacacccagcccaccctatt

SEQ ID NO: 143156 - DNA, 601 bp, Human
tgctgttccctttgcctgagtattgttctcccagatgattgcatgatggactttatcttattcaaagtctagctcaaatatcacctctgagacaagcctttcttgattatcccacctaaatgaagctttcttctccctaccaagccactaatacatcctctgtgttcttgtctgtataacacttgttactacctggaattgtctcatttattaacttgtatacttatttgtggtctccccagctagaatttcaggaatttagtttctgtcctttacttctgttcagtatagctgctcagcytctgaaataacatgttatctaaataatagtatctgttcagtaaatgacttcagagttagagcaaaaatgagttaagcgcagtggtggggaacaggatcgcaagtcccctgggcagttgtttactcagtgtggacgctgacgctgctgctcaggggtggcacttttattttttattccatctgaaccagcaacttggtctgaagtaatactatattttataaatataaacctaaatagtgatcttttgattgttggattcatagccctttctgtggacactggaaggatctctaaatagtg

SEQ ID NO: 143157 - DNA, 601 bp, Human
aatagtggttcagaaaggaaagcatatctaaaccaagcttgtccaacccacgtcccgcaagacgcatgtgacccagaatggctttgaatgtggcccaacacaaattcgtaaactttcttaaaacattatgagattttttggcgttttttttttcttcagctcattggctgttattaatgttagtgtattttatgtgtggcccaagataattcttcctctaatgtggcctagggaagccaaaagattggacaccccgatctaaacttttctttactgtctttttacagtttctattattctrtttctagaggcattctgactggttcaagtaaagaaaacataaagtgaattatttttatctagttgatgtgaagaatctactctgtctcagatgtaaagtacatctactgcctaagcctttggtttctaatactgtgttaggtaaactcctctcctgtgatgggtattttttgttctttgtcacatttggtgtgttagggtaaagcagtctgaggttttgattatattatatcatcgtggattggccacaaaagtcagcaaacagtttagttattatcattttggaggtaagacatttgaa

SEQ ID NO: 143158 - DNA, 601 bp, Human
ccaggctggagtgcaatggcacgatctcggctcactgcaacctccgccttccagattgaggcaattctcccacctcagcctcctgagtagctgggactacaggcatgcgccaccatgcctggctaattttttttggatttttagtagagacagggtttcaccacgttgaccagactgctcttgaactcctgaccttgagtgattctcccatcttggcctcccaaagtgctgggattgcaggcacgagccactgcgcccagccaatagctctcttttataattgatcctaaagactttcacyattaatgggagtaaaaggagggttttatttccacccaaacctagatagacaagggtatgggactgcaagcagtttaatacactgttagtgagaatgcagattggtacactttctctagatggcaggttggcaatgcatatcaaagtctaaaaggtgtgtatcatgccctccagttaaacacagatgtacattgtttattacagcatgcttacaataggaaaattgggaacaatgtgattggttaaattatgatggtgtttagaatttatataggaagacgagcagcatagcccaaaagag

SEQ ID NO: 143159 - DNA, 601 bp, Human
attctactacatataaccatggttctcactttcatcttctgatgaaatatatgccctcctaccttaaggagttagaggaagaaaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtgagacaacacaggtggctttttttttcttttccctggtgtctacgaaaacaaaatatttttcagattgaaaattgaggcataaatagccgggcgcggtggctcacgcatgtaatcccagcactttgggaggctgaggtgggcagatcatgaggtcaggagatcgagaccatcctggctaacatggtgaaaccccgtctccactaaaaatttaaaaaaaaaaatcagcccggtgtgctggcacatgcctgtagtcccagctacttgggagggcgagacaggagaatcgcttgaacccgggaggcggaggttgcagtgagccgagatc

SEQ ID NO: 143160 - DNA, 601 bp, Human
taaggagttagaggaagaaaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtgagacaacacaggtggctttttttttcttttccctggtgtctacgaaaacaaaatatttttcagattgaaaattgaggcataaatagccrggcgcggtggctcacgcatgtaatcccagcactttgggaggctgaggtgggcagatcatgaggtcaggagatcgagaccatcctggctaacatggtgaaaccccgtctccactaaaaatttaaaaaaaaaaatcagcccggtgtgctggcacatgcctgtagtcccagctacttgggagggcgagacaggagaatcgcttgaacccgggaggcggaggttgcagtgagccgagatcacaccactgcactccagcttgggcgacagagtgagacgcagtctcaaaaaaaaaaaaaattgag

SEQ ID NO: 143161 - DNA, 601 bp, Human
aaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtgagacaacacaggtggctttttttttcttttccctggtgtctacgaaaacaaaatatttttcagattgaaaattgaggcataaatagccgggcgcggtggctcacgcmtgtaatcccagcactttgggaggctgaggtgggcagatcatgaggtcaggagatcgagaccatcctggctaacatggtgaaaccccgtctccactaaaaatttaaaaaaaaaaatcagcccggtgtgctggcacatgcctgtagtcccagctacttgggagggcgagacaggagaatcgcttgaacccgggaggcggaggttgcagtgagccgagatcacaccactgcactccagcttgggcgacagagtgagacgcagtctcaaaaaaaaaaaaaattgaggcataaatagaaaatgaa

SEQ ID NO: 143162 - DNA, 601 bp, Human
tttttaaaagaattttttacttgccccaaaactctcaaacttgtctcctacacatataaaaattgtacatagcaatgtctgcagttctgtgagaactaaatgctctgttcttttaggaagcagctctcttggtttttgtcttttgtcttttttgttttgttgaaagcatgattctttattagtaaataggatgttttacctggaaagtttctgtttttattattataactatattaaagtttttagtctcttcttttggtgccatgacttggattatagtcctcattttggcaggggggtsgggggtgggtctgcacgttagaaaactacatagctctatgatatttttagttattaaaatgaaaatttggatttctaggcacctttaagaatagtggctggaacttattctatacttactccatatctattttagaattggaggaggttgagataaagcttagcaaaagggatccttagtttggggtaggttctgtaaccccagaattcatttacaatgaagtctcctttttcagattttgaaagtcaggttagtaaatttcttttaggatactacagaccagggcctagtggatgggct

SEQ ID NO: 143163 - DNA, 601 bp, Human
gcagtggctcatgcctgtatcccagcactttgggaggctgaggtgggtggatcacttgaggtcaggagttcaagaccagcctggccaacatggtgaaaccccgtctctactaaaaatacaaaacaattagccggccatggtaacgcatgcctgtagtcccaactacaggttgaggcaggagaatcacttgaacccgggaggtggaggttgcagtgagccgagaccacaccactgcactccagcctgggtgatgagtgaggctgtctcaaaaaaaaaaaagaaaaagaaaaaaaaaagagagaaaacttggtaataaaatgtggaagaggatgaatgggtattgtctggtactcttagtgacagtgggattggcaaagtctttctggaggacaatttggcagtgtgttaaaatgttaaatccatataccctttaatcagcaattccacttttctgaatttctgctaaactgatttcataaactgtaagcaatctaaatgtttatcagtaggggaatggctaaataaaatggaaattctataccatggatactaggcaactgtttttaaaaattagattattctagttgcactaccatgagaa

SEQ ID NO: 143164 - DNA, 601 bp, Human
tggctcatgcctgtatcccagcactttgggaggctgaggtgggtggatcacttgaggtcaggagttcaagaccagcctggccaacatggtgaaaccccgtctctactaaaaatacaaaacaattagccggccatggtaacgcatgcctgtagtcccaactacaggttgaggcaggagaatcacttgaacccgggaggtggaggttgcagtgagccgagaccacaccactgcactccagcctgggtgatgagtgaggctgtctcaaaaaaaaaaaagaaaaagaaaaaaaaaagagagaaaacttggtaataaaatgtggaagaggatgaatgggtattgtctggtactcttagtgacagtgggattggcaaagtctttctggaggacaatttggcagtgtgttaaaatgttaaatccatataccctttaatcagcaattccacttttctgaatttctgctaaactgatttcataaactgtaagcaatctaaatgtttatcagtaggggaatggctaaataaaatggaaattctataccatggatactaggcaactgtttttaaaaattagattattctagttgcactaccatgagaagatc

SEQ ID NO: 143165 - DNA, 601 bp, Human
aagaaaaagaaaaaaaaaagagagaaaacttggtaataaaatgtggaagaggatgaatgggtattgtctggtactcttagtgacagtgggattggcaaagtctttctggaggacaatttggcagtgtgttaaaatgttaaatccatataccctttaatcagcaattccacttttctgaatttctgctaaactgatttcataaactgtaagcaatctaaatgtttatcagtaggggaatggctaaataaaatggaaattctataccatggatactaggcaactgtttttaaaaattagattwttctagttgcactaccatgagaagatctctatgacaaaatgttgagtggaaaaaacaagttataaaatagtgtacaatatggtaccatttgtgtttttctttaatcacataaaactgcctttctagcatgtatttatgtaaatgtatagaatttggcctagaaggaaggctgttcatcaagctcatgcctctggataggagactggattgagggaggatacatggcaaagaggactttgactttatctatattatttacatttttgtacagaagagtacaacaagcataaggtaacagaa

SEQ ID NO: 143166 - DNA, 601 bp, Human
ttctagttgcactaccatgagaagatctctatgacaaaatgttgagtggaaaaaacaagttataaaatagtgtacaatatggtaccatttgtgtttttctttaatcacataaaactgcctttctagcatgtatttatgtaaatgtatagaatttggcctagaaggaaggctgttcatcaagctcatgcctctggataggagactggattgagggaggatacatggcaaagaggactttgactttatctatattatttacatttttgtacagaagagtacaacaagcataaggtaacagaarctaaccaaactgtctccttcaaagagaaggtaggactttaagagcattttgattaaaaagagagagaaagtttgataggttgggggtgccgagatacagaagcagaagtcttgccttgagagaggagtctaaatgagtgtctccattgactggccttcaaattcactaattctgaagttacgttgatcttttctccaaacttgctcttgtggtttctatgggaatgtgtttttagggaaaatgagattaagagaagccagtgttttgcttggcactactagggagtggtgtttctgataa

SEQ ID NO: 143167 - DNA, 601 bp, Human
gattgagtaccccctgcctgaaatgtttgggaccagaagtacgttggatttcatatatttttggatttttttaacatttgcatatacctagtgagatatcttggggataggaccacaatctaaacacagaatttatttgtgttttatatacaccttatgcactatagcctggtggtaatttcttagggtatttttaataattttgtgcatgaaataaagttttgacagcgacttgaggtcatgggtggaattttccacatgtgacacttgaaacattccagatttcagatcttcaaattarggatgctcaatctctccagattaaggattaaaactgtgctggattaaagccatgatgtttctgagtccttatttgttttacatttagagtagttttatttaatagatttgaagagtggatgcttaaagcatctacttttttaaaaaaaaagaaacagctttttcttattataaaatcagaattaccaatcagttgccaaagagctatggtgcacctaaattttataacaaattaagctctaaattttagaacaaaagttatgaatactggagaagttgctgaaaaaagatggcttgatga

SEQ ID NO: 143168 - DNA, 601 bp, Human
ctgagtggtgggaattaatgggaactgactgtagtgtgaggccagattgtggtgggtctgaaaagctgggcagaaggatctagtttagttgccatagttaaaagacatttggaggtgttttgagcattggagctatgtaggtaacatttaggaaaacctctcaggcaaggatatgtgggaagagggaatgaagggagaacttggagtttcccaagaaagccaactagaaggatacactagccttgggccaaaaaattagaataaaggtggggccggagaagaagggatagacaccagagaygtttcaaagaaaacaaaagaactggacttgcaatgtgtgactaggtaagtgttgaaggagaaaagtaaagataactttgacatttttagtttgagtggccggggaaagggtggttttctacttgctaagataaaaaagttgagaagacaagtagattggagagagggtagggtaggagtttaagtgaagaggctgatgctgagcccacctttcaagtaacattgagttattggaactcagttggaaggcctggtgggagagccgaaggaagacttgagggtgaaagatatccacgtccag

SEQ ID NO: 143169 - DNA, 601 bp, Human
ctagtattctccacagtgagtgctttctgatcactttaggatttctgttttgtttgtttggtttaagacagggtcttgctctgtcacccgctttaggatttttgttttgttttgttttgttttgttttgagacaaggtctcactctgtcacccaggctggagtgaagtggcaccatcatggctcactgcatccttgacctcctgagctcaagcgatcctcctgcctcagcctctctagtagctgggactacaggcacgtgccactgtaaccgactgagttttgtatttttggtagagacaragtcccactgtgttgcccaagctggtctcaaactcctggtctcaagcattctgcctgcctgagcctcccaaggtgcagggattataggcatgagccactgcacccaacccactttaggattttgttaatttagaattatttagccttctcatttcattttctccagactctcctaggtatgaatataaagaattctcctttttggaaactgttaatggtattcaaagaaaagggagtttatgaaagtctatatcaatttaatctatacctctgagaaagccattttttttaacatgaaga

SEQ ID NO: 143170 - DNA, 601 bp, Human
gttcatggttccctattatgtaacaatttgtatcatcttctcgtaaaataatatctaatatttattataagaatgataagaatacctgatatttatagaaatctttaatattaaagtgttgctgtactcattctctcattaatacttaattattctcatttctgttttttcttgttttactttgtaactacaaatccacacccccgagtctgattcattgctaaaagtggcctctttttggttttcagctgcaggggcagtatgggtgcatccttagttgcaggatgctacttatatctgragtgctatagaccaccaggttaaaaggaagacagtaggtctgggaaggaggaatagatcataacttgataaactgcttttcttgccagaaatcattatcagcgattaagaatattcacaaagtagaccctcccccaacacacacagagtgtggttactatgccaggaaataagaatggcagttgtctttgtggtttaaaacctgtttggtctggatttgatttgtaaaataaatctgaatgaagtccataatgcatttaaattcacacatgctttactatgtctatatgtcagactcatg

SEQ ID NO: 143171 - DNA, 601 bp, Human; identical to SEQ ID NO: 31734

SEQ ID NO: 143172 - DNA, 601 bp, Human; identical to SEQ ID NO: 31735

SEQ ID NO: 143173 - DNA, 601 bp, Human; identical to SEQ ID NO: 31736

SEQ ID NO: 143174 - DNA, 601 bp, Human; identical to SEQ ID NO: 31737

SEQ ID NO: 143175 - DNA, 601 bp, Human; identical to SEQ ID NO: 31738

SEQ ID NO: 143176 - DNA, 601 bp, Human; identical to SEQ ID NO: 31739

SEQ ID NO: 143177 - DNA, 601 bp, Human; identical to SEQ ID NO: 31740

SEQ ID NO: 143178 - DNA, 601 bp, Human; identical to SEQ ID NO: 31741

SEQ ID NO: 143179 - DNA, 601 bp, Human; identical to SEQ ID NO: 31742

SEQ ID NO: 143180 - DNA, 601 bp, Human; identical to SEQ ID NO: 31743

SEQ ID NO: 143181 - DNA, 601 bp, Human; identical to SEQ ID NO: 31744

SEQ ID NO: 143182 - DNA, 601 bp, Human; identical to SEQ ID NO: 31745

SEQ ID NO: 143183 - DNA, 601 bp, Human; identical to SEQ ID NO: 31746

SEQ ID NO: 143184 - DNA, 601 bp, Human; identical to SEQ ID NO: 31747

SEQ ID NO: 143185 - DNA, 601 bp, Human; identical to SEQ ID NO: 31748

SEQ ID NO: 143186 - DNA, 601 bp, Human; identical to SEQ ID NO: 31749

SEQ ID NO: 143187 - DNA, 601 bp, Human; identical to SEQ ID NO: 31750

SEQ ID NO: 143188 - DNA, 601 bp, Human
tctgtgagaccctatgtgattgttatatttttaaataatatataattaagcaggacaaattaaatactccatggctttggggaaattgttgctttaaagtcctggaatggggctgggcacggtggctcatgcctattaatcccagcactttgggaagccaaagtgggtggatcacctgaggtcaggagttcaagaccagcctggccaacatggcaaaaccctgtccatggtggtgtgcgaggctgaggcaagaaaatcgcttgaacccgagaggcagaggttgcagtgacctgagattgcrccactgcactccaacctgggtgacagaatgagactccgtctcaaaaaaaaaaaaaaaaaaaaaaaaaaccaatcctggaatgaggatagataaataacatactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacata

SEQ ID NO: 143189 - DNA, 601 bp, Human
aaaaaaaaaaaaaaaaaaaaaaaccaatcctggaatgaggatagataaataacatactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacataggaaatgcaaagagccatcgtggcttctgagaatcattttccaaakatgccaaacaaattcaattctaaaactatagcctactttttctgtagggaaagaggcttttgtgcttatctaaatctagacagagttgatctcaaccagaatgctgtaggacaaaggacatcttatagccacacatgttcaggatgaaatggaccatggttggaattaaggagaacctctctctctagctagactcctacttctatttttttacctttttctattcctcatcagagtcctaaggcaccctgagcaaagggtaggatatctggcttatgtggcattcatgtgaagtgtgat

SEQ ID NO: 143190 - DNA, 601 bp, Human
gggtgagagatcaagaccctgtctcaaaaaaaaaaaaaagccaggctcagtggctcacacctgtaatcccactactttgggaggccaaggtgggtggatgacctgaggtcaggagtttgagaccagcctgaccaacatggtgaaaccctgtttctactaaaatacaaaaaattagacaggcatggtggcaacacctgtaatcccagcgaatcgggagttccaggcacgagaatcgcttgaacccaggagatggagattgcaatgagctgagatcatgccactgcactccggcctgggcgayagagcaagactccgtcttgaaaaaaaaaaaaaaaaaggtaatgacccatgcaagccagaagtttaaattttggatcaccaaagcagacctgatgaagacattgcacctagcacctgcgcaccctgaagacttctttctggacatgtaccccacactaccccgacactaaaggaactacccaagcactcacattactttatttctatgttctctgtctttttcaatagagtctttggtctcttaggatggagtttcatggttcggttcaatataaagattttcacagatgccttttcattt

SEQ ID NO: 143191 - DNA, 601 bp, Human
tgatgaagacattgcacctagcacctgcgcaccctgaagacttctttctggacatgtaccccacactaccccgacactaaaggaactacccaagcactcacattactttatttctatgttctctgtctttttcaatagagtctttggtctcttaggatggagtttcatggttcggttcaatataaagattttcacagatgccttttcatttagatgtaggtagaattgcctaaggctggtgaaggctaccagattaattccttcctttacttgtttgtttgtttgtttgtttgtttgttttttttgagacagggtctcactctgtcacctagactggttcactgcagccttgacctcaggctaaagctatcctcccacctcagcctactgagacgctgggaccacaggtgcgcactgccacaccgcgctaattttttaaattatattttttgtagagatgggatctccctttgttgcccaggctggtctcaaactcctgggctcaaaatgatcctcccgccttagtctcccaaagtgttaggattataggcatgagccactacacccggccctttacttcattttttgaacatagttatct

SEQ ID NO: 143192 - DNA, 601 bp, Human
tacttgtttgtttgtttgtttgtttgtttgtttgttttgagacagggtctcactctgtcacctagactggttcactgcagccttgacctcaggctaaagctatcctcccacctcagcctactgagacgctgggaccacaggtgcgcactgccacaccgcgctaattttttaaattatattttttgtagagatgggatctccctttgttgcccaggctggtctcaaactcctgggctcaaaatgatcctcccgccttagtctcccaaagtgttaggattataggcatgagccactacacccrgccctttacttcattttttgaacatagttatctcaatactcttttcatcttatacaccttaatgtaagaagtcatacagttcagcccatttgtttttcttcactctgccttcctctctgctggtccccagaaccccctgtgttccaggactcctgacctccaggactgacagatacaggcattcactcagacttgaggagctctttgctgagtgcctctcacctctcacccagaccttaacacccattgttggcaagcctcagaaaaccaggcctatagacctttctcttccttcctatt

SEQ ID NO: 143193 - DNA, 601 bp, Human
tggagctctctgacctaggacatcaacatacttctcagctgttgaccttgcattctgtctctcaatcctgttgtatcattattttattcatttaacaaaatttacataatcttactatgtataagcattctaagtgttttacatgcattatatttaaaacgcatgataactttatgagtaaacactgttaaactgatttaacacatagggaagctgagacacagaaagtttcagtaacttaaccaagttcacatagagagtggcagacaattcaggcaatttgtttccaaaccactgtacyacactgtctccctttgatgtgagctctgggttcctgcctagactccacaaatacagggtgataaccattgttgaacaaataaatttggaaatgtcaaacctttccccacccctgccagaggctgcttgccttagtctagtttagccacagcacccatctgcccagctgttccgagggctgtaggggtaccctggaggttcatgctgctgagtgccccgggctcagcagccctccctctgcacacacacaggcttgcctttgctggccagaggagccgacaggtctgtatgcttctccggt

SEQ ID NO: 143194 - DNA, 601 bp, Human
acttgcctttgtctagggctgctgttctcttctgcacatagtttgcggtcatgagtgtggcctttttactcctaaaatggcacaatgtgtcttcaaatctcaacagatgcattgtatttcaactctatcatgaaaggtagcttttgccattttttcctttttgtcaccaccatcatccatttttacttactgcatgtcccactgttccaactctttaaaaatgagagggatgatgccaatcctccacatgttagactgtaaaacacatctccttccacctttttctgtgttccttgttccctggacacatcagtatatgggcttgttctcacaagagtccactgagatgtaaatgttaatttaggaactgtattattgtttctccccaaaaaggttgctgatgtgctattccagtgtgtactaaatcactttttgcctcattattttaaagtttaaataaatgaatgtattaaatagtcttagtgtaagagtgcgttttcagtcaccataagcataatagccttaaaagtgctgttgtgttctatgacactgtgatactatttgtagcttttatccaaagatggtaagctcagtgcctcag

SEQ ID NO: 143195 - DNA, 601 bp, Human
gaaactcccttcttccccttcactccctcttgccagcttagcctacctaggaagtaaagaaggcataatacaaatgaaaatcatggcctttattattcatctggttatgctagtacttggtgtggtgactcctttgcaggattattttaaagaatggtggcagctatgttttactcactttagaagtcaaagactcacggtaaatcttagcagaggcaaataaaaacatgataccaaaacctaacatctaaatctgtactgtccagtatgatagctgttagctacatgtggctatttgaayttaaatgcaagttgattaaaatgaaataaaatgtaaaaggtagttattagtcacaatcatatttcaagtgctgaatagccacatacgccctgagatactgaatttttaatttaattataatttattcacatttaaatgtaaacaggcacatgtacctagtagccactttaatggactgtgtagatacagaacatgtctatcactgaagacagttctattgggtggtgctgatctaagggctatatcaataacactgtggtctcctggcaagttgtaccctctctgtacaggggaggacaa

SEQ ID NO: 143196 - DNA, 601 bp, Human
aacctgagaccggagacagtggtgacatcaagactcacttcctagtgagtttattcatgactcaggccatgtgcatatttccacttggattcctcacaagtgcaagtttctcttctaggctacaggtatctgcagccaggtgctgtaatggatttatagtagcccgccaaaagatcaaatatctgaagcctgacgggtcacaaagctgacaggagccatgactattgcatgaattccagatttcacagtgaaacagagctgctgctgaaaaatgggagcacagagctgttcactggggctyttgattctagacactcaaagaggggtacagttctctgccccatgtgtgtttctcacccaaccttttcatggtgttgaggaggggaagggacagctcagtggtgattcttcacttctcaaacgtgtcctcctcctctgtcttcataatgacctcctgaagtccaaagtgccttccaaaatagctcttggaaagaggtggcagtttcctgactccccaatctcccccatcctgggagatgtgttgatggcactaatttgcggggtagcagagactatagtcctactctctttactggctggg

SEQ ID NO: 143197 - DNA, 601 bp, Human
tcatatccctcaggcatactgagattctcttctctagaattaccaggccttttctgtcactcctcaggcataccccccgtagctggagggatttccagttgccagggttctttggtgcttttctttgcctcctgcagagatgctgagctgtggacaccttcagaaagaccagcactgcctcatgagagtatctcctgtccctctttgcgggtttaggttccttgtgtagtctgcacatccagaggggatgtgtcattctctctctaccattataacctggggtggcctcgggcattcatcktttatatgccaggaattgctaacctaagctctgctatttgaaggcttaaagactgcagatcaaaagtagacacagagggcctttacaatgagatgataggccagtagctgtcattctttattcttagtgctcatctaagccatgaccatgtccttcagatgtagcttttagatacttttcatgtgaaagactggatacctctagtcgacatgtcagggccccaaaggaatcaagtccctttggcataccttcatgtcctcttttttttgtttttctgtacttcaatagatgcaaattcat

SEQ ID NO: 143198 - DNA, 601 bp, Human
aggttgtggttggagtcagtgaagtgaatgtctaagtggcacctgcttcattcaacagatctgctttcctggggcctcccagtgcacatctgctcctgacaaagcctcttttctcctcctattggtcagactgagagcaaaggcctggcaaggagacatactggttttgctttgtcagcacaattgcctgtgacattataattacaccaaatcttcattattagaaaggccccaatttagagattttcagagcctaaatgggattttctaagtgaaattgattaaaaaaaaaaaaaaaaamaaaaaactttgccatcataaagcctagcaattgcatctgagaatcattgaaggggtctaaatatggaaaccgagacactgctgtgagtgagactacaaagaccatgctatcagattggctcgctagagaggcgtccagcagtcttccgactctgcccagcccatcctctccttattcccgtagcactgtaacatgcagatacctacactgcattgctctcacatgctgatagtttctcatgcagaggcctggtgggggaggggctggagggtgttaaaataagttgatgaggtatggcag

SEQ ID NO: 143199 - DNA, 601 bp, Human
acagaagtggcctgttggttttacaaatgtgaatatagtcaactcttacttgttacctacagattatctgtcacgcagattactcgtgacacattttaaatccttgggcaatttctctgagcgagccagtgtaagcctggaccatctcctctgccccccgacccagctgctgggtacttagggaatacaaattagttttcatattagcttaaagaagacataattaggaaggtaagtctgctacaagaaaatcacatcacaaattccaacggcgagggggaaatatgagggaaatgacctsctctcccttcaactgaactaagatctggtggtctaagtgcacattagcacttggtgctggcatgcttgccgaaggctttcctcacgggtggaaggagcgaggctgtgcaccctgcaccagatgtgcatgggaggctgcaagcgccgcagcggggctggtggcccatcttgcccggtgcttttttttttttttttttttaacagttctgtgttattgtcaggcctctttatggcagatcgtgcaggtcgcaagtggatcctgactgacaaagccacaggtgggttcatctttggggaaaga

SEQ ID NO: 143200 - DNA, 601 bp, Human
ctgatctgcttttttcaggtgtctcactgcctagagcaaatttaattctgccctttatgtgctcttaaaaagttttagtttttttgtggtttttttcctaaatggtgctctacagattatgctgagtgaggggatgaaaagtcacgagtacatctttggaagcttccttgcctcagcgtatccctgctcagatagaagaggcagggactggatgacaggcacatgggggttcattgtactcctccctctcctggtgcctatttgacattttccatcataaaaagtttgaagaaaaaaaaaagtttgaaagtaataataacagaaaaataaataaatctcccttcctaactctgagtaactcctgagtgggcctgctgttcatttctgcacctgactgttgcaggctcctggtgactttcttcttctgaggtttgtcatctgggctccactttccattttaaaatattggtgcactctgcatattgccatgatctatcctctgggacacagacttcaacctgagtgttgttcccacccttcttcctagtgatttcttctgggaatttactgggtaccccttgccctgctctgtacagtcaga

SEQ ID NO: 143201 - DNA, 601 bp, Human
gacacagacttcaacctgagtgttgttcccacccttcttcctagtgatttcttctgggaatttactgggtaccccttgccctgctctgtacagtcagatcagatgtcctccagagcaggggtccccagtccctggcacggcaggaggtgggtggcaggtgagcaagcatcaccgcccgagctccacctactgtcagatcatcagcggcatcagattctcataggagcacgaacctattgtgaactgatgatctaaggtggaatagtttcatccccaaaccatccccctcaaccccccccccatccatggaaatactgtcttccatgaaactagtccctgctgccaaaaatgctcgggaccgctgctccagagcacgtgcatattccacaagcttcagcagaacgctttctctcctgccattttcagtttaaagccttcttggcagggtcaacaggccttgcagttagcttgttcatccccacgttgggagctcaattttcaggataataaaccatggtggttctgaatactgaaacacagagcgtttcataacgctcctgggcatcgccagtaatttcaagaggaaatcatgacattgtat

SEQ ID NO: 143202 - DNA, 601 bp, Human
cactcgattagcaaccacttcatctacgtcatgtgcagtgccagttctgaccatcactgtgtttcagaagggaagctgcctgccagtccatctgccctgatttcatggctgttatctttaatctttacatctttgaaggcctttggtgaatgatgtgcttcctggcaggagaaaatcactgctgaaaggagatctgtgttgtctctgcttttctttctgtttcccgagagctttagtctaacatctgtgaccccagccagactccatcaaacttcatactcaaagtcatctttgaaaagcmgtggcatttattatatacctactatgtgccaagcactgtaatagattttaatgtgtcatcccatctatctagtttagcagccctgtgagatgagtgatcaccattttacatatgaggaaacaggctcacaagccattaaacagcagaaccaagattcacatgtaggtctttctgactgggaagcctttaatggaaataaacagcctactttttctcacataaaatgcacctgatctgcagcaccatgagaatggttgtggagaaaattcgacttcattctgaatcagagtaaaaggtgtt

SEQ ID NO: 143203 - DNA, 601 bp, Human
tgtgcagtgccagttctgaccatcactgtgtttcagaagggaagctgcctgccagtccatctgccctgatttcatggctgttatctttaatctttacatctttgaaggcctttggtgaatgatgtgcttcctggcaggagaaaatcactgctgaaaggagatctgtgttgtctctgcttttctttctgtttcccgagagctttagtctaacatctgtgaccccagccagactccatcaaacttcatactcaaagtcatctttgaaaagcagtggcatttattatatacctactatgtgccmagcactgtaatagattttaatgtgtcatcccatctatctagtttagcagccctgtgagatgagtgatcaccattttacatatgaggaaacaggctcacaagccattaaacagcagaaccaagattcacatgtaggtctttctgactgggaagcctttaatggaaataaacagcctactttttctcacataaaatgcacctgatctgcagcaccatgagaatggttgtggagaaaattcgacttcattctgaatcagagtaaaaggtgttaaggctgtttggtctgtggagggcaagacta

SEQ ID NO: 143204 - DNA, 601 bp, Human
gtcaggagttcaagaccagcctgactaacatggtgaaacccccacctctactaaaaatacaaaaattagccgggcgtggtggtgcgcgcctgtaatcccagctactcaggaggctgaggcaggagaatcacttgaacctgggaggcagaggctgcagtgagccgagatcaggccactgcactccagcctgagcaacaaagcaagactccgtctcaaaaaaaaaaaaaaaaaaaaaaaagacagtcttgccaacaatgcaagcatgcagatttatagacagaaaagcagcaactccttgggracaggtcagcacatacctggggccaaatgaatggtggcggcaataaagtcacaggagggagaaaccaggtgggctgtcccctcagaggcaaccccatgaaccatgtggaaactgctagaagaactggcctgagactggcagggcctaattccagacagagagacctgcctgaggaagttcacatggcatccaagggacacatgtgattgtaatgaggggatagtgtagggtgttagcaggaaaggctacataaactccttcaactattagctatttagactttattttcctgataggaga

SEQ ID NO: 143205 - DNA, 601 bp, Human
gaggggagtaacattatggaaagatattttggctgggtgtggtagctcatgcctgtaatcctagcactttggaaagccgaggcaggaggatcacttgagctcaggagttcaagaccaacctgggcaacatagtgagacctcgtcactatttaaaaaaataaaaaataaataataataaagaaagataatttgagtgactgggaaggggtgaactgaaagagagattaattaaagacagttaagagcaatttgcaaaggtttagttgaaagaaattgaagcccacagttttgtaggccaagrcctggcccttctgcgtgcttcccccatgcccacgtgcacttggaggctggcctctctcctcctcctttcaggcctgcattgcaagtgtgggggcgactggccacgtcttccatttcggtgagggcacaccagaggagccagggtttctagtgatgcgtcaccataacagcaagtctcatttcatgaagtctcactgcatcatcaaatgcttaccccttatccctaaactggcaaaacttactcttagaaaaaagttacatacaatttaacattggaaaagaaaatcttatatttgatttt

SEQ ID NO: 143206 - DNA, 601 bp, Human
catgaagtctcactgcatcatcaaatgcttaccccttatccctaaactggcaaaacttactcttagaaaaaagttacatacaatttaacattggaaaagaaaatcttatatttgattttttttgcattagaaaatattttgacaaccctttttaaaataatttttatcttcatcaaagtagcctatggtttaaatgtcaaaaagaactaaaaggggcctctctgggtcagtttctcaatacagtgggtgaacctcagaggcccagtcagcaaaggtctttgggtctggatgttggggttgktctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacatccctcggttatatccttttttcctcattcactgtaattctagtttcagaaggaagagagattgatgtatatgttagttactgccttactgggaatccttttttttaatgtattatcagct

SEQ ID NO: 143207 - DNA, 601 bp, Human
agcctatggtttaaatgtcaaaaagaactaaaaggggcctctctgggtcagtttctcaatacagtgggtgaacctcagaggcccagtcagcaaaggtctttgggtctggatgttggggttggtctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacrtccctcggttatatccttttttcctcattcactgtaattctagtttcagaaggaagagagattgatgtatatgttagttactgccttactgggaatccttttttttaatgtattatcagctttccctttttaggcaggactacctttatggaggttatgtgcttcttcctttaagccatcctttctactctgaaataatagtgatattagggagtagctggggtcttttttttttaagttgaccccaaaatgtgtttttacattttactggtgtgtgaaatctagaaatcaggaaacaag

SEQ ID NO: 143208 - DNA, 601 bp, Human
aaggggcctctctgggtcagtttctcaatacagtgggtgaacctcagaggcccagtcagcaaaggtctttgggtctggatgttggggttggtctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacatccctcggttatatccttttttcctcattcwctgtaattctagtttcagaaggaagagagattgatgtatatgttagttactgccttactgggaatccttttttttaatgtattatcagctttccctttttaggcaggactacctttatggaggttatgtgcttcttcctttaagccatcctttctactctgaaataatagtgatattagggagtagctggggtcttttttttttaagttgaccccaaaatgtgtttttacattttactggtgtgtgaaatctagaaatcaggaaacaagtgacctaggctttaaaaataaataaataaat

SEQ ID NO: 143209 - DNA, 601 bp, Human; identical to SEQ ID NO: 31751

SEQ ID NO: 143210 - DNA, 601 bp, Human; identical to SEQ ID NO: 31752

SEQ ID NO: 143211 - DNA, 601 bp, Human; identical to SEQ ID NO: 31753

SEQ ID NO: 143212 - DNA, 601 bp, Human; identical to SEQ ID NO: 20272

SEQ ID NO: 143213 - DNA, 601 bp, Human; identical to SEQ ID NO: 20273

SEQ ID NO: 143214 - DNA, 601 bp, Human; identical to SEQ ID NO: 20274

SEQ ID NO: 143215 - DNA, 601 bp, Human; identical to SEQ ID NO: 20275

SEQ ID NO: 143216 - DNA, 601 bp, Human
tcctctctaatgtctatggttttcgaagctgcaattcgggttctcaggattatgcgatgttcaggtgaagccttcttgtcatcctcagtataagagagtccagtctctctggttttctctggggctttcagagctggagacaaggtttgaagtttatcaggctgagatctcttagaaggtgaggtgatctccgagaaggccactttccgttttattcttcctggagaatccaaggaggcacatgaagtctgctgggacatctgagggttacctaagtctaagagaaatcatcacaatgtgyaaattttttacctaacaatatacaaacccacaatctcatcacagccaaattcagccactgagttatatgtaaaacaggaattatctatatttttaatcattccaggcttgctttctccagcccaggtagctctaataatttttcatctctcacctaaattttaggagtgattttcctagttagaaccataagtcaacttttaagtcagcttttgcagataaatggagtgttttctcatctctaacaggtttccctgaaataacctatcagaacagtgggtctcaatcaggggtgacatcg

SEQ ID NO: 143217 - DNA, 601 bp, Human
tgaggtcagaagtttaagaccagcctgaccaacatggtgaaaccctatctctactaaaaatacaaaaatcagccgggcatggtggcacatgcctgtaatctcagctactggggaggctgaggcaggagagtcacttgaacctgggaggtggaggttgcagtgagccaagatcacgccactgcactccagtctagagtccatctaaaaaaaaaaatcactttccaagtaacccaggacacaaacatgactatcggcttacatttttcccttcctctaatccccagtattgaactggtaaggrtgtcctgtagcccttcctgcttcgtcagttctcctcccctcccattaccacctgtacagcctggtgaagaggcactttgtgtggtgaatagcagggactcaagggcctcaagacaaagtgaaaggggaactctggggggtaaggaaacacctaaaccagtctgaccccaagggtatcagtgacacttggcaaccctatgcatcccttcgggctgctgctgggacaagggagacacaagaagaagctaaggcccagccaacatggaacctaacaggacatcctgcaggcacctgaaacttg

SEQ ID NO: 143218 - DNA, 601 bp, Human
tatctgaatatctacaacaattgtctgatttggtccagaagtcccccctgttcccaaggccccagcaggaagcctggtaggggaggggacctgtttggccaaataagcacagccaagccgcagaaacctcggtcttttattaatagtgtttttaaccaaaacatccccaagtactcaggaagaggcgtcagctccctccaggcaccccgtgtaaacagcaatccctgcagagtccactaggtggggccggtgacccagcggaaagggcagaaacgctccccgaggagggaaggcaggtgccgcggatgggacctttgcccggacgatccccaggctggacaagtgctccctactcctgccttgcgtggcttctagtcgatggtgtaaacatcaaccctgggggccacaagcactttagggggcagtcactctagcatctctggatttcaaggtcctcaagccaagtgagtccctcgtgagccaccaagcaagacgcacagccaccaagtcaagttctgccccgaagccccggagcgccaggcgggggcatctgtgcgtgacgcccgtgatctgtctcccgagagaaggcacctgccagcac

SEQ ID NO: 143219 - DNA, 601 bp, Human
agctcctctcgcctgactacctgagcgtgagctgggatgttggcctcctccagcctccagactcggactgaaacactggctcttcctgagcctcgagtccactggcttatgagctggaatttacatccctggctctcctagctctcaggcctttggacttggactggaaccaatattggctgtcctgggtctccagctattgactgcagagattaggacctctaagcctccataatcacctgaatcaattccttctaatacttttcttcgtatgtagatatagatacagataacgcacacrccctgttggttttgtttctctagagaacactgactaacacaaagactcaaccttgggcttcccgttggctgcatatttgggcgtggaaggcccagcgataaggcggtgccagaagccagatatctgaatatctacaacaattgtctgatttggtccagaagtcccccctgttcccaaggccccagcaggaagcctggtaggggaggggacctgtttggccaaataagcacagccaagccgcagaaacctcggtcttttattaatagtgtttttaaccaaaacatccccaagtactcagga

SEQ ID NO: 143220 - DNA, 601 bp, Human
ggcatgtgccaccacgcccggctaatttttgtatttttagtagagacagggtttcaccatgttggccaggctagtctcaaactcctgacctcaggtaatctggctgcctcagtctcccagagtgctgggattccaggcgtgagccaccgcgcccagcctgagagtaatagattttcatctgcgcaaagcttatctgctttccatcctgggtggctgaaggaataatagtatgacacttcattttctaggccaacctgactaggccacaaggtgtccagatacttgtccaaacattaatccrgacatatttgtgaggcatttgggatgaggttgatatgtgtattggtggactgagtaaaaagactcctccccagtataggtgggcctcatccaatccactgaacacctgaatcaacaaaaaggcagaataagaggaagctcctctcgcctgactacctgagcgtgagctgggatgttggcctcctccagcctccagactcggactgaaacactggctcttcctgagcctcgagtccactggcttatgagctggaatttacatccctggctctcctagctctcaggcctttggacttggact

SEQ ID NO: 143221 - DNA, 601 bp, Human
tactaagcttcccaagaggcaagcagacagaggagtctgtggcctgtggggaggcgggttttctgtaagaccatggtcctgccttaggaacctacacccccacttgtcagctgagatgagtcctggccctttcttctcagagtgaaactgggcagtctccgctgaatggagccacccgtggtctgtgggcctggccctgccgtgctgccctgctcagcctggacttgggcagggtttatggggcagggcttcaggtttcaccctaatacctctgtgggatccatgtcttggggacacaaamgaagacaaaggcagagtgcaaggctgtggaagggcgtgctggggagagaggagcatgtcctgccaacaccgcagagacccggcttcacccggggccaccccatgtggcagaaaggaggttgattgcaaaagcaggttcggtcatggtgcagcagatattgatcagacttggtctttgcagtggtaatgctgttggctccccagccctctaaacctggcgagaaaagtcttgtgggccctggtggccaagggctgtgcactttggtgagccaggcctaatgctgcaggcctcccctcatgc

SEQ ID NO: 143222 - DNA, 601 bp, Human
ttgaactactgatctcaggtgatccacccacctcggcctcccaaagtgctgggatgacaggcgtgagccaccgcacccggccaatggtgaggatttcaattcgcctccacccttatctttgggttctcctgcaggctggagtctaatcccctgtttcgattttacattgacaaagcattctgccaaacaccatctcacagaaacctcacaacagctgtgaggtttgagccctgtgaggtcaggagggaggaaattctcagtgtcttcacactacagatgagcaaactgcagctctggtggrgagtcatgagtgacacccctcaggccacacagtgagacagtggtagagtggggacaaaacccagttcttctctctgccttgtagcccctttttactaagcttcccaagaggcaagcagacagaggagtctgtggcctgtggggaggcgggttttctgtaagaccatggtcctgccttaggaacctacacccccacttgtcagctgagatgagtcctggccctttcttctcagagtgaaactgggcagtctccgctgaatggagccacccgtggtctgtgggcctggccctgccgtgctgc

SEQ ID NO: 143223 - DNA, 601 bp, Human
ttctttttcttttgagatggcatctcactctgttcccctggctgctggagtgcaatggcgtgatctcagctcactgcaacctctgcccccactgggttctagcaattctcctgcctcagtctcccaagtagctgggattataggcacctgccaccacacccagctaattttttgtgtatgtttttagtagagacagggtttcaccatgctggccaggatggtcttgaactactgatctcaggtgatccacccacctcggcctcccaaagtgctgggatgacaggcgtgagccaccgcaccyggccaatggtgaggatttcaattcgcctccacccttatctttgggttctcctgcaggctggagtctaatcccctgtttcgattttacattgacaaagcattctgccaaacaccatctcacagaaacctcacaacagctgtgaggtttgagccctgtgaggtcaggagggaggaaattctcagtgtcttcacactacagatgagcaaactgcagctctggtggggagtcatgagtgacacccctcaggccacacagtgagacagtggtagagtggggacaaaacccagttcttctctctgc

SEQ ID NO: 143224 - DNA, 601 bp, Human
atgatagggacaatgatgatgatttttttttcctttttttctttttcttttgagatggcatctcactctgttcccctggctgctggagtgcaatggcgtgatctcagctcactgcaacctctgcccccactgggttctagcaattctcctgcctcagtctcccaagtagctgggattataggcacctgccaccacacccagctaattttttgtgtatgtttttagtagagacagggtttcaccatgctggccaggatggtcttgaactactgatctcaggtgatccacccacctcggcctyccaaagtgctgggatgacaggcgtgagccaccgcacccggccaatggtgaggatttcaattcgcctccacccttatctttgggttctcctgcaggctggagtctaatcccctgtttcgattttacattgacaaagcattctgccaaacaccatctcacagaaacctcacaacagctgtgaggtttgagccctgtgaggtcaggagggaggaaattctcagtgtcttcacactacagatgagcaaactgcagctctggtggggagtcatgagtgacacccctcaggccacacagtgagaca

SEQ ID NO: 143225 - DNA, 601 bp, Human
ccaacacgtgaaaggttcagcacaagcctctctaagcagctgtgatgagggggaggaggaggaagaggatgatagggacaatgatgatgatttttttttcctttttttctttttcttttgagatggcatctcactctgttcccctggctgctggagtgcaatggcgtgatctcagctcactgcaacctctgcccccactgggttctagcaattctcctgcctcagtctcccaagtagctgggattataggcacctgccaccacacccagctaattttttgtgtatgtttttagtagagacrgggtttcaccatgctggccaggatggtcttgaactactgatctcaggtgatccacccacctcggcctcccaaagtgctgggatgacaggcgtgagccaccgcacccggccaatggtgaggatttcaattcgcctccacccttatctttgggttctcctgcaggctggagtctaatcccctgtttcgattttacattgacaaagcattctgccaaacaccatctcacagaaacctcacaacagctgtgaggtttgagccctgtgaggtcaggagggaggaaattctcagtgtcttcacact

SEQ ID NO: 143226 - DNA, 601 bp, Human
ctaatcttaggcaaattacgtcacctctctgagccccagttttcgcacctgtaatgtggagatggttatagcacctacctcatagagttgttggggctcttaaatgaaaccaacacgtgaaaggttcagcacaagcctctctaagcagctgtgatgagggggaggaggaggaagaggatgatagggacaatgatgatgatttttttttcctttttttctttttcttttgagatggcatctcactctgttcccctggctgctggagtgcaatggcgtgatctcagctcactgcaacctctgyccccactgggttctagcaattctcctgcctcagtctcccaagtagctgggattataggcacctgccaccacacccagctaattttttgtgtatgtttttagtagagacagggtttcaccatgctggccaggatggtcttgaactactgatctcaggtgatccacccacctcggcctcccaaagtgctgggatgacaggcgtgagccaccgcacccggccaatggtgaggatttcaattcgcctccacccttatctttgggttctcctgcaggctggagtctaatcccctgtttcgatttt

SEQ ID NO: 143227 - DNA, 601 bp, Human
gcagatcacctgaggtcaggagatcaagaccagcctggccaacgtggtgaaaccccgtctctactaaaaatacaaaaaattagccaggcgtactggcgggtgcctgtaatccccgctactagggaggctgaggcagaagaatcacttgaaccccgggaggcggaagctgcagtgagccgagatcacaccactgcactccagcctgggtgacagaaggagactctgtctcaaaaaaataaaatacataggctgggcgaggtggctcacgcctgtaatcccagcactttgggaggccgaggcrggcggatcacctgaggttgggagttcaagaccagcctggccaacatgatgaaaccccatctctactaaaaatacaaaattagccggatgtggtggcctgtaatcccagctacttgggaggctgaggcaggagaatcacttgaacccaggaggcggaggctgcaatgagccgagattgcgccactggactccagcctgggtgacagagggagacgccatctcaaataaataaattacataaaataaaataaagctaatgttgaggagaagccggtacacaacactgtttatacagtgaaac

SEQ ID NO: 143228 - DNA, 601 bp, Human
ctaactgcagccacagatgggactggattcgtcaccttccagatcaccttgctcctccctctgcctcctctctgttctagtacaggtcactccaaaatcatatacatagttcaactacataaagctaatgttggccagatgcagtggctcacgcctgtaatcccagcactttgggaggccgaggcgggcagatcacctgaggtcaggagatcaagaccagcctggccaacgtggtgaaaccccgtctctactaaaaatacaaaaaattagccaggcgtactggcgggtgcctgtaatcccmgctactagggaggctgaggcagaagaatcacttgaaccccgggaggcggaagctgcagtgagccgagatcacaccactgcactccagcctgggtgacagaaggagactctgtctcaaaaaaataaaatacataggctgggcgaggtggctcacgcctgtaatcccagcactttgggaggccgaggcgggcggatcacctgaggttgggagttcaagaccagcctggccaacatgatgaaaccccatctctactaaaaatacaaaattagccggatgtggtggcctgtaatcccagctact

SEQ ID NO: 143229 - DNA, 601 bp, Human
gctaatatttactgagcacctactgtgtgccaggcacagttctcggcaccagagactgcaatgagcaagttttgttacaaaaccgacaaaatctctctctcgtgagagttcacaattctagcacggagttggtcctgaggccacagaggtaggcagggggtccaggggtcaggtcacacaaggccttgacagctgtgcaaagggaaggggggccccataggcgaagggaaggtgctggaggatttcaggacaggtgtgacaggacattcatcctgcatccctcctgctgacatcagatgastctttctaaaacactgctcactctatgcccagcaggaagccaccaagccagcccaaacaagagccgtggggccccagctgatgactcacccatctcactgttgacagtaacctctcaaagggcctggcacgttctcacttccaggcctttaacaacggcaggtcctcggcttgaagcactttctcccgcctcttggcttctccctggctctcccagctttcctggcagaaactcaagccccacctccagactgtatgaagctcagtagctcttcagccaatgggaactgacaccaaaggg

SEQ ID NO: 143230 - DNA, 601 bp, Human
cacctgtaatcccagcactttgggaggctgaggcaggcagatcacctgaggtcaggagtttgagaccatcctggctaacacggtgaaaccccgtctctactaaaaatacaaaaattagctaggcgtggtggtggacgcctgtagtcccagctactcaggaggctgaggcaggagaatcgcttgaacccaggaggcggaggttgcagtgagccgagatcgcgccactgcactccagcctgggtgacagagagagactccgtctcaaaaaaaaaaagcagtggttagagatgctggtggggcyggggaacagacaggagagagactatgtgaggcacaatgacatgagtttagtctggctggttcatgcattcattcagctaatatttactgagcacctactgtgtgccaggcacagttctcggcaccagagactgcaatgagcaagttttgttacaaaaccgacaaaatctctctctcgtgagagttcacaattctagcacggagttggtcctgaggccacagaggtaggcagggggtccaggggtcaggtcacacaaggccttgacagctgtgcaaagggaaggggggccccataggcgaa

SEQ ID NO: 143231 - DNA, 601 bp, Human
tcacttgagttcaggagttcgtgaccagcctggtctacgtggtaaaaccctgtctctactaaaaatacaaaaattaaccaggaggggtggcacaggcctgtaatcccagctactctggaggatgaggcacaagaattccttgaatccgggaggcagtggttgcagtgagctgagatcacaccactgcactctagtctgggcgacagagcaagactctgtctcaaaaaaaaaaaaaaaaattatggccgggcgcagtggctcacacctgtaatcccagcactttgggaggctgaggcaggcrgatcacctgaggtcaggagtttgagaccatcctggctaacacggtgaaaccccgtctctactaaaaatacaaaaattagctaggcgtggtggtggacgcctgtagtcccagctactcaggaggctgaggcaggagaatcgcttgaacccaggaggcggaggttgcagtgagccgagatcgcgccactgcactccagcctgggtgacagagagagactccgtctcaaaaaaaaaaagcagtggttagagatgctggtggggctggggaacagacaggagagagactatgtgaggcacaatg

SEQ ID NO: 143232 - DNA, 601 bp, Human
ttgcgatttttttttttttttttttttttttttgagacggagtctcgctctgtcacccaggctggagtgcagtggcatgatctcagctcactgcaacctccgcctcctcggttcaacccattctttcgcctcagcctcccaagtagctgggattacaggaacccgccaccaggcccggctaatttttgtatttttagtagagatggggtttcatcatgttggccaggctggtctcgaacccctgacctcaggtgatccacccgcctcggcctcccaaagggctgggattacaggtgtgagmcacggcacctggcccactgcttatttttagattcgactttaaacgtcacctcctccagggagcctcccgtgactccccgttggctgcgtcagatgtgcccgctggtgccctcagagcccactctacgttcccaatcgtggcacttctattttaacttctttattttcctgttacatcactaacaattctaactctgtagacacacataataaagaaagagaaagtctcctctggttccctctgacagagggagcctctaagagttagttatacatttttccttatttgtgtccacgaata

SEQ ID NO: 143233 - DNA, 601 bp, Human
tagcatcggaatgcagccatggacagggaaccccgtgcctaccctcgcggagctgacagtctcagggacagattgacctggtgactgactcccaaggcagtgtcaagggaggggcaaggccgtactggggaggggagcagtgtcagaactctgcagctgaggtgccacttttctggaagggataacatggaaacacctattgcgatttttttttttttttttttttttttttgagacggagtctcgctctgtcacccaggctggagtgcagtggcatgatctcagctcactgcaacctccrcctcctcggttcaacccattctttcgcctcagcctcccaagtagctgggattacaggaacccgccaccaggcccggctaatttttgtatttttagtagagatggggtttcatcatgttggccaggctggtctcgaacccctgacctcaggtgatccacccgcctcggcctcccaaagggctgggattacaggtgtgagccacggcacctggcccactgcttatttttagattcgactttaaacgtcacctcctccagggagcctcccgtgactccccgttggctgcgtcagatgtgcccg

SEQ ID NO: 143234 - DNA, 601 bp, Human
tcatggagggtgaggggcataagcacacaccacacctagctactgttggaaatctttcgcagccactgagatttctgacaccatcaagtctaaatctcagtctccaatggttgactccccacagtcttcccccacacccaccctccattccctccttccctgacccaatcagcaagcatttgttaacgcctgacccaatcagcaagcatttgttaaccgcctgacccaatcagcaagcagttgttaaccgcctgacccaatcagcaagcatttgttaacgcctgacccaatcagcaagcakttgttaaccgcctgacccaatcagcaagcatttgttagccgcctgctgtgcaccaggcagtgtgctagcatcggaatgcagccatggacagggaaccccgtgcctaccctcgcggagctgacagtctcagggacagattgacctggtgactgactcccaaggcagtgtcaagggaggggcaaggccgtactggggaggggagcagtgtcagaactctgcagctgaggtgccacttttctggaagggataacatggaaacacctattgcgatttttttttttttttttttttttttttgag

SEQ ID NO: 143235 - DNA, 601 bp, Human
agagtgcccctccatcagacacagactccactcacaggccctcggtgcccccctggaggggaagtgactcaccagtccccacagcttccctccccttccctgacaaatgccctgagccagccctggacctgagctccacactccgtctgcctcggcctggctcctaatgttctccatagaagcagcctgcttcaaaggcccccccaaacggtttattccaaagccagaggcctccctctccgactctttggcctctgcagtctagagtttctccaagccctcagctgccctgttgatgcargcactgccccgaccactctctggtgtaggctggcccttcattctcccgcctcctgtaaatgtggagtcacttgcttgggcccagcctcagccctctgctcccttcccccagagaagcagcccttctcccttccaggccagtggtggcccgctgccagctgcagccctggtgtcttgctgggctctaggtctagcacctgccccggccactgggtctcctcacttggaagcccagccacggcccttccactccacacatctggaccaaaggacccttcctccttctgaaacagcttcccct

SEQ ID NO: 143236 - DNA, 601 bp, Human
atcctcgtccccgttccccacacctctacacggcatggtgagactgacgcccacttcttcccaaaatccctgaaccccacacaagtgactccctgagtatccagggcctctctactccaccctgtccccggtggctggaaattccagtgagtaatgagagtgcccctccatcagacacagactccactcacaggccctcggtgcccccctggaggggaagtgactcaccagtccccacagcttccctccccttccctgacaaatgccctgagccagccctggacctgagctccacactccrtctgcctcggcctggctcctaatgttctccatagaagcagcctgcttcaaaggcccccccaaacggtttattccaaagccagaggcctccctctccgactctttggcctctgcagtctagagtttctccaagccctcagctgccctgttgatgcaggcactgccccgaccactctctggtgtaggctggcccttcattctcccgcctcctgtaaatgtggagtcacttgcttgggcccagcctcagccctctgctcccttcccccagagaagcagcccttctcccttccaggccagtggt

SEQ ID NO: 143237 - DNA, 601 bp, Human
acgcaagctcatggctgcctgatctctgttcaaaataagctaaaatctggcttattaacaggaatgctcctgattttaaaacgatggcaaataattaacattttaaaacaacatggtgccgtctaaatgaaccacacctgtggcccgagttcaggccacagccccccactccccccagaattcttcagaagctctgggctctaggtggggctcatgcaattccattggcagcagagaagctgccctccctggagagaggctccatcctgttgcagagctgaaatacagagcaggggattgsggggtgagcccttgaggggccccagggctaacagcctttgatcagggaactgtgccaccagggttcaacagaggcacacccccaccccacccatctccttccagcccctggttttcccctgtccctgcctgggtgggttataaatagccagggcgcatctgaagggccctttcagccacaattcctcatttggtgcgggcgggtgaggctgtggcgagggcttgggaacgaccaggcctggcattccccagggcacaagtatgccagctcagggcctggtaccacgggttcttctgtctc

SEQ ID NO: 143238 - DNA, 601 bp, Human
ctgcgggtgaggccagccggtgaagcgagccaggtagggcagggtgaaaccaccactcactccagccgatggctgctggaggaaacgcaagctcatggctgcctgatctctgttcaaaataagctaaaatctggcttattaacaggaatgctcctgattttaaaacgatggcaaataattaacattttaaaacaacatggtgccgtctaaatgaaccacacctgtggcccgagttcaggccacagccccccactccccccagaattcttcagaagctctgggctctaggtggggctcatgsaattccattggcagcagagaagctgccctccctggagagaggctccatcctgttgcagagctgaaatacagagcaggggattgcggggtgagcccttgaggggccccagggctaacagcctttgatcagggaactgtgccaccagggttcaacagaggcacacccccaccccacccatctccttccagcccctggttttcccctgtccctgcctgggtgggttataaatagccagggcgcatctgaagggccctttcagccacaattcctcatttggtgcgggcgggtgaggctgtggcg

SEQ ID NO: 143239 - DNA, 601 bp, Human
caggcagggtgctctgaagagcacctaacctgagagtgtttgttgaatgaatccaggagctttcttcccaccgctctgtggccacctgcttgtcttctccctctgaggccaatgccggtagaggagggaggaattctagaggtgttcaggatggagcagggagcctggaactccccggcattcgagaaaggtctccttcccccatgctggcagcaaagtagaggggaagacaccatcccggtgctcacggggacccaggaggagcagcgttttcaggtgtgacacgtgctcaggctctctyggcatccgtgggccaccgccgtacacagcaggacacctctgagatggagcgaggctgggaacctggtgcacccttcgtgggccccagcgggcctcacacattgtgcagactctcacaggcaccagccccacaccaagcactgtgcagtgttcagcaatgaatatgacatggtcctggtcctccaggagaatgggatataattgcggaggcaaatgtctagagttctgagcatctgagcagaatgaaatacgggcttagctgaggcatacgccggggtccagcagaaggggaggtccagga

SEQ ID NO: 143240 - DNA, 601 bp, Human
catccaggccatccccaactccactagaagtggtcccttctcccctgaatttggtgcccttttatcagtactcttctcacagtcttttttttttttttttttttgagactgagtctcaccctgtcgcccaggctggaatgcagtggcatgatcttggctcgctgcaacctctgcctcccaggttcaagcgattctcctgcctcagcctcctgagtagctgggattacagacgcccaccactacgcccggctaatttttgtatttttagtagagatgtggtttcactatattggtcaggctratctcgaactcctgacctcaggtgatccgcccacctcagcctcccaaagtgctgggaatacaggcgtgtgccaccgcatctggcccaccctgcctacttccgtactctattcctactccctgtacctgccccttgctctgaacgccttgtgagggaagatcacgccttgttcctcttgtcatctctacagtgccaggcagggtgctctgaagagcacctaacctgagagtgtttgttgaatgaatccaggagctttcttcccaccgctctgtggccacctgcttgtcttctccctctgag

SEQ ID NO: 143241 - DNA, 601 bp, Human
cctggcacttgggcacatgctcacaacgcaactgctgcttaaggtaagtacccctaaagtaaagtaatagcaaagagaattgccttggattcctactagctgccagggaagggtgtgccaagaacctctgcagcccaggacaggagtgtatcatccagaaatgacccttggcctgcacacacacacacacatgcacgcatccaggccatccccaactccactagaagtggtcccttctcccctgaatttggtgcccttttatcagtactcttctcacagtcttttttttttttttttttttgagactgagtctcaccctgtcgcccaggctggaatgcagtggcatgatcttggctcgctgcaacctctgcctcccaggttcaagcgattctcctgcctcagcctcctgagtagctgggattacagacgcccaccactacgcccggctaatttttgtatttttagtagagatgtggtttcactatattggtcaggctgatctcgaactcctgacctcaggtgatccgcccacctcagcctcccaaagtgctgggaatacaggcgtgtgccaccgcatctggcccaccctgcctacttccgt

SEQ ID NO: 143242 - DNA, 601 bp, Human
gtaatcccagcactttgggaggccaagaggggcagattgcttgagcccaggagttacagactagcatgggcaacatggtgaaaccctgtctctacaaaaatataaaaattagcccaacgtggtggcatgtgcctgtagtgagggggaggctgaggtgggaggactgattgagtctgggaggtggaggccacagagagccatgattgtgccatcgcactccagcctgggtgacagagtgagactctgtctcaaaagaaaaaaaaaaatggcacagaatgatacctaaagggttaatctgcaytacaaaagggtttttattcctgacaaataagttccttaaaatagcaccttctacaacgcccccgtcacaaccctacctatctttaaatagaatggcatgaaacatttttggcaagtgtaagccattttacaaatgcaacatgacgctgctatcagtattttatttgcattaccagttttacagatcaataactcttcaaaggtaagtctgggctgagatatgcagcaaactccagctatagctttggagaaaactgcagccaactttacctctgccccccaggaagatgaagcgtcttgg

SEQ ID NO: 143243 - DNA, 601 bp, Human
cacccattcccaccgggagccaggcactgggaatacgaaggtgaaggagaggtgcccacgtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagcatcctgcacaatctgctaggctgacagtgtggcagcttgaagccgccaaaccaaagacgtcaggtcactctggtaggaacartgtctagagataaggcgtggccagctcaggcctggtcctccacagagttgagaggctaaataaagcctccaaacatctggttccaggccaagcaaagacacaatctctccagtagcactggcctccaagacaacaagcagggctggctctctggctgcgactcaaggctatagggcatgcagcgagggtctgaggcttcacagacggtagaagtcagttcacgggccacagctggctgccaggagtacccagcaggatctgctcagagtagatgccactgggcctgggggtgggggtggc

SEQ ID NO: 143244 - DNA, 601 bp, Human
gctgagattggagcaaaggcgttggagagcgtacggatgggaaattagcctcggtgcacttggctaacaggagacccgttgctcagtcaccaccaaaggaaggcctgttccatctcccatcttttccagctttcctcagactccacaattcccagtttagagccatgaggaaattcacattgtttcttcagtctttgcagggcgtctcttgtctcatcaaaaaccaggctcaccactcactcacccattcccaccgggagccaggcactgggaatacgaaggtgaaggagaggtgcccacrtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagcatcctgcacaatctgctaggctgacagtgtggcagcttgaagccgccaaaccaaagacgtcaggtcactctggtaggaacaatgtctagagataaggcgtggccagctcaggcctggtcctccacagagttgagaggctaa

SEQ ID NO: 143245 - DNA, 601 bp, Human
tcatagtccactcttgaaaggctggttctgatgggaagacaactcaggaagaccctccctcaagaggcaacagtcagccccaagagtcctgctctgggccccgttcacgctgcagttttggctgagattggagcaaaggcgttggagagcgtacggatgggaaattagcctcggtgcacttggctaacaggagacccgttgctcagtcaccaccaaaggaaggcctgttccatctcccatcttttccagctttcctcagactccacaattcccagtttagagccatgaggaaattcacatygtttcttcagtctttgcagggcgtctcttgtctcatcaaaaaccaggctcaccactcactcacccattcccaccgggagccaggcactgggaatacgaaggtgaaggagaggtgcccacgtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagcatcctgcacaatctgctaggc

SEQ ID NO: 143246 - DNA, 601 bp, Human
tcctcccctcaagacttccattcatagtccactcttgaaaggctggttctgatgggaagacaactcaggaagaccctccctcaagaggcaacagtcagccccaagagtcctgctctgggccccgttcacgctgcagttttggctgagattggagcaaaggcgttggagagcgtacggatgggaaattagcctcggtgcacttggctaacaggagacccgttgctcagtcaccaccaaaggaaggcctgttccatctcccatcttttccagctttcctcagactccacaattcccagtttasagccatgaggaaattcacattgtttcttcagtctttgcagggcgtctcttgtctcatcaaaaaccaggctcaccactcactcacccattcccaccgggagccaggcactgggaatacgaaggtgaaggagaggtgcccacgtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagc

SEQ ID NO: 143247 - DNA, 601 bp, Human
caattcaccggagtctcaaaacctggcaggtgttatcatcttcctgaggcaccgagagtcgggactgccagaggcctgcacagcctccagcacacgtagccccgggggacaagatcagagcctggaacagcccccagctccagcccctccaggtcagaccctcaggggtcttcctgctgcttcccagccttgacaaatgggaactcatcccctgtgctgggggctagcactccctcctgttccctgccaaccaaggttttgcctgagggtttagcaaatgccacaccgtgagctgtaactrtagagctggttggactaggatggggggaagaaagggatttgcagccccagccacaaacaagcttcatcccccctggcacgagcatagaccctggaagccctgtaatcgcccatttctgcaagatcctcccctcaagacttccattcatagtccactcttgaaaggctggttctgatgggaagacaactcaggaagaccctccctcaagaggcaacagtcagccccaagagtcctgctctgggccccgttcacgctgcagttttggctgagattggagcaaaggcgttggagagcgtacgg

SEQ ID NO: 143248 - DNA, 601 bp, Human
gtggttcaattcaccggagtctcaaaacctggcaggtgttatcatcttcctgaggcaccgagagtcgggactgccagaggcctgcacagcctccagcacacgtagccccgggggacaagatcagagcctggaacagcccccagctccagcccctccaggtcagaccctcaggggtcttcctgctgcttcccagccttgacaaatgggaactcatcccctgtgctgggggctagcactccctcctgttccctgccaaccaaggttttgcctgagggtttagcaaatgccacaccgtgagctktaactgtagagctggttggactaggatggggggaagaaagggatttgcagccccagccacaaacaagcttcatcccccctggcacgagcatagaccctggaagccctgtaatcgcccatttctgcaagatcctcccctcaagacttccattcatagtccactcttgaaaggctggttctgatgggaagacaactcaggaagaccctccctcaagaggcaacagtcagccccaagagtcctgctctgggccccgttcacgctgcagttttggctgagattggagcaaaggcgttggagagc

SEQ ID NO: 143249 - DNA, 601 bp, Human
caccatgttggccaggctcgtctcaaactcctgacctcaggtgatgcgcccgcctcggcctcccaaagtgctgggattacaggtgtgagccatggagccgggccgagatcctttttagatttctgtataagagaataaatttgtgtggttttaagcccttaagtttgtggcgatttgtttcagcagcattagaaaagcaagacagaccccacgcttcaggcaagggcaatagttacttattggcggcttcacaaattccaggaactgagcttagctatctttgtggttcaattcaccggastctcaaaacctggcaggtgttatcatcttcctgaggcaccgagagtcgggactgccagaggcctgcacagcctccagcacacgtagccccgggggacaagatcagagcctggaacagcccccagctccagcccctccaggtcagaccctcaggggtcttcctgctgcttcccagccttgacaaatgggaactcatcccctgtgctgggggctagcactccctcctgttccctgccaaccaaggttttgcctgagggtttagcaaatgccacaccgtgagctgtaactgtagagctggttg

SEQ ID NO: 143250 - DNA, 601 bp, Human
cccctgttctcaagtggcttagactctagtgggaaagacatttattttttcttttttttttttttttagagacggagtctcgctctgtcgcccaggctagagtgcagtggcgcgatctcggctcactgcaagctccgcctcccgggttcacgccattctcctgcctcagcctcccgagtagctgggactacaggctcccgccaccacgcccagctaactttttgtatttttagtagagccgggatttcaccgtgttagccaggatggtctcgatctcctgacctcgtgatccgcccgcctyggcctcccaaagtgctgggattacaggtgtgagccaccgcaccctgccggaaagacatttaaaaaacaagtaaagattcggccctagactgggacatggggcccaccatatcctttatgagccacctgcagtggcccggatgcccgtccctacccttccagtctttcccacagccaggacatcgctcagtctcccccacacgcaggagaaccagcctcctcatcttcaaaggtctctagctttcggttcgttctttacctgctgcctaaaatgccatctttccctgaggcatcgtggcca

SEQ ID NO: 143251 - DNA, 601 bp, Human
ccaccaggccctatagataccatgggaaacagacagtggcccctgttctcaagtggcttagactctagtgggaaagacatttattttttcttttttttttttttttagagacggagtctcgctctgtcgcccaggctagagtgcagtggcgcgatctcggctcactgcaagctccgcctcccgggttcacgccattctcctgcctcagcctcccgagtagctgggactacaggctcccgccaccacgcccagctaactttttgtatttttagtagagccgggatttcaccgtgttagccargatggtctcgatctcctgacctcgtgatccgcccgccttggcctcccaaagtgctgggattacaggtgtgagccaccgcaccctgccggaaagacatttaaaaaacaagtaaagattcggccctagactgggacatggggcccaccatatcctttatgagccacctgcagtggcccggatgcccgtccctacccttccagtctttcccacagccaggacatcgctcagtctcccccacacgcaggagaaccagcctcctcatcttcaaaggtctctagctttcggttcgttctttacctg

SEQ ID NO: 143252 - DNA, 601 bp, Human
ttttgcttccctcaatctattttccacctgggttctcgaaccgacttttcctccctctcttcctctcctcctgcctgtcccacacaccagagctggattcaactcctaagagtgccaccttgcccgatgcttgccaaggaccgagtatgaataccgcaaaacgcgagtacttggggattccactgggctatgtgtccatttatttattcattcaataaatatttactgaatgtccaccaggccctatagataccatgggaaacagacagtggcccctgttctcaagtggcttagactctartgggaaagacatttattttttcttttttttttttttttagagacggagtctcgctctgtcgcccaggctagagtgcagtggcgcgatctcggctcactgcaagctccgcctcccgggttcacgccattctcctgcctcagcctcccgagtagctgggactacaggctcccgccaccacgcccagctaactttttgtatttttagtagagccgggatttcaccgtgttagccaggatggtctcgatctcctgacctcgtgatccgcccgccttggcctcccaaagtgctgggattacaggt

SEQ ID NO: 143253 - DNA, 601 bp, Human
catgttggccaggctggtatagaactcctgacctcaggtgatccgtccgcctcagcctcccaaagtgctgggattacaggcgtgagccaccgcgcccggcccccctttcccctttccttttattttaagcgacactttcataggggataaaagtcagatattattataaaaaatatacaaaacatgcagaaatataaaaggaaaagacaatcacccatattcctcctgtaacatctcgttttgcttccctcaatctattttccacctgggttctcgaaccgacttttcctccctctcttcytctcctcctgcctgtcccacacaccagagctggattcaactcctaagagtgccaccttgcccgatgcttgccaaggaccgagtatgaataccgcaaaacgcgagtacttggggattccactgggctatgtgtccatttatttattcattcaataaatatttactgaatgtccaccaggccctatagataccatgggaaacagacagtggcccctgttctcaagtggcttagactctagtgggaaagacatttattttttcttttttttttttttttagagacggagtctcgctctgtcgc

SEQ ID NO: 143254 - DNA, 601 bp, Human
cctcccgggttccagtgattcccctgcctcagcctcccgagtagctgggattacaggcacctgccaccatgcccagataatttttgtatttttagtagagatggggtttcaccatgttggccaggctgatatagaactcctgacctcaggtgatccacccacctcagcctcccaaagtgctgggattacaggtgtgagccaccatgcccagccattatgccagactaattttttttgtatttttagtagagatggggtttcaccatgttggccaggctggtatagaactcctgacctcagktgatccgtccgcctcagcctcccaaagtgctgggattacaggcgtgagccaccgcgcccggcccccctttcccctttccttttattttaagcgacactttcataggggataaaagtcagatattattataaaaaatatacaaaacatgcagaaatataaaaggaaaagacaatcacccatattcctcctgtaacatctcgttttgcttccctcaatctattttccacctgggttctcgaaccgacttttcctccctctcttcctctcctcctgcctgtcccacacaccagagctggattc

SEQ ID NO: 143255 - DNA, 601 bp, Human
cttcagagcatgacatcacccaacacgggcggggggaccggaaggccccagagcagggactgtactcaccagcaacagggcttccagctggttaatgtagatctcttcgctggccaagaaccccgagagaaccagcttcctcatctccaggcctttccctgcttccacctgcacaaacgcaaagcacagccaacagctcatgagcaaggaggccaaaaccctgcgtggacggtctgcttccctgcccttcccccccgacctttattttttttttgagacgaagtctcgctctgtcacctargctgaagtaaagtggcacaatctcggctcactgcaacctccgcctcccgggttccagtgattcccctgcctcagcctcccgagtagctgggattacaggcacctgccaccatgcccagataatttttgtatttttagtagagatggggtttcaccatgttggccaggctgatatagaactcctgacctcaggtgatccacccacctcagcctcccaaagtgctgggattacaggtgtgagccaccatgcccagccattatgccagactaattttttttgtatttttagtagagatggggt

SEQ ID NO: 143256 - DNA, 601 bp, Human
agccgagatcgcaccactgcactccagcctgggtgacaagagcaaagctccgtcttaaaaaaaaaaaaaaaaaaaaaaagaacacagcctcccacctcatatttcctgacacggggcctcaggatggcactaacggttccctcacccagggaggtagaaggacttggacacaagacggcagagacttcttaactggattgattgggaatgactgcccagagcacagcgtggagaaggcgctcggcccccgcccaggcaggcagagcaccgtgatgggttcacgatgccctatgccagggtygtgggtgacaggtgtgtttgccatctctaagccgggtgtgcttctcctgccttttgagagctggagctgagaggcacaggccctttctggcaatgacccgggctgcccgatgcccagccagaagcagaccagctgcagactctgtccacagggagggacgggtacggtcccctttcctctccaactccaaaagcagcttcagagcatgacatcacccaacacgggcggggggaccggaaggccccagagcagggactgtactcaccagcaacagggcttccagctggttaatgtagatct

SEQ ID NO: 143257 - DNA, 601 bp, Human
cacttgaacccgggaggcagaggttgcagtgagccgagatcgcaccactgcactccagcctgggtgacaagagcaaagctccgtcttaaaaaaaaaaaaaaaaaaaaaaagaacacagcctcccacctcatatttcctgacacggggcctcaggatggcactaacggttccctcacccagggaggtagaaggacttggacacaagacggcagagacttcttaactggattgattgggaatgactgcccagagcacagcgtggagaaggcgctcggcccccgcccaggcaggcagagcaccrtgatgggttcacgatgccctatgccagggtcgtgggtgacaggtgtgtttgccatctctaagccgggtgtgcttctcctgccttttgagagctggagctgagaggcacaggccctttctggcaatgacccgggctgcccgatgcccagccagaagcagaccagctgcagactctgtccacagggagggacgggtacggtcccctttcctctccaactccaaaagcagcttcagagcatgacatcacccaacacgggcggggggaccggaaggccccagagcagggactgtactcaccagc

SEQ ID NO: 143258 - DNA, 601 bp, Human
ggaggccaaggcgggcagatcacctgaggtcaggagttggaaaccagcctggccaacatgataaaatcctgtctctactaaatacaaaaattagccaggactggtggcgtgcacgtgcaattccagccactcgggaggctgaggcaggagaatcacttgaacccgggaggcagaggttgcagtgagccgagatcgcaccactgcactccagcctgggtgacaagagcaaagctccgtcttaaaaaaaaaaaaaaaaaaaaaaagaacacagcctcccacctcatatttcctgacacggggmctcaggatggcactaacggttccctcacccagggaggtagaaggacttggacacaagacggcagagacttcttaactggattgattgggaatgactgcccagagcacagcgtggagaaggcgctcggcccccgcccaggcaggcagagcaccgtgatgggttcacgatgccctatgccagggtcgtgggtgacaggtgtgtttgccatctctaagccgggtgtgcttctcctgccttttgagagctggagctgagaggcacaggccctttctggcaatgacccgggctgcccgatgccca

SEQ ID NO: 143259 - DNA, 601 bp, Human
ctcaagtgatctgcccacctggggctcccaaagtgctgggattacaggcactgagccacggcgcccggcctgcacctgcacatttacacagtcattcctgggtaacataaatgtcaagtcccctgggacactgacagcatctcagggttgacgtgtgacaacacctcacgtcatggcaagtacttaaatgtgcatcttagaattcttgttaagaatgagcttccacagatccacacttctgcgtctcccttttctgacaattaccttatgtctcaggctgcaaaatacccaaaagaaagaytgacacgccacgatcactctgcataacatccagacacatctaaggagcactttcttccaaggcaaaaccacctcacatctgtgtagtacttttatcttccgaaaacattttcatattcccctcccaatcagactctcacaacgatgcctccatctgggaggggaactgaggcatgttaccgagggctgagcttggcctgatgcctcagagctgtgccgcttctcaaaagaacacagacaggccgggcgcagtggctcatgcctgtaatcccagcactttgggaggccaaggcgggcagat

SEQ ID NO: 143260 - DNA, 601 bp, Human
gcaacctccacctcccgggttcaagcgattctcctgcctcagcctcctgagtagctgggattacaggggcccgccaccacgcccagctaattttttgtatttttagtagagatggggcttcaccatgttggccaggctggtctcgaactcctgacctcaggtgatccacccacctcggcctcccaaagtgctgggattacaggtgtcagccactgcacccagcctttttttttgaggaatttcacttccgtcgtccagtctggagtacagtggcgcactctcagctcactacgaccttcgmccccagattcaagcaattctcatgcctcagcctcctgagtaactgggattacaggtatgcaccaccacgcctggcttttttttgcatttctagcagagacaaggtttcaccacattggccaggctggtctcgaactcctgtcctcaagtgatctgcccacctggggctcccaaagtgctgggattacaggcactgagccacggcgcccggcctgcacctgcacatttacacagtcattcctgggtaacataaatgtcaagtcccctgggacactgacagcatctcagggttgacgtgtga

SEQ ID NO: 143261 - DNA, 601 bp, Human
gatccagaaatggaggctcaaggaatttatgtagggcttgcccaaagccagcagttttcttttctttttttttttttttgtgatggagtctcactgtgtcgcccaggctggagtgcagtggcgcaatctctgctcactgcaagctccgcctcccaggttgacgccattctcctgcctcagcctcccgagtggctgggactacaggtgctcgccaccacgcccggctaattttttttgtacttttttagtagagacggggtttcaccgtgttggccaaggatggtctggatctcctgacctygtgatccgcccacctcagcctcccaaagtgctgggattacaggcttgagacacggcgcccggccaaagccagcagttttcaaacccacaacaggtgtaagacaccatgggcccggcaattacatatatatacaggcacacagacagacaacaaaccgaaagttccctcacttatctttcccgtgtatgatgcatgctgacattttttcattggtttaaaaatgctggttcaacccactgtactggtttcacaacccactgtactgatttcacaacccaaagcactgatgggctgagaggc

SEQ ID NO: 143262 - DNA, 601 bp, Human
cggtttggaagacgtgtttcacgaatgtctgacgggttgtctctttgcctgtcctcctttcttccactaacagttgagtgtcttaagtaactcaacgctgtatgaggtcccgaaagcatctcccgatcttctcaaccccatggaaagagagagaaagaatggcatccctctcatcttcagatccagaaatggaggctcaaggaatttatgtagggcttgcccaaagccagcagttttcttttctttttttttttttttgtgatggagtctcactgtgtcgcccaggctggagtgcagtggygcaatctctgctcactgcaagctccgcctcccaggttgacgccattctcctgcctcagcctcccgagtggctgggactacaggtgctcgccaccacgcccggctaattttttttgtacttttttagtagagacggggtttcaccgtgttggccaaggatggtctggatctcctgacctcgtgatccgcccacctcagcctcccaaagtgctgggattacaggcttgagacacggcgcccggccaaagccagcagttttcaaacccacaacaggtgtaagacaccatgggcccggcaatta

SEQ ID NO: 143263 - DNA, 601 bp, Human
ctgttagtaatgacaactatgttcctttttggacagcaattcacggtttggaagacgtgtttcacgaatgtctgacgggttgtctctttgcctgtcctcctttcttccactaacagttgagtgtcttaagtaactcaacgctgtatgaggtcccgaaagcatctcccgatcttctcaaccccatggaaagagagagaaagaatggcatccctctcatcttcagatccagaaatggaggctcaaggaatttatgtagggcttgcccaaagccagcagttttcttttctttttttttttttttgtgatggagtctcactgtgtcgcccaggctggagtgcagtggcgcaatctctgctcactgcaagctccgcctcccaggttgacgccattctcctgcctcagcctcccgagtggctgggactacaggtgctcgccaccacgcccggctaattttttttgtacttttttagtagagacggggtttcaccgtgttggccaaggatggtctggatctcctgacctcgtgatccgcccacctcagcctcccaaagtgctgggattacaggcttgagacacggcgcccggccaaagccagcagttt

SEQ ID NO: 143264 - DNA, 601 bp, Human
tgccggacacagtggctcacatctgtaatcccagcactttgggaggccgaggcgggcggatcacttgaggtcaggagttcaagaccagcctggccaacatggtgaaatctcatctctactaaaaatacaaaaattagctgggcgtggtggtgggtgcctgtaatctcagctacttgggaagctgacacaggagaatggcttgaacccaggaggcggaggttataatgagccgagattgtgccactgcactccagcctgggcaacagagcaagactccgtctcaaaaaaaaaaaaaaaaaaagaactctgtgtataaattcctttaatcctcacaacgaccccatgaaaagcatactatttgtatacccagtttgcagatggaaaaactgaggcacgatagctcattcacctgctgaaagcctggagccagtacggccaggcagtctagatcctctgtctgaactcctttcaaatacacaccctgttagtaatgacaactatgttcctttttggacagcaattcacggtttggaagacgtgtttcacgaatgtctgacgggttgtctctttgcctgtcctcctttcttccactaacagttga

SEQ ID NO: 143265 - DNA, 601 bp, Human
agctggggaaggggggaacctgccccgggtggagagagctgggggaagtgggggaacctgccccgggaggagagagctggggaaggggggaaacctgccccaggagagagctggggaatgggggaacctgccccaggaggagacagctggggaaggggggaaacctgccccgggagagagctggggaaggggggaacctgcccggggaggagagagccggggaaggggggaacctgccccgggaggagacagctggggaaggggggaacctgcgccaggcatatcaggaagggggcccctrccccacagattctgcctttggggcatgagctgttagaaaggcagagcagggaggggctcttggtcttggcccagaggaagaggctcgtgggtggcaggtgggatctaagggctccgtgtctgatggggacaggcgccactccctccttcagggaacgggtgtgttgtggcagaaaccacgaagccctaacctgtctcctctcccagcaatagagaaattaacagtgtcaacgaacactcaggctgtgttctaagagctttatgtgccggacacagtggctcacatctgtaatcccagcac

SEQ ID NO: 143266 - DNA, 601 bp, Human
actcgcggggaggggacagggctgggtgtgtgcccttggctggccaggaccctcgaggccgttatttgtctctggtgaagtcctgcgtatgggctcaggggcaggagggtggactgaaaggcaaggtgacccacactgagctttggcacggcacagccattctgccaaagcgctagcacaccactcaggcaccccctcctccccagtcctgctgcagggacaagggcaggccccggctctccatttcaccactcgagttctcggagaggacccgtgagtgacttcaaccctggctcccagrccagctgcttctcaggaagacgggcctgggccggttctcacttgccagtgggacttcacatagccgtttgtcagctctgtcccccagcgaccggcctttcgaaataagggaaagaaatgtacccacttcctccacctcctgccccagaaggcctggcatgcttgctgccatgccacccgagtcactcgtcactggagcccagggaggaaggcctcattcacctgttttatagataaagagcctgcgatgcagcgtggccaggagtccaccccaggagggccagtcgtggccagcggtggg

SEQ ID NO: 143267 - DNA, 601 bp, Human
cactcgcggggaggggacagggctgggtgtgtgcccttggctggccaggaccctcgaggccgttatttgtctctggtgaagtcctgcgtatgggctcaggggcaggagggtggactgaaaggcaaggtgacccacactgagctttggcacggcacagccattctgccaaagcgctagcacaccactcaggcaccccctcctccccagtcctgctgcagggacaagggcaggccccggctctccatttcaccactcgagttctcggagaggacccgtgagtgacttcaaccctggctcccakgccagctgcttctcaggaagacgggcctgggccggttctcacttgccagtgggacttcacatagccgtttgtcagctctgtcccccagcgaccggcctttcgaaataagggaaagaaatgtacccacttcctccacctcctgccccagaaggcctggcatgcttgctgccatgccacccgagtcactcgtcactggagcccagggaggaaggcctcattcacctgttttatagataaagagcctgcgatgcagcgtggccaggagtccaccccaggagggccagtcgtggccagcggtgg

SEQ ID NO: 143268 - DNA, 601 bp, Human
gggcatcagatggttctcatgacacgatggggaccttggctgttactcctgatttcactcgcggggaggggacagggctgggtgtgtgcccttggctggccaggaccctcgaggccgttatttgtctctggtgaagtcctgcgtatgggctcaggggcaggagggtggactgaaaggcaaggtgacccacactgagctttggcacggcacagccattctgccaaagcgctagcacaccactcaggcaccccctcctccccagtcctgctgcagggacaagggcaggccccggctctccatktcaccactcgagttctcggagaggacccgtgagtgacttcaaccctggctcccaggccagctgcttctcaggaagacgggcctgggccggttctcacttgccagtgggacttcacatagccgtttgtcagctctgtcccccagcgaccggcctttcgaaataagggaaagaaatgtacccacttcctccacctcctgccccagaaggcctggcatgcttgctgccatgccacccgagtcactcgtcactggagcccagggaggaaggcctcattcacctgttttatagataaagagcctg

SEQ ID NO: 143269 - DNA, 601 bp, Human
tcctcctcaacttcccaccccgtctgcaaaaggggaagaaatggacgctcacccacagccagtcacaaggacggggcctgcgcttggggcatcagatggttctcatgacacgatggggaccttggctgttactcctgatttcactcgcggggaggggacagggctgggtgtgtgcccttggctggccaggaccctcgaggccgttatttgtctctggtgaagtcctgcgtatgggctcaggggcaggagggtggactgaaaggcaaggtgacccacactgagctttggcacggcacagccrttctgccaaagcgctagcacaccactcaggcaccccctcctccccagtcctgctgcagggacaagggcaggccccggctctccatttcaccactcgagttctcggagaggacccgtgagtgacttcaaccctggctcccaggccagctgcttctcaggaagacgggcctgggccggttctcacttgccagtgggacttcacatagccgtttgtcagctctgtcccccagcgaccggcctttcgaaataagggaaagaaatgtacccacttcctccacctcctgccccagaaggcctggca

SEQ ID NO: 143270 - DNA, 601 bp, Human
cacaatggttatgcttcctcctcaacttcccaccccgtctgcaaaaggggaagaaatggacgctcacccacagccagtcacaaggacggggcctgcgcttggggcatcagatggttctcatgacacgatggggaccttggctgttactcctgatttcactcgcggggaggggacagggctgggtgtgtgcccttggctggccaggaccctcgaggccgttatttgtctctggtgaagtcctgcgtatgggctcaggggcaggagggtggactgaaaggcaaggtgacccacactgagcttyggcacggcacagccattctgccaaagcgctagcacaccactcaggcaccccctcctccccagtcctgctgcagggacaagggcaggccccggctctccatttcaccactcgagttctcggagaggacccgtgagtgacttcaaccctggctcccaggccagctgcttctcaggaagacgggcctgggccggttctcacttgccagtgggacttcacatagccgtttgtcagctctgtcccccagcgaccggcctttcgaaataagggaaagaaatgtacccacttcctccacctcctgcc

SEQ ID NO: 143271 - DNA, 601 bp, Human
gtttcaccatattggtcaggctggtctcaaactcctgacttcaagtgatccacgtgcctcggcctcttgaagtgctgggatgacaggtgttgagccaccatgcctggctgagacctttataatccagttgggcaaaatgggccaacacagatgaaatgactatggacgatgcgactgactgtaagcaccaaccacatggttccaaggttgtgctggagtagcctggagggctgcatggaggaggcacacataccaggtccttggagagctgagcaggtggaggagtgggggcgtagagaggcatgccagacagggaaacagaaggcaccgggaggcaggagcaagggaagagtgtccccccaagcccaggtgggtgagctgaaagctttggggactccccaccctccatgagggacatggaactagcttcaggattgacatcgtcgtaagagtttatccttttcacctcaacgcaggaccccacggaggagcccgcagagtcgccacagaatccccatacccaagaattcttgtccccgccttggcgcagtccccactgagggggaaataagggaagcaggaaggtcagcagtcccaggaa

SEQ ID NO: 143272 - DNA, 601 bp, Human
cttgagtcgcagctctgctgtgcgcacatcactcagcatccctgggcttcgtgtcaccagcagcctcatgtgtgaaactgggataatacagccatgcgctacctactggcattcccgtcagtgcgtacacgatcatggtcccagactgcaattttttttttttttttttgagacagagtctcactctgtcacccaggctggagtgcaatagtgcaatctcggctcactgcaacctccgcctcccaggttcaagcgattctcctgcctcagcctcctgagtagctggaattacaggtgtccrccaccccgcccagctagtttttgtagtttttgtagatatggggtttcaccatattggtcaggctggtctcaaactcctgacttcaagtgatccacgtgcctcggcctcttgaagtgctgggatgacaggtgttgagccaccatgcctggctgagacctttataatccagttgggcaaaatgggccaacacagatgaaatgactatggacgatgcgactgactgtaagcaccaaccacatggttccaaggttgtgctggagtagcctggagggctgcatggaggaggcacacataccaggt

SEQ ID NO: 143273 - DNA, 601 bp, Human
caggcccctccttctgaccctcaccgtcctagaaccaacggcccctctgcgtccggtcaggcctctccttctgaccctcgccgtcctagaaccaacggcccctcggtgtctggtccttgctaggcaagcgcatggggttccacctggtgcaggccaggcagggtgggcttgagtcgcagctctgctgtgcgcacatcactcagcatccctgggcttcgtgtcaccagcagcctcatgtgtgaaactgggataatacagccatgcgctacctactggcattcccgtcagtgcgtacacgatsatggtcccagactgcaattttttttttttttttttgagacagagtctcactctgtcacccaggctggagtgcaatagtgcaatctcggctcactgcaacctccgcctcccaggttcaagcgattctcctgcctcagcctcctgagtagctggaattacaggtgtccaccaccccgcccagctagtttttgtagtttttgtagatatggggtttcaccatattggtcaggctggtctcaaactcctgacttcaagtgatccacgtgcctcggcctcttgaagtgctgggatgacaggtgtt

SEQ ID NO: 143274 - DNA, 601 bp, Human
tctgccttctggctccttcatcctccgagctctaaaaagcccagatccaacaatccatgcaggacaaagcaggaccctccttctgaccctcgccgcgctagaaacaacggcccctcagtgtccagtcaggactctccttctgaccctcgctgtgctagaatcaatggcccctcggtgtccggtcaggcccctccttctgaccctcaccgtcctagaaccaacggcccctctgcgtccggtcaggcctctccttctgaccctcgccgtcctagaaccaacggcccctcggtgtctggtcctkgctaggcaagcgcatggggttccacctggtgcaggccaggcagggtgggcttgagtcgcagctctgctgtgcgcacatcactcagcatccctgggcttcgtgtcaccagcagcctcatgtgtgaaactgggataatacagccatgcgctacctactggcattcccgtcagtgcgtacacgatcatggtcccagactgcaattttttttttttttttttgagacagagtctcactctgtcacccaggctggagtgcaatagtgcaatctcggctcactgcaacctccgcctcccaggttca

SEQ ID NO: 143275 - DNA, 601 bp, Human
gcaaactcccagcccagcctcactccagcctcacatcacctcattctgatgaagtctcatctactcagatatatcgcctcactctgatggagacagaacccatgttcactggaagaagtcgtctcatctactcagacacccagatggtgctctgccttctggctccttcatcctccgagctctaaaaagcccagatccaacaatccatgcaggacaaagcaggaccctccttctgaccctcgccgcgctagaaacaacggcccctcagtgtccagtcaggactctccttctgaccctcgcygtgctagaatcaatggcccctcggtgtccggtcaggcccctccttctgaccctcaccgtcctagaaccaacggcccctctgcgtccggtcaggcctctccttctgaccctcgccgtcctagaaccaacggcccctcggtgtctggtccttgctaggcaagcgcatggggttccacctggtgcaggccaggcagggtgggcttgagtcgcagctctgctgtgcgcacatcactcagcatccctgggcttcgtgtcaccagcagcctcatgtgtgaaactgggataatacagccatgcgcta

SEQ ID NO: 143276 - DNA, 601 bp, Human
tatgaataatcagaaaaaaaaaaaccaaagatgaccaggctgtactgcaaaggccctgcaggacacagggcctgataacctgccatacagggaaggtgtggcagggaagggcagggtggccagagggagagcagccacgtcgaattcttttttttttggagacggagtctcgctctgtcacccaggctggagtgcagtggtgcgatctcggctcactgcaagctccgcctcccgggttcacgccattctcctgcctcagcctcccaagtaacagggactacaggcgcccgccaccacgccyggctaattttttttgtatttttagtagagacggggtttcactgtgttagccaggatggtcttgatctcctgacctcgtgatccacccacctcggcctcccaaagtgctgggattacgggcgtgagccaccgcgcccggccagccatgtcggattctgttgatgttcttcacctacctgaaggccacgtggaaagaggcttagacttggctggtcacggtggctcacacctgtcatcctagcactttgggaggccgaggcaggtagatcacctgaggccaggagttcgagacaagtctgac

SEQ ID NO: 143277 - DNA, 601 bp, Human
gtggttctctgcattttataaatcacctacaatgaatgaatatgaataatcagaaaaaaaaaaaccaaagatgaccaggctgtactgcaaaggccctgcaggacacagggcctgataacctgccatacagggaaggtgtggcagggaagggcagggtggccagagggagagcagccacgtcgaattcttttttttttggagacggagtctcgctctgtcacccaggctggagtgcagtggtgcgatctcggctcactgcaagctccgcctcccgggttcacgccattctcctgcctcagcytcccaagtaacagggactacaggcgcccgccaccacgcctggctaattttttttgtatttttagtagagacggggtttcactgtgttagccaggatggtcttgatctcctgacctcgtgatccacccacctcggcctcccaaagtgctgggattacgggcgtgagccaccgcgcccggccagccatgtcggattctgttgatgttcttcacctacctgaaggccacgtggaaagaggcttagacttggctggtcacggtggctcacacctgtcatcctagcactttgggaggccgaggca

SEQ ID NO: 143278 - DNA, 601 bp, Human
actggccgggagctgatgccatcaccttccagcctagcagtgggaccgtgggataacgggacgtgcaggcatttcctcagtgtggttctctgcattttataaatcacctacaatgaatgaatatgaataatcagaaaaaaaaaaaccaaagatgaccaggctgtactgcaaaggccctgcaggacacagggcctgataacctgccatacagggaaggtgtggcagggaagggcagggtggccagagggagagcagccacgtcgaattcttttttttttggagacggagtctcgctctgtcrcccaggctggagtgcagtggtgcgatctcggctcactgcaagctccgcctcccgggttcacgccattctcctgcctcagcctcccaagtaacagggactacaggcgcccgccaccacgcctggctaattttttttgtatttttagtagagacggggtttcactgtgttagccaggatggtcttgatctcctgacctcgtgatccacccacctcggcctcccaaagtgctgggattacgggcgtgagccaccgcgcccggccagccatgtcggattctgttgatgttcttcacctacctga

SEQ ID NO: 143279 - DNA, 601 bp, Human
gacattgctaagcgaccgtgatggtccttcccactgcgcatggcaggggtctccagtctcagactctttctcaatgcctgcctgtctataccaagatgctccagggcctgccagtgtagacggtgaggtggcagataacacagaccaacccccagcactggccgggagctgatgccatcaccttccagcctagcagtgggaccgtgggataacgggacgtgcaggcatttcctcagtgtggttctctgcattttataaatcacctacaatgaatgaatatgaataatcagaaaaaaaaaaaccaaagatgaccaggctgtactgcaaaggccctgcaggacacagggcctgataacctgccatacagggaaggtgtggcagggaagggcagggtggccagagggagagcagccacgtcgaattcttttttttttggagacggagtctcgctctgtcacccaggctggagtgcagtggtgcgatctcggctcactgcaagctccgcctcccgggttcacgccattctcctgcctcagcctcccaagtaacagggactacaggcgcccgccaccacgcctggctaattttttttgtattttta

SEQ ID NO: 143280 - DNA, 601 bp, Human
tactgggttaacaggatccgcgtctttcttccacgatagcctgtgccccgagtcataagctccttgtcacacttcagtggaagggagggttgacagggaactcaagcctatagctgtttccttccaagaaacagaatgtggttctaggactcagaaggtagggacccgaagttactcaagaccagtcttggcctcactgatgttccaagttcccgtcacttggcacagggagaggcatgggcgttcacgtgtcccccactgcagcccacccccgtggcagacattgctaagcgaccgtgatggtccttcccactgcgcatggcaggggtctccagtctcagactctttctcaatgcctgcctgtctataccaagatgctccagggcctgccagtgtagacggtgaggtggcagataacacagaccaacccccagcactggccgggagctgatgccatcaccttccagcctagcagtgggaccgtgggataacgggacgtgcaggcatttcctcagtgtggttctctgcattttataaatcacctacaatgaatgaatatgaataatcagaaaaaaaaaaaccaaagatgaccaggctgtac

SEQ ID NO: 143281 - DNA, 601 bp, Human
cggcatgtgcccctctgttcactgagggacaggagactgaagcccagcaagaagccttcattccagggctggttcctcagagcaccctccgggagagagagggagcaccgtccgggaaagacggagcaccctccgggagggagaaggagcaccctccgggagagagatggtgctcccacagaagtgcccatccacacagcccatctccaccacccctggaaggacctatccacacagcctgtctccaccaccccagaagctcccagggctgcaccaggggaggcctagagtcaaggcccckgccccaggcaccccataacacacaggcccaggccttcctcccggactcggagaggtctcaggccttcaaggagtccgagagggctgcccggtcctctcctgaggctcctgcaacactatgggctccactgaggccctgcgtgaggaccctccatccctggcagactcaccagcttctggaagaggtggcccatggtgacctggctgtcccactgttgcaccttggggcacaggttgtcatagaactccttgtggatctcatagatgtcctggatcttgtagaagatggtctcgatctgct

SEQ ID NO: 143282 - DNA, 601 bp, Human
tttggcgacttggaaagccttcttggaggaggtcccttctaagctgggaactgaccaggggaggccagacgagagggggaaggacgtttcaggcacacggggcctcaagtaccaagagttaagaaagtgcctgccctgggaactgagaacagaaagtccagtgtcaggagcacagaggtgcggggaggaagctgccaaggctggggctggacacgggtcagtgtgcaaagggtctctcgagccattcctcggagcctgaccttcatccgagggccgtggggatccgctgaaggggccgtcraggtttcagtgactctctcccctctaaggagaggtgggggtgggaggtgagtgggcctggaggcaggagccacacaggaggatacgcagctgtccaggtgagggccatgggtggccaagaagaggaaaaggcggctgtgagcaacggccaaaaagtggagtccacaggacaggtgggggagggggtgcagccagaaagagtctgaagcactcggtgaggtaaagacaggaagcggagcaggtgacgccggaggcagggagctcagctctgaacacactcagctagaggtcctaggagtgt

SEQ ID NO: 143283 - DNA, 601 bp, Human
acttcgggaggccgaggcgggcggatcacctgaggtcaggagttcgagaccagcctggccgacatggcgaaaccccgtctctactaaaaatacaaaaattagccgggtgtgatggtgggcgcctgtaatcccagctactcgggatgctgaggcaggagaatcacttgaacccgcgaggaggaggttgcagtgagccgagatcacgccactgcactccagcctgggcgacaggagtgagactccgtctcaacaaaaaaaggaaatgcagtccgtcctcctggaacttgtggtttgggggagkcaggcagttactagtgctcactacgaggactggcacaaggcctgcatttggcgacttggaaagccttcttggaggaggtcccttctaagctgggaactgaccaggggaggccagacgagagggggaaggacgtttcaggcacacggggcctcaagtaccaagagttaagaaagtgcctgccctgggaactgagaacagaaagtccagtgtcaggagcacagaggtgcggggaggaagctgccaaggctggggctggacacgggtcagtgtgcaaagggtctctcgagccattcctcggag

SEQ ID NO: 143284 - DNA, 601 bp, Human
gctccccccgggccctcccaaatctgcagccccaggggcctcaggcatcggttcacgatgctggggagggaaagtggtgggtagcagattcacggccaggcctgtggagccaagaccagaaccggggacagccaggtccaagtgacaaagataaactgtgacagcgtttccagcaaccctaggtttgctctcctctaccctcctgagggatgaggagaggatgccccccaggccactcagctcaggtgagcaggcagtgatgacaggtgttcaccatccctgaaccggagggagcaggggkgggtatgctagaaccagagtgtggcattcccttggaaggataccttccagggtgcctcttcccaatttaataataataataataataataataataataataataataatggcactgatgataatgaccagttattgagtacttattaatttatgatgttccaggccctgttccaagcactttttcttttactttattgtattctatttctttttttgagacagagtcttgctcttgtcgcccaggctggagtggagtggcacgatctcggctcactacaacctctgcctcccgagttca

SEQ ID NO: 143285 - DNA, 601 bp, Human
gggcggggccggacgggagggagtttatttccttttccagggagtactgaggcccggcccatcaatgcccacgctacacgaggcatactagacagtcgctgcctaagccaaagtcagatcaccgatattcttccaggaaaaggctcctcttgccccctttcccacaagaaggagaaagcctggaggcccgggttggcacaccaccctcccaggagccaggggcaggagccagccgtgcggaggcctgcgtccagggtcacggtaatctcagggactgccgctgccacagtcaccccaggckgtagggcccgaggcctggcttggcaggttcattaactgggaagtgcaggttgcctggaaacagcagcctggcactggagtgatctcataaaacaaacagcagagacgctaattcccttctctcagtaacgaataatcaaatacccagagtcttcggctgaaaataaaccacctccggatgccagacctgacccggctccccccgggccctcccaaatctgcagccccaggggcctcaggcatcggttcacgatgctggggagggaaagtggtgggtagcagattcacggccaggcctgtg

SEQ ID NO: 143286 - DNA, 601 bp, Human
agcgcgagtggggacgcccggcgtgacgccaaggccagaggcattcaggtctcagctgcagaagggcaggactttaaaagggggcagggccggacttttaaaagagggcggggcctgagttttaaagggggtggggcctgaccttaaaagggggcggggccggacgggagggagtttatttccttttccagggagtactgaggcccggcccatcaatgcccacgctacacgaggcatactagacagtcgctgcctaagccaaagtcagatcaccgatattcttccaggaaaaggctcctcktgccccctttcccacaagaaggagaaagcctggaggcccgggttggcacaccaccctcccaggagccaggggcaggagccagccgtgcggaggcctgcgtccagggtcacggtaatctcagggactgccgctgccacagtcaccccaggcggtagggcccgaggcctggcttggcaggttcattaactgggaagtgcaggttgcctggaaacagcagcctggcactggagtgatctcataaaacaaacagcagagacgctaattcccttctctcagtaacgaataatcaaatacccagag

SEQ ID NO: 143287 - DNA, 601 bp, Human
ggggcaggggagcggggggcatctggaaaagccagaggggagcgcgagtggggacgcccggcgtgacgccaaggccagaggcattcaggtctcagctgcagaagggcaggactttaaaagggggcagggccggacttttaaaagagggcggggcctgagttttaaagggggtggggcctgaccttaaaagggggcggggccggacgggagggagtttatttccttttccagggagtactgaggcccggcccatcaatgcccacgctacacgaggcatactagacagtcgctgcctaagccraagtcagatcaccgatattcttccaggaaaaggctcctcttgccccctttcccacaagaaggagaaagcctggaggcccgggttggcacaccaccctcccaggagccaggggcaggagccagccgtgcggaggcctgcgtccagggtcacggtaatctcagggactgccgctgccacagtcaccccaggcggtagggcccgaggcctggcttggcaggttcattaactgggaagtgcaggttgcctggaaacagcagcctggcactggagtgatctcataaaacaaacagcagagacgct

SEQ ID NO: 143288 - DNA, 601 bp, Human
gagcctggagcctcccagtacagaggcagagccctttgaggaagctggtggggcaggggagcggggggcatctggaaaagccagaggggagcgcgagtggggacgcccggcgtgacgccaaggccagaggcattcaggtctcagctgcagaagggcaggactttaaaagggggcagggccggacttttaaaagagggcggggcctgagttttaaagggggtggggcctgaccttaaaagggggcggggccggacgggagggagtttatttccttttccagggagtactgaggcccggcccrtcaatgcccacgctacacgaggcatactagacagtcgctgcctaagccaaagtcagatcaccgatattcttccaggaaaaggctcctcttgccccctttcccacaagaaggagaaagcctggaggcccgggttggcacaccaccctcccaggagccaggggcaggagccagccgtgcggaggcctgcgtccagggtcacggtaatctcagggactgccgctgccacagtcaccccaggcggtagggcccgaggcctggcttggcaggttcattaactgggaagtgcaggttgcctggaaa

SEQ ID NO: 143289 - DNA, 601 bp, Human
taatgaatggatgaaagcttcacggagcaccgggagctcccctgcactgaaaacctctcactcagctcgttgggaacttggggaaacgcagggatgaacatattacagtgtccctttgaactggacagtttccatggaaaccagctcagccaataaggttaatgagggggtctggggttggggagaccaggctagggcctttgttggcctgctagaaattcaactcttcacagcatccagctttcctcagcacggtgaaggtctcccagggtttgaaatcccttaatgtctcatacttccktcacatcctggaattagccggagcagggagagaggggggtgtgtgtgctggggggagctggcacgtgtggcctgctcaggcctccctccccacgtgcagcgtggggaacgacatttaaaggtgctgtcttggccgggcgtggcggctcacgcctgtaaccccagcactttgggaggcctgaggtcaggagttccagaccagcctggccaacatggcgaaaccccgtctctactaaaaatacaaaaattagctgggcatggtggcgcgtgcctgtaatcccaggtactcaggagaatgagg

SEQ ID NO: 143290 - DNA, 601 bp, Human
acaccgagctggctggcctgcagggaggagtcagggaacagagggagaggagggtgggaggggagaggattaatgaatggatgaaagcttcacggagcaccgggagctcccctgcactgaaaacctctcactcagctcgttgggaacttggggaaacgcagggatgaacatattacagtgtccctttgaactggacagtttccatggaaaccagctcagccaataaggttaatgagggggtctggggttggggagaccaggctagggcctttgttggcctgctagaaattcaactcttcayagcatccagctttcctcagcacggtgaaggtctcccagggtttgaaatcccttaatgtctcatacttccttcacatcctggaattagccggagcagggagagaggggggtgtgtgtgctggggggagctggcacgtgtggcctgctcaggcctccctccccacgtgcagcgtggggaacgacatttaaaggtgctgtcttggccgggcgtggcggctcacgcctgtaaccccagcactttgggaggcctgaggtcaggagttccagaccagcctggccaacatggcgaaaccccgtctct

SEQ ID NO: 143291 - DNA, 601 bp, Human
agaggggggacgtgacttgctcaaggtcaccatagtgtggtgtgggagaacactgccttggatttttttttttttttttttttttgcctcccctgttcctctctctaatctgaaagagaataataaaaaaataaataaaatagatcgttttctattaagagggaaaatgtcaggtgcaagaaagcaaatatcaggctaagtgttacccattagagtaaccacttcaccgactggcaagcgagggaggggagaccaagggctctgagcagcccccaaagctccttgtccctcagggtggctrtgtggggagcggcctacctctgagatcttctggaactggttgttggactggctgcacttctcagctgtctccagagcgactttatagttatcgacaaacgctttgtacacaccgagctggctggcctgcagggaggagtcagggaacagagggagaggagggtgggaggggagaggattaatgaatggatgaaagcttcacggagcaccgggagctcccctgcactgaaaacctctcactcagctcgttgggaacttggggaaacgcagggatgaacatattacagtgtccctttgaact

SEQ ID NO: 143292 - DNA, 601 bp, Human
attctcctgtctcagcctcccaaatagctgggattacaagtgtgcaccaccacgcccggctaatttttgtatctttagtagagacggcgtttcgccacgttggccaggctggtctcaaactcctgacctcaggtgatccgcccgcctcggcctcccaaagtgctgggatgacaggtgtgagccgccacgcccggcttctataggtacgtttcattccagaggcgaagtgtcagcaagcccactgtggctacagatccaaatccacattttccaagctgcatttttttaacagtaatgaagstgacatgttcatctccaactgtcagcttctctgctgcctctcggtggattctaaacgtgggcatcgaccgtcacccctgaagtttcaggaaaactaccctgcgtttccccaactcttctagcgttagagctgagacgggaacacaaagggccaagaggggcctttacggcaggactcccaaaactgcagaagcttctccccttttctaggatggaggttctcttgccctgagctgggggctgttcctctcaggccagtgcttcaggggtgccactgaggtctttttggacaaagggatga

SEQ ID NO: 143293 - DNA, 601 bp, Human
ctgtgaggggcttatggttgggtgtgggggtttctgcctaggcacagagaacaggcaatcagcccaggccaagagaagaccccacactctctgcaccatgtctgaccccgggatcttgggcggccttggcagggctgatctgaacacagaccaggggagtccaggtagttcctgggttgggctggaaaccgcagggaaagcaccatttctccagccccttttatttgtatttttaatagagacggggtttcaccatgtttcccaggccggtcttgaactcctgggctcaagccaatctccygcctcggcctcccaaagtgctgggattacaggcgtgagccactgcacctggcctctccagccacttgactccatggagagggacttccccaccctgcacttcgtcctcccaggcagagggtgacacatctgctccatgggtctgggagaagaaactatggtcagccatcctctctctgcacactgggtaagaggcgtgggctctgtcctcattgtggagaggggcctgtgttttcctattcctgcaagggactcaatagatacttttttttttccagacagggtctcgctctgtcaccag

SEQ ID NO: 143294 - DNA, 601 bp, Human
gacagagaaaactcctggagatggagcttgggtgtgtgtatattttggggggcgggggggtgggggatactcagcgtccccagcctgtgtctctggctggtgcctggactcccagatttcgggaatgtttcctcacgccccctccagtgaagtctagggtatgaaatcactcctgctgcagagaggagcctaattgcagtaattaagtggcagcctcagcaggaagcaagcacgtcatcgagtgagtcaggatgagaagccacctggcagaaagccaggggcctggctctgccctccagggtgggcaggctgtgaggggcttatggttgggtgtgggggtttctgcctaggcacagagaacaggcaatcagcccaggccaagagaagaccccacactctctgcaccatgtctgaccccgggatcttgggcggccttggcagggctgatctgaacacagaccaggggagtccaggtagttcctgggttgggctggaaaccgcagggaaagcaccatttctccagccccttttatttgtatttttaatagagacggggtttcaccatgtttcccaggccggtcttgaactcctgggctcaagc

SEQ ID NO: 143295 - DNA, 601 bp, Human
cgtcgccgtctctccctaacagcccctccaggaagttctctcacactagcccaccaattccccaccgatcctcggggccacctggacccctccagcctggtccttccatttgcaagcggccctgctctgagcagcccccaggtttcaactctaggctggatgccgccaaaacgaagggggaattcaggtccagccgctcgcccaccctccttccctgcggccctctaacctccccggccacatctaagcccactccagccggcccccagaggtgggagggtccgccacctcccacagcgagcacctgggttaccataggtgcagttacagcagaagcgaataatgaggagaatctccatggcagcctctgtccccgcggcgggagcgtgcagccatcgctccaggctccccggcgcccaccagcagcccggccactcagccaccttgctgatgctgccgcacggactccagcatcgggcagccgctccggagtgctcttccagcaagggggaggggagggaggcgcgtggcgaggagaggagggaaggggaaggggaggaggggtagggagggagggagccagcagcctgctggcatccta

SEQ ID NO: 143296 - DNA, 601 bp, Human
ctcgtcgccgtctctccctaacagcccctccaggaagttctctcacactagcccaccaattccccaccgatcctcggggccacctggacccctccagcctggtccttccatttgcaagcggccctgctctgagcagcccccaggtttcaactctaggctggatgccgccaaaacgaagggggaattcaggtccagccgctcgcccaccctccttccctgcggccctctaacctccccggccacatctaagcccactccagccggcccccagaggtgggagggtccgccacctcccacagcgagcacctgggttaccataggtgcagttacagcagaagcgaataatgaggagaatctccatggcagcctctgtccccgcggcgggagcgtgcagccatcgctccaggctccccggcgcccaccagcagcccggccactcagccaccttgctgatgctgccgcacggactccagcatcgggcagccgctccggagtgctcttccagcaagggggaggggagggaggcgcgtggcgaggagaggagggaaggggaaggggaggaggggtagggagggagggagccagcagcctgctggcatcc

SEQ ID NO: 143297 - DNA, 601 bp, Human
gggtgcagagccgaaacacctggtgggaaggaagaggaaggtcctaaaaccagccgcctgctgctcccacagactcaggcccagagcagccggcctgggagccacacgtgcccaccccactccctgccacaggcaggcagggcaccccttggcacgtcttgcctcttgaggcagggtccacgggcttctggacacctccctacctgggccggcttcatcctcctacgaccaacagtcgtgttgatgacatgcacctgtcccgggacttcccccagcccccagccagctgcgggagctgcarggaggatggtccgggtcccttccaccgaaaggtggtgtgtgtgtgtgtgtgtgtgtgtgtgaccttcacagagtagcttgccacacccctctcccgctggccctgccgacctgccttccacagttgagggcccagacctcggctgggggtctctcacggctggaaacaaacctctccttcctgctcccacagcccctccgtgtcctccgcctactgctgcatgtgcgcggagcacacaataccgtgccgcccagcctccgcgcctctctccagaaacaaagaaactcccaacttctccct

SEQ ID NO: 143298 - DNA, 601 bp, Human
acaccaagtgaggatggctgggattcagcagggacaggtggaggtggcagctggtggatcaacacttcccaacacccttcctgtacgcggctgcgcccaccctcccaacaggaggctcagcttcagtcctgcacctggatgctctgtccctggggtcatgaccttgggcctcctgccgcaggggcagtgacagaggcaggttggtcatctgggaagaaggatcccagactgggtgtcccataagaccaggttgtgacaggtcccagcgtgaacacgcacgccctagccgggccccaaaccygatagttctccaaagcctgagatataaataccccgtgcgcggctaagcagacacttcagggagcaatctgctggctgtgaagaaaatgcagcctcagcagggccaccagccttacccgcagtccgagcttggctgcctgtcggaatcactgggggagcggttaaaagatacagatgcctgctccccagccccgtcaactcaacccaaatctctgcaagaccacaagggccatcagcatttctataaagcttctttactgatttgaatgtataataatggttgaaaaccactgctttatgt

SEQ ID NO: 143299 - DNA, 601 bp, Human
cagctccacccagccacgccccgtagagtccagcacacctgccacacgcagaaccccagaatcacacagctccacccagccatgccctgcagagtctagcacacctgccacatgcaggaccccagaatcacacagctccacccagccacgccccgcagagtccagcatacctgccacacgcagaaccccagaatcacacagctccacccagccatgccctgcagagtctagcacacctgccacatgcaggaccccagaatgggggaaggagacatgctgtgtttccaggaagggcagctcyccagaccttatcattctcaggctcctggagctgaaggccaggcacagccagctgggattggcatgcctcactgtgatccacaggactggcctcatctctcagaggaaagacccctccccacatcctcaaaccccagatagcaaagcacaggaaggctggaggcagggaggctggaggccaggaggctggcctgatctccacagaaaggctctgctccccgaggccagcctggccaaccagtgaaaccccatctctattaaaaatacaaaaattagccaggcgtggtggcacatgcctgta

SEQ ID NO: 143300 - DNA, 601 bp, Human
ccccatccaaagggtgggcactcagggacctgcctaattcccgcaaaatctgaactacaaatcagagtcaggccgggcacggcggctcatgcctgaaatcccagcactttgggaggccgaggcgggggatcacttgaggtcagaagttcgagaccagcctgggcaacgtggtgaaaccccatctctagtaaaaatataaaaattagctgggcgtggtggcgggcgcctgtagtcccagctactcgggaggctgaggcaggagaattgcttgaacccaggaggcagaggttgcagtgagccragatcgcaccactgcactccagcctgggtgacagagtgagactccgcctcaaaaaaaaaaaaaaaaaaaaaaaatcagagccagcacagcaggggagagggccctggctgccccctcttctcctggccacagtcatactctctccccagtgtggagaccaggtggaggctcatccccccgagcagctgggagagaaaccctgtgtctgccctgcagctgctccaaggacactggagaccaggaggcagcgggtggggaagcaggaatgcctgcctccccgggagcacctggccacgtcaa

SEQ ID NO: 143301 - DNA, 601 bp, Human
accggggagtgctcagtccccatccaaagggtgggcactcagggacctgcctaattcccgcaaaatctgaactacaaatcagagtcaggccgggcacggcggctcatgcctgaaatcccagcactttgggaggccgaggcgggggatcacttgaggtcagaagttcgagaccagcctgggcaacgtggtgaaaccccatctctagtaaaaatataaaaattagctgggcgtggtggcgggcgcctgtagtcccagctactcgggaggctgaggcaggagaattgcttgaacccaggaggcrgaggttgcagtgagccgagatcgcaccactgcactccagcctgggtgacagagtgagactccgcctcaaaaaaaaaaaaaaaaaaaaaaaatcagagccagcacagcaggggagagggccctggctgccccctcttctcctggccacagtcatactctctccccagtgtggagaccaggtggaggctcatccccccgagcagctgggagagaaaccctgtgtctgccctgcagctgctccaaggacactggagaccaggaggcagcgggtggggaagcaggaatgcctgcctccccggga

SEQ ID NO: 143302 - DNA, 601 bp, Human
caccagtggctgaaagactgcgtggtggacctggagagactccccagcctcaggttcttctggctcactggattgttattattatttctgagatggagtctcactctgtcacccaggctggagtgcagtggtgcgatctcggctcactgtaacctccgcctcctgggttcaagcaattctcctgcctcagcctcctgagtagctgggactacaggcatccgccaccacgcccagctaatttttgtatttttagtaaagacggggcttcaccatgttggccaggctggtctcaaacttctamctcaagtgatccacctgcctcagcctcccaaagtgctgggattacaggtgtgagccactgtgcccagcctccctagattattatgaggattaatgagacactggacttaaacttctcagcctagggcctggaaagctgcaggtcatcagggtgaccaagggctgaaaacctctccttggctgggaatgggggatcaggattggagaggcaggaggcacccggtgccgcccgtgtgtgagagaaggggacgagggacctgccgcccgtgtgtgagagaaggggacgagggacctgccgccc

SEQ ID NO: 143303 - DNA, 601 bp, Human
agaggcaggtgtctgcattcaagaatgaggcacccggaggccacttccccggcgtgggcctccagacagtcccaggtgaggaatccagctctgacaccagtggctgaaagactgcgtggtggacctggagagactccccagcctcaggttcttctggctcactggattgttattattatttctgagatggagtctcactctgtcacccaggctggagtgcagtggtgcgatctcggctcactgtaacctccgcctcctgggttcaagcaattctcctgcctcagcctcctgagtagctggsactacaggcatccgccaccacgcccagctaatttttgtatttttagtaaagacggggcttcaccatgttggccaggctggtctcaaacttctaactcaagtgatccacctgcctcagcctcccaaagtgctgggattacaggtgtgagccactgtgcccagcctccctagattattatgaggattaatgagacactggacttaaacttctcagcctagggcctggaaagctgcaggtcatcagggtgaccaagggctgaaaacctctccttggctgggaatgggggatcaggattggaga

SEQ ID NO: 143304 - DNA, 601 bp, Human
gtcgtccccatctgtgccagcctttcctgtatgatacacggtgtgacctacatctgctgtaatacgtaggtgagcgtattcaaagtatacaattaagatgaccgaggccgggcgcagtggttcacacctgtcatcccagcaatttgggaggctgaggcgggtggatcacctgaggtcaggagtttgagaccagcctggccaacgtggcgaaaccccgtctctactaaaaatacaaaaactagccagacatggtgacgcctgcctgtaatctcagctacttgggaggatgaggcaggagaaytgcttgaacccagagggtggaggctgcagtggagctgaggtcacgccattgcactccagcctggacgatggaatgagattcagtctcaaaaaaaggatgactgaaaacggagggtacgctaagccctctggagatttttcagatatccccagagtaaaacagacgacgggatccccagacgctgcacatcagcaccaggagccgcacggaatcggctctctctgcccagtggacactgtccaggcctgtccctcaccactttctccccaggagaccctgggggctcgtaaacagaccaca

SEQ ID NO: 143305 - DNA, 601 bp, Human
ttaaccaaaggtggttcaagcactgcctttggagtcacatgggcatgggtttgaatgccaacaggcttctcagctgtgatctcagacaggctccctgacctctctgaatcccagattcaccttctgttaagtgcggacagtgaggtctgcctcataaggtgactcatcgagatggtgcatgtgaaacagcacagtgcctggcacattaagtgtgtgcaacgcacggggctctccgcggctaaccctggagccccctgccctggacgacctggtttctccaccctggggcacgaacatcccygtttgcaatccctcccgaccgcggcggcgaacttcatctagccccggctcaaccgagacccgagacccgagacccactcaggcctgtctgtgctactcctccctggcttctccagccccctggggatgagacctgggccctccagcctgggactgcagcagtgcccagaggggacctgcagccaactctaacctgggctctgggtggtttctgctccacgtgggagttccagagtttccaacccccgctcagagccggggggtcgtccccatctgtgccagcctttcctgtatgatacac

SEQ ID NO: 143306 - DNA, 601 bp, Human
agggaggactggaccgagaggcggcatagcctgtcatcccttaaccaaaggtggttcaagcactgcctttggagtcacatgggcatgggtttgaatgccaacaggcttctcagctgtgatctcagacaggctccctgacctctctgaatcccagattcaccttctgttaagtgcggacagtgaggtctgcctcataaggtgactcatcgagatggtgcatgtgaaacagcacagtgcctggcacattaagtgtgtgcaacgcacggggctctccgcggctaaccctggagccccctgccckggacgacctggtttctccaccctggggcacgaacatccccgtttgcaatccctcccgaccgcggcggcgaacttcatctagccccggctcaaccgagacccgagacccgagacccactcaggcctgtctgtgctactcctccctggcttctccagccccctggggatgagacctgggccctccagcctgggactgcagcagtgcccagaggggacctgcagccaactctaacctgggctctgggtggtttctgctccacgtgggagttccagagtttccaacccccgctcagagccgggg

SEQ ID NO: 143307 - DNA, 601 bp, Human
aaaaggatgattatgaagatgaggcagcaacagggaaaatgcttatgacacgaaacagaaacagcagagccccaaattgggcattcacagtgattacgactgtgtgaagaaacatgagaacatttaaaaacagggaaggaagcagcgcggcaggagtcggacctcatgcttcagtgggggacggggtttcctccaatggccttatattatctttataattaaaaacatgacttactttcaggaaaaaaggctatgtagtgaaattaagttaattaatatagtttttaaaaggaaaaaaccrgccaggcgcggtggctcatgcctgtaatcccagcactttgggaggccgaggcgggcagatcacctgaggttgggagtttgagatcagcctggccaacatggcaaaaccccgtctctactaaaaatacaaaaattagccagacatggtggcatggtggcgtgcacctgtaatcccagctactcaggaggctgaggcaggaaaatcgcttgaacccgggaggcagaggttgcagtgagccgagatcgcaccactgcactccagcctgggcaacagagcaagaccctgtctcaaaagaaaaaa

SEQ ID NO: 143308 - DNA, 601 bp, Human
aaatagtagcaggagacgtggtgaatattcacagcactgcagttagcagaaattcagagatgtctaataaaaggagaatgcttaagtagacgatggcacatctacgggtaacatcgtgcaggaaagtaaaaggatgattatgaagatgaggcagcaacagggaaaatgcttatgacacgaaacagaaacagcagagccccaaattgggcattcacagtgattacgactgtgtgaagaaacatgagaacatttaaaaacagggaaggaagcagcgcggcaggagtcggacctcatgcttcartgggggacggggtttcctccaatggccttatattatctttataattaaaaacatgacttactttcaggaaaaaaggctatgtagtgaaattaagttaattaatatagtttttaaaaggaaaaaaccggccaggcgcggtggctcatgcctgtaatcccagcactttgggaggccgaggcgggcagatcacctgaggttgggagtttgagatcagcctggccaacatggcaaaaccccgtctctactaaaaatacaaaaattagccagacatggtggcatggtggcgtgcacctgtaatcc

SEQ ID NO: 143309 - DNA, 601 bp, Human
ctcacattttcctattccccacgacaatcccctccctcccttctagactatccgtgttcaatatccttcaggctagcaatggaatacaggtgttattccaaatgccacctcttatcaagagtggtcacatgggtcaacactgggtggaggattacaaagccacatccaagtctagcaagaaagtgtgccctagttgattagtaatgtctgccatggcaaaggacggcaggcagaggcatatgtgattagtaatgtctgccatcgcaaaggacgacaggcagaagcatgtgtgcttattatygccatctctgcctcagaactatctcaaacatgatctagttccagggagtcatgtcctttattattattattttttaaattatttttattttgtgagatggagttttgctcttgttcccaggctggagtgcaatggcgcgatctccactcactccaacctctgcctccagggttcaagcgattctcccacctcattctcccaagtagctgggattataggtgcctgccatcacacccagctaatttttgtactttcagtagagacggagttttgccatgttggccaggctggtctcaaact

SEQ ID NO: 143310 - DNA, 601 bp, Human
gccccttcaccttaccaggcttctggcccagatgactcgtgttgtcaaacatcccaaaccacttaggtatcaagaagagcgaagccttcctggctgggctcacattttcctattccccacgacaatcccctccctcccttctagactatccgtgttcaatatccttcaggctagcaatggaatacaggtgttattccaaatgccacctcttatcaagagtggtcacatgggtcaacactgggtggaggattacaaagccacatccaagtctagcaagaaagtgtgccctagttgattagtratgtctgccatggcaaaggacggcaggcagaggcatatgtgattagtaatgtctgccatcgcaaaggacgacaggcagaagcatgtgtgcttattatcgccatctctgcctcagaactatctcaaacatgatctagttccagggagtcatgtcctttattattattattttttaaattatttttattttgtgagatggagttttgctcttgttcccaggctggagtgcaatggcgcgatctccactcactccaacctctgcctccagggttcaagcgattctcccacctcattctcccaa

SEQ ID NO: 143311 - DNA, 601 bp, Human
agcctggctcttccagcctcaactcttgggtccagaaccacagaaccactgacaggggttgactgagaactcgccagaagcacgaacgatccctgctcctgaggagcctgattgggaaacacacactggagtgatgaaagctgggttctggggtccgccccgcccgcagggagcaactccgccccttcaccttaccaggcttctggcccagatgactcgtgttgtcaaacatcccaaaccacttaggtatcaagaagagcgaagccttcctggctgggctcacattttcctattccccacsacaatcccctccctcccttctagactatccgtgttcaatatccttcaggctagcaatggaatacaggtgttattccaaatgccacctcttatcaagagtggtcacatgggtcaacactgggtggaggattacaaagccacatccaagtctagcaagaaagtgtgccctagttgattagtaatgtctgccatggcaaaggacggcaggcagaggcatatgtgattagtaatgtctgccatcgcaaaggacgacaggcagaagcatgtgtgcttattatcgccatctctgcctcagaactat

SEQ ID NO: 143312 - DNA, 601 bp, Human
gtcggccagggggatgtaccacttacagtcatactgctggtgcttcctgcaaacgagccagagggagccatgagccagagggagcctggctcttccagcctcaactcttgggtccagaaccacagaaccactgacaggggttgactgagaactcgccagaagcacgaacgatccctgctcctgaggagcctgattgggaaacacacactggagtgatgaaagctgggttctggggtccgccccgcccgcagggagcaactccgccccttcaccttaccaggcttctggcccagatgactcrtgttgtcaaacatcccaaaccacttaggtatcaagaagagcgaagccttcctggctgggctcacattttcctattccccacgacaatcccctccctcccttctagactatccgtgttcaatatccttcaggctagcaatggaatacaggtgttattccaaatgccacctcttatcaagagtggtcacatgggtcaacactgggtggaggattacaaagccacatccaagtctagcaagaaagtgtgccctagttgattagtaatgtctgccatggcaaaggacggcaggcagaggcatat

SEQ ID NO: 143313 - DNA, 601 bp, Human
tcccccaacacagctggctcaaagggccccaggctcagataccaagctctgctcacctccttctggatttcactcttgagggcagagatcttcatcttcatgtcctccagctcatggtctgggaaggggtgcacctgggggctggcctcagattcctcgggggatggaaacaccaggtcggccagggggatgtaccacttacagtcatactgctggtgcttcctgcaaacgagccagagggagccatgagccagagggagcctggctcttccagcctcaactcttgggtccagaaccacaraaccactgacaggggttgactgagaactcgccagaagcacgaacgatccctgctcctgaggagcctgattgggaaacacacactggagtgatgaaagctgggttctggggtccgccccgcccgcagggagcaactccgccccttcaccttaccaggcttctggcccagatgactcgtgttgtcaaacatcccaaaccacttaggtatcaagaagagcgaagccttcctggctgggctcacattttcctattccccacgacaatcccctccctcccttctagactatccgtgttcaatatc

SEQ ID NO: 143314 - DNA, 601 bp, Human
tggcctcaagtgacccacccgtctcagcctcccaaagtactgggattaccggtgtaaaccaccacgctgggccctaaccacctgttttctacgtgtcgaatatgaggaacatggaacagaagaaaatagcgctgtccctggagttcaaattccagtggggaagagaggagtctgacaatgcaattacaattcagtaccatttaagcaaagccacaggtgaacaaaaagccacaggatctggggacagggcacccaaccaagactgtggtgggcgtgggtgtcagagaagcttcccaggggwggtgaggcctaagctgaacctgagaggtgaggaaaacagaccaagctgaccaaaccgctccaggcccttcctccactcacagggatgctcctcccgtggtgccttcctctagacactgttgttacgtgaactgagggctatgcatgttcctctagacactgttgttacgtgaactgagggctatacatgttcctctagacactgttgttatgtgaactgagggctatgcatgttcctctagacactgttgttatgtgaactgagggctatgcatgttcctctagacactgttatgtgaac

SEQ ID NO: 143315 - DNA, 601 bp, Human
agatgtaccaccagttggaccctctgtcctaggacatcccccagccctgaacactcctggggctgtaatggtgatcttgctttcccctgttcaaagggagatgcttgagttgaaagaatcctcagagaggccatctggttatgttttcttcaataattgtttgtttactaagtgcctttttttttttgagatggagtcccactcactctgttgcccaggctggagtgcagtggcgtgatctcggctcactgcaacctccacctcccgggttcacacaattcttttgcctcagcctcccacrtggctgggattacaggcacccaccaccacacccggctaacttttgtatttttcatagagacggggcttcatgatgttggccaggctggtcttgaactcctggcctcaagtgacccacccgtctcagcctcccaaagtactgggattaccggtgtaaaccaccacgctgggccctaaccacctgttttctacgtgtcgaatatgaggaacatggaacagaagaaaatagcgctgtccctggagttcaaattccagtggggaagagaggagtctgacaatgcaattacaattcagtaccatt

SEQ ID NO: 143316 - DNA, 601 bp, Human
ctcccaggggcgggtgggaaacaggcacgcaggatgctcctgggcgggcactgtgggcagggcccagccgttcaggagggggacagctgtgctggcgaggaagccctctgggcagatgtaccaccagttggaccctctgtcctaggacatcccccagccctgaacactcctggggctgtaatggtgatcttgctttcccctgttcaaagggagatgcttgagttgaaagaatcctcagagaggccatctggttatgttttcttcaataattgtttgtttactaagtgcctttttttttttgagatggagtcccactcactctgttgcccaggctggagtgcagtggcgtgatctcggctcactgcaacctccacctcccgggttcacacaattcttttgcctcagcctcccacatggctgggattacaggcacccaccaccacacccggctaacttttgtatttttcatagagacggggcttcatgatgttggccaggctggtcttgaactcctggcctcaagtgacccacccgtctcagcctcccaaagtactgggattaccggtgtaaaccaccacgctgggccctaaccacctgtttt

SEQ ID NO: 143317 - DNA, 601 bp, Human
tgtaccacactctgtggtcagcaaggggcgtgtctgcttcctccactggacagggatatacatgaggcacccggcacaccccaggcagcacagccagtggggctcactgagtgttgactgttgactcgactgggcacaaggccacgtctgcacagctggggcaacggggaggcagcaagcctcccaggggcgggtgggaaacaggcacgcaggatgctcctgggcgggcactgtgggcagggcccagccgttcaggagggggacagctgtgctggcgaggaagccctctgggcagatgtaycaccagttggaccctctgtcctaggacatcccccagccctgaacactcctggggctgtaatggtgatcttgctttcccctgttcaaagggagatgcttgagttgaaagaatcctcagagaggccatctggttatgttttcttcaataattgtttgtttactaagtgcctttttttttttgagatggagtcccactcactctgttgcccaggctggagtgcagtggcgtgatctcggctcactgcaacctccacctcccgggttcacacaattcttttgcctcagcctcccacatggctgg

SEQ ID NO: 143318 - DNA, 601 bp, Human
aaactcttgacctcaggtgattcgcctgcctcagcctcccaaagtgctgggatgacaggcatgagccactgtgcccggcccaaagctcctccttatccaggcacagctgaccttgcaggaggaggcagctgggggtgggtgggtgaagggggagctccttcctgggaagccaaggtgacaggagcggctgtgccagggacggccagcagagggcactcattccacacgagaggggagagcgagtcaacagctggagccatggcagcctcctcaggaagagggggcctgagtttccggttcrtacaggtcagggccaggagccacagagtgggctgctctggactaaggaaggggctgtcttggtcccacccccacccatcctgacctttccattccgattgtggatcctgaacgggattgtgggggagttgagcagcagcaggaactcattctcaaacatcttcttcttcaggcgctcgatggcccggctctggcctttgttggctttctgcaggagatggggacacagagggttcccctcacactcgggcctttctcacgagcagcactaagcacgacactccactgtgtgttaacatgc

SEQ ID NO: 143319 - DNA, 601 bp, Human
gctggtgacaggaatgttgtgtacagtcctaagcttgaaacaggatcctgtgagcacctggagctccactgagctcaggacaaaggcctggagatctggagggagagccgagagagaagggagcgtgggcactggtccaccaggaccggctgctcttccctgggggctgctgcaggaagacggcttaatccctggggcagacttggtccttgcgagggagggggaaggatttgtggacacagcaggactggtgtagatgctgtgagaggggtcagagtaggagaatctaactgaagaggtktgtgtgtgtgtgtgtgtgtgtgtgtgtgtgtgtgtgtggtgtatgcgttttgttttcgttttttttttaaacggagtctcactctgtcgcccaggctggagtgcagtgctgtgatctcagctcactgcaacctccgcctctcaggttcaagggattctcctgcttcagcctcctgagtagctgggattacaggtgcccaccaccacacctggctaatttttgtgtttttagtagagacggggtttcaccacgttgcccaggctgatctcaaactcctgactgggattacaggcgtaagcc

SEQ ID NO: 143320 - DNA, 601 bp, Human
cagcctcatttcccatacaccattttatctaccgggtctgctctctcatgaatatattaacagcacaatctcagtgcaccagggtgccagttctcccaagccagacagaggggcccaaggaaaagctggggtcatctgggaactcagtagacagtcacccctacccaagctgtgtcctggccactcaacagtctcagcacagccgagcagggatcagccatttacagccacatgtctgtctgagtccttacgggaagccggccacgctctgagggctgggacctgccggttgggccacctstggttcccgagcttaccgtctttattgctggtgacaggaatgttgtgtacagtcctaagcttgaaacaggatcctgtgagcacctggagctccactgagctcaggacaaaggcctggagatctggagggagagccgagagagaagggagcgtgggcactggtccaccaggaccggctgctcttccctgggggctgctgcaggaagacggcttaatccctggggcagacttggtccttgcgagggagggggaaggatttgtggacacagcaggactggtgtagatgctgtgagaggggtca

SEQ ID NO: 143321 - DNA, 601 bp, Human
ttactggctgattgcttaaatcccttggcagagtggacgatgacatgaaggaagccatagagtcctggagactcatcgtctgcaagagagaaaagcccccagggcagagggtggtcagcggatcccctcagcctccaccccaggccggcgggaggcagacggggtatgagactcagctgagtcttggtccaacatcaccacctggtggccagatgaaaaagtttccgaaggccacggcggccttatatgtgagctgcccggggtagggctagggggtccttctctcctccactcagcctgkgggggtccagcacacccaccatcctggcccagggacttagtaccattccccatgggtactgtctctccctccaaatcctgcctatcctggcactgaaaactgaccaatatgataaatcattctgctaatgatttatgtcgaggaaagcttgccttcaggaccccgttcacaaagtggaccctttcccagcacacaggcagctagaatacacccactccggtcagttcccagccctgatcacagctccccactgctcaaaacccccccagactcccgggcttacagcatgaattccaaact

SEQ ID NO: 143322 - DNA, 601 bp, Human
ggcagagcagtgcagaatccacaatggcccacccaacctcgtcctggccagggcacttactggctgattgcttaaatcccttggcagagtggacgatgacatgaaggaagccatagagtcctggagactcatcgtctgcaagagagaaaagcccccagggcagagggtggtcagcggatcccctcagcctccaccccaggccggcgggaggcagacggggtatgagactcagctgagtcttggtccaacatcaccacctggtggccagatgaaaaagtttccgaaggccacggcggccttrtatgtgagctgcccggggtagggctagggggtccttctctcctccactcagcctgggggggtccagcacacccaccatcctggcccagggacttagtaccattccccatgggtactgtctctccctccaaatcctgcctatcctggcactgaaaactgaccaatatgataaatcattctgctaatgatttatgtcgaggaaagcttgccttcaggaccccgttcacaaagtggaccctttcccagcacacaggcagctagaatacacccactccggtcagttcccagccctgatcacagc

SEQ ID NO: 143323 - DNA, 601 bp, Human
aagaaacttgcccaaggtcacacagtttgtcatgggcagatatgaagttggagtccacgtgtttgtcgccctcagatatgaagttggagtccatgtgtttgtcgcactcggtttcttttttttttttttgagacggattctcgctctgtcgcccagggtggagtgcaatgccatgatctcagctcacagcaacctccgcctcccgggttcaagggattctctggcctcagcctcccaagtagctgggactacaggcgtccaccgccatgcccacgctaattttagtatttttagtagagayggggtttcaccatgttggcccggatggtctcgaactcctgacctcgtgatccgcccgcctgggcctcccaaagtgctgggattacaggcgtgagccaccgcgcccggcccctaggtttcagacagcttcagggagggcttgagaaagaggactttggagacaaaggccaggggtgacctccctgccaagaggagctggtttctggcctccaggggaatgccccatgtctaaaggcgtgctggcagggccccatcctgggcagagcagtgcagaatccacaatggcccacccaacctcgtc

SEQ ID NO: 143324 - DNA, 601 bp, Human
acacacgatcatatcccagcctgctctcgggtcaaaattcacaagcgtgactgccttttagtggaggcccagagaggttaagaaacttgcccaaggtcacacagtttgtcatgggcagatatgaagttggagtccacgtgtttgtcgccctcagatatgaagttggagtccatgtgtttgtcgcactcggtttcttttttttttttttgagacggattctcgctctgtcgcccagggtggagtgcaatgccatgatctcagctcacagcaacctccgcctcccgggttcaagggattctcyggcctcagcctcccaagtagctgggactacaggcgtccaccgccatgcccacgctaattttagtatttttagtagagacggggtttcaccatgttggcccggatggtctcgaactcctgacctcgtgatccgcccgcctgggcctcccaaagtgctgggattacaggcgtgagccaccgcgcccggcccctaggtttcagacagcttcagggagggcttgagaaagaggactttggagacaaaggccaggggtgacctccctgccaagaggagctggtttctggcctccaggggaatgcc

SEQ ID NO: 143325 - DNA, 601 bp, Human
taaattaacgacttcactccacatttctgagctcccatgcatcccagggtaaaggagacctggttcccgccctcagagaactcacagtgggagacgcaaattgttaagtgacaaaacagcatgacaggtgccataaccagcttgccctgagcaggatgggggcacaaggaacctcaggggatgggggcacaaggaacctcaaagggatggggatacaaggaacctcaggggacgggggcacaaagaacctgaggggatgggggcacaaggaacctgaggggatgggggcacaaggaacctsaggggatgtgggcacaaagaagggacaaagaagggaggccagtttgcccccaggaactcagggaggcttcctgggaaaggctgctctaacggcccggggagtcacctctgtgtggggcgctgcagggaggggtgagggcagaccccacctgccagtgaagagcagggagtgggaggggcaggtggagagggagagagtcagggtttctgatcctctgtgatgttaagtcttttctcctctctgtgactcggttacctcctctggcaaatgggtagaaactattagctgtctaactgactc

SEQ ID NO: 143326 - DNA, 601 bp, Human
atgttctcaccttctccaggtgcacggtaggtgctgtgtaaattaacgacttcactccacatttctgagctcccatgcatcccagggtaaaggagacctggttcccgccctcagagaactcacagtgggagacgcaaattgttaagtgacaaaacagcatgacaggtgccataaccagcttgccctgagcaggatgggggcacaaggaacctcaggggatgggggcacaaggaacctcaaagggatggggatacaaggaacctcaggggacgggggcacaaagaacctgaggggatggggkcacaaggaacctgaggggatgggggcacaaggaacctgaggggatgtgggcacaaagaagggacaaagaagggaggccagtttgcccccaggaactcagggaggcttcctgggaaaggctgctctaacggcccggggagtcacctctgtgtggggcgctgcagggaggggtgagggcagaccccacctgccagtgaagagcagggagtgggaggggcaggtggagagggagagagtcagggtttctgatcctctgtgatgttaagtcttttctcctctctgtgactcggttacctcctct

SEQ ID NO: 143327 - DNA, 601 bp, Human
gccggaggctcagagcggaccgtgagactgagaggctctgaacacgccacaggctttgcacatgtgagtacgtccacacgccagccatgttctcaccttctccaggtgcacggtaggtgctgtgtaaattaacgacttcactccacatttctgagctcccatgcatcccagggtaaaggagacctggttcccgccctcagagaactcacagtgggagacgcaaattgttaagtgacaaaacagcatgacaggtgccataaccagcttgccctgagcaggatgggggcacaaggaacctcakgggatgggggcacaaggaacctcaaagggatggggatacaaggaacctcaggggacgggggcacaaagaacctgaggggatgggggcacaaggaacctgaggggatgggggcacaaggaacctgaggggatgtgggcacaaagaagggacaaagaagggaggccagtttgcccccaggaactcagggaggcttcctgggaaaggctgctctaacggcccggggagtcacctctgtgtggggcgctgcagggaggggtgagggcagaccccacctgccagtgaagagcagggagtgggagg

SEQ ID NO: 143328 - DNA, 601 bp, Human
gggacccaactgctgaggccacagcaccggcacggaccccaggccctctgcaaacccacacccgccctgggctcggaccccagcagtcctcccacctccagggagatgccgaggttgttcccagggtaccagaggtggtgtgggaggtgcctttgggacactatggccaaccctctgcagcgtgaaacaacgtcagaggtcacagtgcgggcatacagtgcaggtggcttactccacttagcccctgcagctgcccagctgggccattctccatcagaacagctttcctggccgggcaagrtggctcacgcctgtaaatcccagcactttgggaggccaaggtgggcagatcacctgaggtcaggagtttgagaccagcctgaccaacatggtgaaaccccatctctactaaaaatacaaaagtgagcccggcgtggtggcacatgcctgtagtcccagctactcgggaggctgaggcaggacaatcgcttgaacctggggtgtggaagttgcagtgagctgagatggcaccactgcactccagcctgggcgaccaagtgactctttctcaaaaaaaaaaaaaccaaaaaaaccagctttc

SEQ ID NO: 143329 - DNA, 601 bp, Human
cccttgactgttccgtctccacatcttcctcaccatggagacgacaccacaaactcttcactgaccgccctggagccacctctccccgtaacatgggtgcccaggcctcaacagcggcatttggggtgggaggcgtttagcagccctgcctctgggtcctgaatgctcggagcatcccctgccgcggtgacgaccaacaacgcccacatccccaagcccagggtgctgtggtttcctccgctgcacttaacataaaccaaagggatcttctctactcgtgcgtccctagtctctctccccycacgacgtaaacaccatgtggagagaagcctgggttttcctgcctgccggtgtacccgcagtaccaagaacagggctgggaacccagctggcacacggtgaacgaggctcccaccaccaccaagcgctccaggtaacaaggcagtggagggctggggcgggagggcagggccgggggctttccccggcatttccatcttccaccctggccttcaggctgaaaatctaccttgggacccaactgctgaggccacagcaccggcacggaccccaggccctctgcaaacccacacccgccctg

SEQ ID NO: 143330 - DNA, 601 bp, Human
ggccgtccccagcagacaagccacgagcacggggtggtggggtccccacagagatgccagcccctgccactcacctcatcccacttgggctccgctgtgtcccggaacaccctggttttggctttgctgacaaaatagccgaaggaatccacctccagggtacagtacaggtctgtgggggaaggacagacggagatactgagtgagtggggccagggtggggcagctggggcggcactcaggatggagggggacatcgcatctgtcctttccaacgtccccacggatggcatcttggctstctcctccctgaagcccgggaccatctggcttctcccctgcccccttcttaggggctcagccctccccacctcggctcaccccacactctgcccttcctacctcagccctccccacactctgcccttcccacctcggccctccccacactctgcccttcccacctcggccctccccacactctggcctcctcctccctctaaagggcccttgactgttccgtctccacatcttcctcaccatggagacgacaccacaaactcttcactgaccgccctggagccacctctccccgtaacat

SEQ ID NO: 143331 - DNA, 601 bp, Human
acaaagggccctgaacctctgaagctgggaggcctggctttccggcaggtgcgtgcctcagctttgcaaggaggagggagtaagcacggcccacgaaggacacgtcagattttctggagctcccagaggcctcccatcacccctggagtctgggggcctgagctgacaccacagggtctgacacccagacacacaccgcgatcagaagccagaggagcagggagcagaaaggggggtgcagacatagctggtccaaccaatgggctggccgtccccagcagacaagccacgagcacggggyggtggggtccccacagagatgccagcccctgccactcacctcatcccacttgggctccgctgtgtcccggaacaccctggttttggctttgctgacaaaatagccgaaggaatccacctccagggtacagtacaggtctgtgggggaaggacagacggagatactgagtgagtggggccagggtggggcagctggggcggcactcaggatggagggggacatcgcatctgtcctttccaacgtccccacggatggcatcttggctctctcctccctgaagcccgggaccatctggcttct

SEQ ID NO: 143332 - DNA, 601 bp, Human
acctcctgggaactttcctccaaccagcttggaaccaaaatcacgaaagagcaggctccttgaccagaattccttttcaactggaaccacctcctggaggctccctcagcctcgccccggcgccctggcctcacctggatctgtcctttgcccatgatcttgtccacgatctcattgttgtccttgttgaccttggtcttgtcatagcacttctcatagcacaggatcctcagggactgggagccctccagctcgatctcaaactcctggggaaagatgggacaaagggccctgaacctcygaagctgggaggcctggctttccggcaggtgcgtgcctcagctttgcaaggaggagggagtaagcacggcccacgaaggacacgtcagattttctggagctcccagaggcctcccatcacccctggagtctgggggcctgagctgacaccacagggtctgacacccagacacacaccgcgatcagaagccagaggagcagggagcagaaaggggggtgcagacatagctggtccaaccaatgggctggccgtccccagcagacaagccacgagcacggggtggtggggtccccacagaga

SEQ ID NO: 143333 - DNA, 601 bp, Human
agctcggcgcccagctgtgcctggatcacgtctgcggccactgtcaagaagctcagcacgcccaacgcccgaggctcaacctcagtacgggtcagttaccgtctcccttcatttcatggtcacagaatctacccccaaaccagaccacttgcggcacagcacgaggccacacgaggtaccagacgggagtgtgagcggctccaccacgtcacgccttttcccgctcccaagcctacttctcttaataggttggtgaatagcagccatcttcaaaattggcagaatgtttcagagacacagrctgcacacacagaggccttttccctatatatgtttatagggagccaaaagcacagttgaggcataaatgctgtttttatttatttttatttttttggagacacggtctgactccatcacccaggcgcgatctcagctcactgcaacctctacctcctgggttcaagcgattctcctgcctcagcctactgagtagctgggattacaggcgcccgccaccacgacctgctaatttttgtatttttagtagagatggggtttcgccatgttggccaggctggtctcgaactcctgacctcgt

SEQ ID NO: 143334 - DNA, 601 bp, Human
atccgcccgcctcggcctcccaaagtgctgggattacaggcgtgggccccacacccagctaattcttgtatttttagtagaaacagggtttcgccatgttggccaggcgggtctcgaactcccgaccttgtaatccgcccgcctcggcctcccaaagtgctgggattatgggtgcgtgccaccacgcctggctaatttttgtatttttagtaggaaaggggttttgccatgttggccaggctggtctcgaactcctgacctcgtgatcagcccacctcggcctcctgctctttcccgcacrtgctcctctccttcctcccaggggcaccaggcacaagtgtcccctgcccagaggactccaagacaaaggacgctcaccttatgccataaagcagcacctcagctgcttctccaagccattagccatgccacggccctctgtccgggctgagggattcgttgacaaaggcctgagacgtggggacatggcacagaggagggaacatggcctttcccacataccatacgcagagatgccttggccaaggtacttaacctcagtaccccagtgtcctcatctgtaagatggggaggagggact

SEQ ID NO: 143335 - DNA, 601 bp, Human
cccgccctggcctcccgaagtgctgggattacaggcacgcacgaccacccctggctaatttttatatttctagtagagacggggtttcgccatgttggccaggcgagtctcaaactcccgacctcctaatccgcccgcctcggcctcccaaagtgctgggattacaggcgtgggccccacacccagctaattcttgtatttttagtagaaacagggtttcgccatgttggccaggcgggtctcgaactcccgaccttgtaatccgcccgcctcggcctcccaaagtgctgggattatgggygcgtgccaccacgcctggctaatttttgtatttttagtaggaaaggggttttgccatgttggccaggctggtctcgaactcctgacctcgtgatcagcccacctcggcctcctgctctttcccgcacatgctcctctccttcctcccaggggcaccaggcacaagtgtcccctgcccagaggactccaagacaaaggacgctcaccttatgccataaagcagcacctcagctgcttctccaagccattagccatgccacggccctctgtccgggctgagggattcgttgacaaaggcctg

SEQ ID NO: 143336 - DNA, 601 bp, Human
cacagggtttcaccacgttgaccaggctggtttcgaactcctgacctcaggtgatccccccgccctggcctcccgaagtgctgggattacaggcacgcacgaccacccctggctaatttttatatttctagtagagacggggtttcgccatgttggccaggcgagtctcaaactcccgacctcctaatccgcccgcctcggcctcccaaagtgctgggattacaggcgtgggccccacacccagctaattcttgtatttttagtagaaacagggtttcgccatgttggccaggcgggtctygaactcccgaccttgtaatccgcccgcctcggcctcccaaagtgctgggattatgggtgcgtgccaccacgcctggctaatttttgtatttttagtaggaaaggggttttgccatgttggccaggctggtctcgaactcctgacctcgtgatcagcccacctcggcctcctgctctttcccgcacatgctcctctccttcctcccaggggcaccaggcacaagtgtcccctgcccagaggactccaagacaaaggacgctcaccttatgccataaagcagcacctcagctgcttctccaa

SEQ ID NO: 143337 - DNA, 601 bp, Human
ctcccaagtagctgggattacaggtgcccgccatcacgcctggctaatttttgtttttttagtagacacagggtttcaccacgttgaccaggctggtttcgaactcctgacctcaggtgatccccccgccctggcctcccgaagtgctgggattacaggcacgcacgaccacccctggctaatttttatatttctagtagagacggggtttcgccatgttggccaggcgagtctcaaactcccgacctcctaatccgcccgcctcggcctcccaaagtgctgggattacaggcgtgggccmcacacccagctaattcttgtatttttagtagaaacagggtttcgccatgttggccaggcgggtctcgaactcccgaccttgtaatccgcccgcctcggcctcccaaagtgctgggattatgggtgcgtgccaccacgcctggctaatttttgtatttttagtaggaaaggggttttgccatgttggccaggctggtctcgaactcctgacctcgtgatcagcccacctcggcctcctgctctttcccgcacatgctcctctccttcctcccaggggcaccaggcacaagtgtcccctgcc

SEQ ID NO: 143338 - DNA, 601 bp, Human
agcaggacaatcttccgtcttcttacagcaggacaatcttccgtcttcttacagcaggacaatcttccgtcttcttatagcaggaggcagcaggacatctagaaatgggctctgcagccagctgcccgccctggcccactcctgggcacatggccttggccgggctccttagccccagcttcctcatctttctagctgtgatgatattcctctcccacagggtcctgggaagatctcctgagacagcagatggaagcatttagcaccgtgctgggctcgtcctgggctcgcttatgtgtgyacggctattgtggctgacatctagcattcttctcactggagaacatggaccaatatactcgtctttccaatctgacagtgggtccctggaggccaggaccccctcctgggctggggacctcacagacgcatgctaagtacccctcctgctgttttcttttcttttttttccccagacagaatctcattctgtcttgtccaggctggagtgcaatggagcaatctcagctcactacaacctccacctcccaggttcaagtgattctcctccctcagcctcccaagtagctgggattacagg

SEQ ID NO: 143339 - DNA, 601 bp, Human
tctacataaaaatgtgtatacctcaagaagggaaaaggcacagaataaactggctgcttcggaggagccggaggaaggatggtttctgattaggtttcaagtctctttgcttctactgcaattttctttctcatacaaacattgcttttggaattaaaaaacccagggcttccaaatcgctctcgttccacctcctccttgaagcctccctaattccagcccatggtgacctttctgcctctgaattcctgcgggacaatcttccatcttcttatagcaggacaatcttccatcttcttayagcaggacaatcttccgtcttcttacagcaggacaatcttccgtcttcttacagcaggacaatcttccgtcttcttacagcaggacaatcttccgtcttcttatagcaggaggcagcaggacatctagaaatgggctctgcagccagctgcccgccctggcccactcctgggcacatggccttggccgggctccttagccccagcttcctcatctttctagctgtgatgatattcctctcccacagggtcctgggaagatctcctgagacagcagatggaagcatttagcaccgtgctgg

SEQ ID NO: 143340 - DNA, 601 bp, Human
taaatctacataaaaatgtgtatacctcaagaagggaaaaggcacagaataaactggctgcttcggaggagccggaggaaggatggtttctgattaggtttcaagtctctttgcttctactgcaattttctttctcatacaaacattgcttttggaattaaaaaacccagggcttccaaatcgctctcgttccacctcctccttgaagcctccctaattccagcccatggtgacctttctgcctctgaattcctgcgggacaatcttccatcttcttatagcaggacaatcttccatcttmttacagcaggacaatcttccgtcttcttacagcaggacaatcttccgtcttcttacagcaggacaatcttccgtcttcttacagcaggacaatcttccgtcttcttatagcaggaggcagcaggacatctagaaatgggctctgcagccagctgcccgccctggcccactcctgggcacatggccttggccgggctccttagccccagcttcctcatctttctagctgtgatgatattcctctcccacagggtcctgggaagatctcctgagacagcagatggaagcatttagcaccgtg

SEQ ID NO: 143341 - DNA, 601 bp, Human
ctgaggctcctgactttcctgggaccctcccttcacattcgtgcctccctgccaggcgggtctgtcctccggaactcccaccctactcccttctgcggaagcggagcctgcgcaccttgctggaataacacagagccttagcatagcaattgcgctggctgctctataccaagatttctacaaagaatataaagtacttttaacaaagtatccaaaaaggtgcttaagaagactccatacagctctagagaaaaggaggtttataataatccatgaaaacagaaaaacagacaaaacaggycctgattaaatctacataaaaatgtgtatacctcaagaagggaaaaggcacagaataaactggctgcttcggaggagccggaggaaggatggtttctgattaggtttcaagtctctttgcttctactgcaattttctttctcatacaaacattgcttttggaattaaaaaacccagggcttccaaatcgctctcgttccacctcctccttgaagcctccctaattccagcccatggtgacctttctgcctctgaattcctgcgggacaatcttccatcttcttatagcaggacaatcttc

SEQ ID NO: 143342 - DNA, 601 bp, Human
gccattgccctccagcctgggcagcacagcaagaccccatctcaaaaaaaaaaaaatacctcttccggccaaacccccaggaatcccctccttttattcattccttctactggccttgcttgcagctccccgccacccctgctgaggctcctgactttcctgggaccctcccttcacattcgtgcctccctgccaggcgggtctgtcctccggaactcccaccctactcccttctgcggaagcggagcctgcgcaccttgctggaataacacagagccttagcatagcaattgcgctggcygctctataccaagatttctacaaagaatataaagtacttttaacaaagtatccaaaaaggtgcttaagaagactccatacagctctagagaaaaggaggtttataataatccatgaaaacagaaaaacagacaaaacaggccctgattaaatctacataaaaatgtgtatacctcaagaagggaaaaggcacagaataaactggctgcttcggaggagccggaggaaggatggtttctgattaggtttcaagtctctttgcttctactgcaattttctttctcatacaaacattgctttt

SEQ ID NO: 143343 - DNA, 601 bp, Human
gtgggcgcctgtaatcccagctactcgggaggctgggacaggagaatggcgtgaacctgggaggcagaggttgcagtgagccgagattgcgccattgccctccagcctgggcagcacagcaagaccccatctcaaaaaaaaaaaaatacctcttccggccaaacccccaggaatcccctccttttattcattccttctactggccttgcttgcagctccccgccacccctgctgaggctcctgactttcctgggaccctcccttcacattcgtgcctccctgccaggcgggtctgtcctcyggaactcccaccctactcccttctgcggaagcggagcctgcgcaccttgctggaataacacagagccttagcatagcaattgcgctggctgctctataccaagatttctacaaagaatataaagtacttttaacaaagtatccaaaaaggtgcttaagaagactccatacagctctagagaaaaggaggtttataataatccatgaaaacagaaaaacagacaaaacaggccctgattaaatctacataaaaatgtgtatacctcaagaagggaaaaggcacagaataaactggctgctt

SEQ ID NO: 143344 - DNA, 601 bp, Human
aaatccacctatggccacggagctgtgcacccaaaaattattattttttgagatggagtctcactctattgcccaggctggagtgcagtggcatgatcttggctcactgcaacctctgcctcccaggttcaagcaattctccagcctcagtgtcccgaatagctgggactacaggcgtgcaccaccacgcccggctaattttttttaatctttgtagagatggggtctcaccatgttggccaggctggtcttgaactcctgacctcaggtgatccatctacctcggcctcccaaagtgctrggattacaggcgtgagccaccgcgcccggcccctaaaatttattaaaatggtaactttatgttatgtatatttcactacaatcttttattttttatttttttcagtggagatagactcttgctctgtcacccaggctggagtacagtagcgcaatccttagctcactctagcctccttagcctcccaagtagtccacagctacaccacgtgagctactatgcctggcttctaccactattttttctttaaaaagaataaaggccggacgcggtggctcacactcccttcctggcctggaa

SEQ ID NO: 143345 - DNA, 601 bp, Human
tccacagacggataaacagacgtggcacctacatccacggacggacgggcagataaagagacgtggcatctacatccagggaaattgtatccagcctcagaaagggaggaaattcagacacacaacggcatatgggtgaagctcaaggacatgaggaggacaaatgctgtctgattccacctacgtaaggttcccagactggacaaattcgtacagacagaaagcaggcaggtggttactggaggctaagggtgcaggagtggggagttatgatttaatggggatggggtttcggctgggragggccaacaagttctggatatgcacactggcaacggctgcacagcaccaaatccacctatggccacggagctgtgcacccaaaaattattattttttgagatggagtctcactctattgcccaggctggagtgcagtggcatgatcttggctcactgcaacctctgcctcccaggttcaagcaattctccagcctcagtgtcccgaatagctgggactacaggcgtgcaccaccacgcccggctaattttttttaatctttgtagagatggggtctcaccatgttggccaggctggtct

SEQ ID NO: 143346 - DNA, 601 bp, Human
tgaccagtcatgccctagggtcacgggtcctgctcatctattacagctgggaggcaggtgggggacagagcttgggtctggagagaaggaggctgtgctgtctccatcctcagggacaaggttctttttctcaacgaaaggcaagagcgttttgggtggaaacaacccaaatgtgcacggatggacggacggacggataaacagacatggcacctacatccacggacggacggataaacagacatggcacctacatccatgaatggatggataaacagacgtggcacctacatccgcggayggatggataaacagacgtggcagctacatccacaaacggatgaataaacagacgtggcacctacatccacgaacggatggataaacagacgtggcacctacatccacggacggatggataaatagacatggcagctacatccacagatggacaggcggataaacagacgtggcagctacatccacgggtgggtggacaaacagatatggcacctacatccacggacggatggataaacagatgtggcacctacatccatggacggatggatgggtaaacagacatggcacctacgtccac

SEQ ID NO: 143347 - DNA, 601 bp, Human
gtcaggagttcgagaccagcctggccaacatggcaaaaccccgtctctactaaaaatacgaaaattagctgggcatggtggcgggcgcctttaatcccagctaaccaggagactgagacaggagaatcacttgaacccgggagacggaggttgcagtgagccaagactgcgccattacactcagcctgggcgacagagagagactccatctcaaataaatataaataagtaaataaataaaagaagaaactgagatgccaagaagtcaagggaccagaggttgttcccgcggcctcagggygactgcgtctgcattcgatgcacctaaaccactgaccaggggaggaaagagctgacccaggaagaagggtgaaggggtcaaggggcagggacacttggccgggagggggagagaaggccgaggcagggggcccaactgtgtgcttcaactacaggagactaatagtgaccagtcatgccctagggtcacgggtcctgctcatctattacagctgggaggcaggtgggggacagagcttgggtctggagagaaggaggctgtgctgtctccatcctcagggacaaggttctttttctcaac

SEQ ID NO: 143348 - DNA, 601 bp, Human
cttgaagagggacagcaggtgggagtctgggctggagaacaaatgtgcccgaaacagctggggtgggcagggccagagcaggacaatggctgcagtcacggggccctgggaggaagtggagagtcagcaggaagtagaaccaggcctggggctcagcctccacggtccctatgtgcctggggaactggcacaggggtgggggtggcggcagagggaagagccccacgtgggccagctgtgagggtggcaagcagcagggaggcggaactcctaagccaggagccgaggcggggcctgacaygcactcctggccttggcgggcgccgacgcgggctgatcttccagggagaggtcactccggtgtcccacgacagggagctatgggggctgtgagtgccagggcaggggttggggacgggagagatggaaccaaagggaaaggcctgtgttccttcccagttgaatcaaggcctccctcagggccaggggcccggctgtggtcagtgtggcccacgcgtgaggcctggaacggggaagcactgaggacccacgttaccggccgtcgatcatcttcctgggaggggtcccagtaccactatga

SEQ ID NO: 143349 - DNA, 601 bp, Human
ccacccttcagaggcgggtcagggggagcgggcgccaagcctgcctgctgaggcggcacttcccaggggtggaggggagcggggggagccgactcacacctccatctgcttcctgctggatgcttcctgcccagaatccactgggcagagtccaggctcccaaaatcaggaacacctgggcgatggaggcagctgagcagggctgacgagagaggttcgtgccccacgtttggaaaagctttcgacggcagggcaggcactctcgagggaccctcccccgacttcccccacccaggacagkctctgctgcccactctccaaggagaaccaggcgtctagacctgccttgaagagggacagcaggtgggagtctgggctggagaacaaatgtgcccgaaacagctggggtgggcagggccagagcaggacaatggctgcagtcacggggccctgggaggaagtggagagtcagcaggaagtagaaccaggcctggggctcagcctccacggtccctatgtgcctggggaactggcacaggggtgggggtggcggcagagggaagagccccacgtgggccagctgtgagggtggcaagcagca

SEQ ID NO: 143350 - DNA, 601 bp, Human
tcctttgggaaactcagggcttttgctcagtggctgtgggttcgccctggcagcctcgagaggggacagcacctgtctagtgggtcaggcgggtgtgtctgggtcatcttgcgtctccagccgcgctagggtctttcctgaagccagggcagctcagcacttgcctccgagggcgtgaacacggtgtgcccatccctccctgccccagcccaaagctacaggctacactggggcttagaccctcgcccagcaccaccaatgtccacgcccccaggccacggcaagggcggggctggccacraggggctgctgtgagtctgcggtggccgcaggcttgagggaggccagcagagcccaccctaaaggtgacccccgctcagcattcatctgcagcctcagccctaactcaagaaattctctggcaacccttctgtggcatccttctcttgaagctttcagaaaacacggaaagtgggacaaccctggagctgatcctttggattcctaggaggaagcagcagcctccgccagcagggaggttagcggctcacggggaggaatctatgtctgcggctttcgcctcggcgagttcgctgaatgc

SEQ ID NO: 143351 - DNA, 601 bp, Human
aaatgcacttgagcctttgggaacatcttgcttatctagaacaaaactcacccagggacagagtgggcagggcgtggcccctcagtatgctgtccctaccgctggagcccccctgggctgcttgcctgctcctcctcccgggaaggagggggtgtggccgggtctcccagcacagccataaattgcagcctgaggcaggaggggctgaggcctgaaggtgggatggggtcgccgagcctccctgctctttcttcattctggattcccgaacacctcccttccacccaagctccgagctcayggtggccagaagcaaagccctgggagccagggacctgtggactcaacggctgtgtttttctctgggttcagtttccacagctgtcaaatcaggagctcggaacagacacatggtctccggtgagatttcttttctgctgaggacgcacccctgccgttttttccaaatgaaattttatgccgacgtctccctgcccacctcgtcggataaaagcagaagcagagagagcaggcgccctggctgaagaggggacgtggggcccactggctcacacctgcttttccaccacccctcgcctgc

SEQ ID NO: 143352 - DNA, 601 bp, Human
atgggcacagtgtaaggaagaaggcagtcaggatgaaatcagttgctctacggcccagacctaggcctgcccaaggtaacctgctgtcctcccaactccccaaaggcctgtgccggctcatagggcagtcccgagtacgtgctgcttctcacacagctccagcctccctctgcctgacctccagcctctctctggccacgtcaggctggtgtcgccagggtgctcggtggttctaggtacggaggagaggctgaaacagcccaagagcttgtctgctgcaggagaagtgtcccgacagccygtccctggcaaaccctagcgattctcacagcacatttggtcatggaaaagggtgaaaaatgcacttgagcctttgggaacatcttgcttatctagaacaaaactcacccagggacagagtgggcagggcgtggcccctcagtatgctgtccctaccgctggagcccccctgggctgcttgcctgctcctcctcccgggaaggagggggtgtggccgggtctcccagcacagccataaattgcagcctgaggcaggaggggctgaggcctgaaggtgggatggggtcgccgagcctccctg

SEQ ID NO: 143353 - DNA, 367 bp, Human
tgccttcgcagatgggtagccgagttgggagtcttcccctgagacgctcatctttcccttcctccctatggactgggggcttcctctggggacagcgcagacttgccttctctcccccaagcccgactcattgcttcctggagtcaatggtcttgggtggaagaagatctgtgcaagacagatgtccccagcaaaagcagaagtctgaattctagtcgctgcagcccaccacggacccctcctcatctctgctgggttcagctcaggctatcccaaccacctgggaaggggccactctccytcctccctcactccttccatcccctaaacctgctcccccccaccccttccaccccctacacctgct

SEQ ID NO: 143354 - DNA, 601 bp, Human
ctgctctccacgtttgcgccacagtgctcctggtgccgtgacttaacttcagaatcggcccctcactggcctatggtccccttccctcgggctgggtcccaggccacagggtgcagactgcgagaatgcacgcccctccctgccgccgggtgtgggggagaagggggccgtgtgaatcccgttcccaaggcccggcactcatctgtcttaggtaccacaggctcaatacttgtctaggtaaagcaagctcggactggatgaacgatggccagctggtctccatggtgacataagtgccttygcagatgggtagccgagttgggagtcttcccctgagacgctcatctttcccttcctccctatggactgggggcttcctctggggacagcgcagacttgccttctctcccccaagcccgactcattgcttcctggagtcaatggtcttgggtggaagaagatctgtgcaagacagatgtccccagcaaaagcagaagtctgaattctagtcgctgcagcccaccacggacccctcctcatctctgctgggttcagctcaggctatcccaaccacctgggaaggggccactctccttcctcc

SEQ ID NO: 143355 - DNA, 601 bp, Human
tcatgtaactggctggtaggatgccattataactgctctccacgtttgcgccacagtgctcctggtgccgtgacttaacttcagaatcggcccctcactggcctatggtccccttccctcgggctgggtcccaggccacagggtgcagactgcgagaatgcacgcccctccctgccgccgggtgtgggggagaagggggccgtgtgaatcccgttcccaaggcccggcactcatctgtcttaggtaccacaggctcaatacttgtctaggtaaagcaagctcggactggatgaacgatggmcagctggtctccatggtgacataagtgccttcgcagatgggtagccgagttgggagtcttcccctgagacgctcatctttcccttcctccctatggactgggggcttcctctggggacagcgcagacttgccttctctcccccaagcccgactcattgcttcctggagtcaatggtcttgggtggaagaagatctgtgcaagacagatgtccccagcaaaagcagaagtctgaattctagtcgctgcagcccaccacggacccctcctcatctctgctgggttcagctcaggctatccca

SEQ ID NO: 143356 - DNA, 601 bp, Human
acaggaggcagacaagcatttgtgcatttggcacgggtcacttgtgcacctactaggcaccacgcccagatggacaaaacccgcacaaaatcccatattacggcctcagaacaggacagacaaaatgccacgaacatcgagagatacaatttccagctggaggcaactggggaaggcttcctggaggagaggggtcagcgtggggccctcggggctgtagggaaaggccatccaccctcgctgggtcccagctttactctacctccctccagcaaacgtgcaatggctgtcatgtaactgrctggtaggatgccattataactgctctccacgtttgcgccacagtgctcctggtgccgtgacttaacttcagaatcggcccctcactggcctatggtccccttccctcgggctgggtcccaggccacagggtgcagactgcgagaatgcacgcccctccctgccgccgggtgtgggggagaagggggccgtgtgaatcccgttcccaaggcccggcactcatctgtcttaggtaccacaggctcaatacttgtctaggtaaagcaagctcggactggatgaacgatggccagctggtctc

SEQ ID NO: 143357 - DNA, 601 bp, Human
ggtgggggttaaggcatcacagagacgaatcaaaagtcagtgcttgacaaaggggcagccaagaaagcagagatgtccatcaacaggaggcagacaagcatttgtgcatttggcacgggtcacttgtgcacctactaggcaccacgcccagatggacaaaacccgcacaaaatcccatattacggcctcagaacaggacagacaaaatgccacgaacatcgagagatacaatttccagctggaggcaactggggaaggcttcctggaggagaggggtcagcgtggggccctcggggctgtrgggaaaggccatccaccctcgctgggtcccagctttactctacctccctccagcaaacgtgcaatggctgtcatgtaactggctggtaggatgccattataactgctctccacgtttgcgccacagtgctcctggtgccgtgacttaacttcagaatcggcccctcactggcctatggtccccttccctcgggctgggtcccaggccacagggtgcagactgcgagaatgcacgcccctccctgccgccgggtgtgggggagaagggggccgtgtgaatcccgttcccaaggcccggcac

SEQ ID NO: 143358 - DNA, 601 bp, Human
gtggaaggctggcagggaccaggcatcatggattaagtcacttacccctcccaactgtatgaagtcagtaccagcatccccgctttacctctgaggaaacgaagggctctgacaagctgagctacgtgtccaaggccaggacaagctggaacacaaacggaggtctggctaactccaaagcccacacccctgtcactcactgtgatgccctagtgtggcaggatctggccctggactatcttccacctggctggtggaggggggccttggggcgtcctgcctgggctagaaccgggcctcrgtcttcactgtccctgcaggggcggccagaccagctccacttcttcctggctcacacgtcacacgcacccctggacggtgcacacggaacttcctcaaacctgagctgctaagtgggggctgagccacaacagcctcaccagcaccgcctgagggggaggtggagagacggacggaggtaggaacatgcctgtgtcccctaactgaggcctcagtcacccttctccacccctccttcgcctgccccttccagggctccaggaggacccagacagccccttcacacagccacaaagccatc

SEQ ID NO: 143359 - DNA, 601 bp, Human
caagttagagtacggtattcagagaaaagagaaaggctgaatcccaaatgtttaactatgcaaaacccaggggtgtctggggcctcggacctctgcagaccccagcacggcacagaaaggaaaccagtatttgcaccgtggcaaccgcgaaccaggtctttcaaacgcccgactgcatgtgagcctcacattcttgtcatgttggtgttactgccctgttctagagaggtgaggacagggggtcaggaggtccagttcttgccagggttacacagtgccaagtgaggatggggaggtcccyccaaagcccttggtgctcacaagcactgtgccttactcaaacatggatgatgctttggattcaggaaaaagagctgggtcaggacatttcttggttgaccccaaggcaggtgggtcggggcccagagacgagccctcggcatccggcgtcaccagccaggcaggtgtcgggatttctcctcagaggccttggtgtttttgaggaataggtggcttccctgcagagacagccgtagtcagagctgtccttcgtggaaggctggcagggaccaggcatcatggattaagtcacttacccctc

SEQ ID NO: 143360 - DNA, 601 bp, Human
gggaccttcttctaagaccatcatgagcctgaagcttccccgaatggcccaagaggggctctccaccccgcccttcctcaggtaacacctctgatcctctctgaagcaaaggcagcagctcccatcacagaacacgggactcaccgtgggggtcagcagtgccggtgtccagcttaagaggagctctttggaagtaggggattctcagacccacgtggctgtgcttcagggcagagacaaggtcacctgaagctgcactcaatctccttagaccctgccggctcagcctgagtccccaccrccggccagcatctggcctggtctgggtcaggagcgtcttggacttggttgctctataagggcctcaacttccccgacagacaaatgcttctggaccggcctcccttcaggccctcttagcctcctcacggctcccacaaggggatgctgcgggggcggggtgggggggttcctccttcagccccttcccctccaaagctcaagcgagaatctagaattcagccccttcccatccaaagctcaaccaagaatctagaagagggaaggatgggagggagaggaaggcaccgggcctggtcta

SEQ ID NO: 143361 - DNA, 601 bp, Human
gtgtaccctcgatggccaagtgagtggtagagtgaacctctggggtgtgcacgtggtctgcacacctggtaccatcaagaaggaataaacgacaggctctgtgaggggtggggttgtcctgcggtggcgatcaagctgacaaagaaagggaccctttcctccccccaccccaagaccgagtctcgctctgttgcccaggctggagtgcagtggcatgatctcggctcactgcaacctccacctcccaggttcaagcgatgctcctgcctcagcctccctagcagctgggattacaggtgcscgccaccatgcccggctattttttttttttttgtatttttagtagacacggggtttcaccatgttggccaggctggtctcgaacgcctgacctcaggtgatccacccgcctctgcctcccaaagtgctgggatgacaggcgtgagccaccacacttggctaatttttgcattgttagttgagacggggcttctccatgttggccaggctggtcttggactcctgacatcaggtgatccaagaaagggaccttcttctaagaccatcatgagcctgaagcttccccgaatggcccaagagg

SEQ ID NO: 143362 - DNA, 601 bp, Human
gggttcccgctctgcggactcaagcaagcctcttgggagctggcctggcagagagatcagagagtactcatgaggccccagcagtgaggtctgcccactcggcaggtgggtaagtgctgtggaaaagagggagggtcgcccgaccccactgccaacctgtcagccagcctggccgcagtcaggacccacacataggcccaggaagaggtgggctggtgtaggggcctccagctctcgggggaggcagcaatgtagtcccctgtctgtggctgaggggtcgctatgggggtgtgtgtgaacmgagaagacgcacgatgaagctttcttcccaccgggaaacaaggaagggcggtgggcagccgggccaggccagacttctattgcagaaggctgcgagatctttcctgacgcccagactggattataaaataaagtagacgagcccaagacatatctgtatcttgtacccagcacctgtgtaccctcgatggccaagtgagtggtagagtgaacctctggggtgtgcacgtggtctgcacacctggtaccatcaagaaggaataaacgacaggctctgtgaggggtggggttgtcctgcggt

SEQ ID NO: 143363 - DNA, 601 bp, Human
acgaggtcaaagaacagcacctgctgaccagttcccaaccacctgggcagtgagcgaggccactcagcagagggccaggcctctccagcaccagcgccctgtggccaacacctggcagctcccccagactcacacctgcaggcttgggggcgcttccaaaatgcctggggcagctcccccagactcacacctgcaggcttgggggctccttccaaaatgcctggggcagctcccccagactcacacctgcaggcttgggggctccttccaaaatgcctggggcagctcccccagccacacmtgcaggcttgggggctccttccaaaatgtctggggcctcattgcctctgggtactacagcaacactgggctcaggcagctttggcctttgaggaacccccttgattggcaggttctcctctccctggtccagagccatccaaaagctggggcaccgcgcccagcaccgctggctggccaagccgtctgtggcctgcagggaggccggggaggaccagcgcccttctaccctccctaggtaccaagaagcggcaccttgccaagttcactcagagcagggttcccgccttgatgtctgcag

SEQ ID NO: 143364 - DNA, 601 bp, Human
aaggtcttcggagatggtttccaccacctcccctcccacaagccctcacccagggccctttaatccacagtaaggggcctgtggtggccctgcccaaggcaggtgggacttagaactggccactgggggtctcagtggaggggggagcagaggtcccaagcagccttcagtggacgccactcaggacgtgatccaggggctcactggacgacgggaatctgaagaccacatttgccagggccccaagagctcccaggcctccgcctccttcctgaaagccgcttccctcaggagcccactsggtcactcccaccgcccaggagctgaccccccgaggagccctgcctccaggcacagccctgccctcgggggccgccccatcctgcctctcacggctggcgctcttctaccctccaccctctgagccccggcatcccagaatgcgggagggtttccctcagagggggttgcagaggttcataaaaaaaagtgcttcttcagccaggtgcggtggctcacgcctgtcatcccagcactttgggaggccgaggcgggcggatcacaaggtcaggagatcgagaccaacctgaccaacgtggcg

SEQ ID NO: 143365 - DNA, 601 bp, Human
agctcaactatttccttctcttttttttttgagacggagtcgcactctgtcgcccaggctggagtgcagtggcgcgatctcagctcactgcaacctccaccttcgggttcgagcgattctcctgcctcagcctcccgagtagctggggctacaggcacgagccaccacgcccggctaatttttgtatttttagtagagacggggtttcaccgtgttggccaggctggtctccaactcctgacctcaggtgatccacccgcctcggcctcccaaagtgctgggattccaggcgtgagccccygcatccggccgactgttttctctttgtctgggcacttcgcctggtcaaatcatgactgcgcattcaggcctctcccaaagagaaacgctggcgctgggggctcatgtccaggagacgaccaggtcccctgcggcgaaaacccagcaggcaggggcaccgggttgaaatggggctccgtcacctccgagggagcaggagtgaagacccgaaggtgagcgtggattctctgccaagaatcccgtaggtggctggtggaggtcgcctcgcctttctggaccgaagtgacctcatgtttggggc

SEQ ID NO: 143366 - DNA, 601 bp, Human
acacctgactgctcaccctctggtcccagcagacaggtgccttccatgggcccaggggagcaggtacttgggggatgtctgatcacctgaagcagggagacagagggagctcgtgaagggtcaggctgggaagaccaccaggggcacacgagcactggggcctccccaaggtgggccacaggcaggagacagaaacaggctgcaaaacatcgtggagccaaaaggcggacgaacgactgggccaggggtcgacgactgggccgtacatggtcactgagagcagctcaactatttccttctyttttttttttgagacggagtcgcactctgtcgcccaggctggagtgcagtggcgcgatctcagctcactgcaacctccaccttcgggttcgagcgattctcctgcctcagcctcccgagtagctggggctacaggcacgagccaccacgcccggctaatttttgtatttttagtagagacggggtttcaccgtgttggccaggctggtctccaactcctgacctcaggtgatccacccgcctcggcctcccaaagtgctgggattccaggcgtgagcccccgcatccggccgactgtttt

SEQ ID NO: 143367 - DNA, 601 bp, Human
ctatttataactcctgggaaatgtggactgtgctatttcctgatgagattagcaccggggtggaggggctggcccctgggacgttggtggatgggacacctgactgctcaccctctggtcccagcagacaggtgccttccatgggcccaggggagcaggtacttgggggatgtctgatcacctgaagcagggagacagagggagctcgtgaagggtcaggctgggaagaccaccaggggcacacgagcactggggcctccccaaggtgggccacaggcaggagacagaaacaggctgcaawacatcgtggagccaaaaggcggacgaacgactgggccaggggtcgacgactgggccgtacatggtcactgagagcagctcaactatttccttctcttttttttttgagacggagtcgcactctgtcgcccaggctggagtgcagtggcgcgatctcagctcactgcaacctccaccttcgggttcgagcgattctcctgcctcagcctcccgagtagctggggctacaggcacgagccaccacgcccggctaatttttgtatttttagtagagacggggtttcaccgtgttggccaggct

SEQ ID NO: 143368 - DNA, 601 bp, Human
tgctgggattacgggcgtgagccaccacgcctggcccgggcccttattttttaattgacacattgcagttgtatgtatttatggggcgcagttcgatgttttgagaccaccccttcttgaggcaggtctctccacacatcagcataagcctcaggccaattccatggcccctggtccgattcacccacagcccctcctccgccccagcttcccacgactgggtgcctcctggcagcttctgcaggaagctgagccaatggtcccttcccaagtctcagggggacctggacacaacctggtsggggggagtgtgcaggatttggaggcaggctgatctgagtctcccattcaaccgtgcgcactcgggcaaggcctttcacctccgtgaacttcaatttcctcatggaggcatccacacctgactcacagggctgttatggaagagtgagagcaacggacttatctcgagctcttcctgcaagtctgacactgatgaatcctctacacacagcatctgcgttcatgatcatgatagcagacatatgcggtttaagctctcatagccgctcccatctcacagatgaggatgctgcagcttaac

SEQ ID NO: 143369 - DNA, 601 bp, Human
ctcagcctcctgaagagctggcattacaggcatgtaccactgtgtgggcccttattttttatttatttatttatttttgagacggagtcttgctctgtcgcccaggctggagtgctgtggcgcgatcctggctcactgcaagctccgcctcccgggttcacgccattctcctgcctcagcctcctgagtagctgggactacaggcgcccgccaccacccccggctaattttttgtatttttagtagagacggggtttcaccgtgttagccaggatggtcttgatctcctgacctcgtgatycgcccacctcggcctcccaaagtgctgggattacgggcgtgagccaccacgcctggcccgggcccttattttttaattgacacattgcagttgtatgtatttatggggcgcagttcgatgttttgagaccaccccttcttgaggcaggtctctccacacatcagcataagcctcaggccaattccatggcccctggtccgattcacccacagcccctcctccgccccagcttcccacgactgggtgcctcctggcagcttctgcaggaagctgagccaatggtcccttcccaagtctcag

SEQ ID NO: 143370 - DNA, 601 bp, Human
tgctatgttgccctgggcttcagtgatcctcctgcctcagcctcctgaagagctggcattacaggcatgtaccactgtgtgggcccttattttttatttatttatttatttttgagacggagtcttgctctgtcgcccaggctggagtgctgtggcgcgatcctggctcactgcaagctccgcctcccgggttcacgccattctcctgcctcagcctcctgagtagctgggactacaggcgcccgccaccacccccggctaattttttgtatttttagtagagacggggtttcaccgtgtyagccaggatggtcttgatctcctgacctcgtgattcgcccacctcggcctcccaaagtgctgggattacgggcgtgagccaccacgcctggcccgggcccttattttttaattgacacattgcagttgtatgtatttatggggcgcagttcgatgttttgagaccaccccttcttgaggcaggtctctccacacatcagcataagcctcaggccaattccatggcccctggtccgattcacccacagcccctcctccgccccagcttcccacgactgggtgcctcctggcagcttctgca

SEQ ID NO: 143371 - DNA, 601 bp, Human
ctcactgtgccgtccaggctgctatgttgccctgggcttcagtgatcctcctgcctcagcctcctgaagagctggcattacaggcatgtaccactgtgtgggcccttattttttatttatttatttatttttgagacggagtcttgctctgtcgcccaggctggagtgctgtggcgcgatcctggctcactgcaagctccgcctcccgggttcacgccattctcctgcctcagcctcctgagtagctgggactacaggcgcccgccaccacccccggctaattttttgtatttttagtagmgacggggtttcaccgtgttagccaggatggtcttgatctcctgacctcgtgattcgcccacctcggcctcccaaagtgctgggattacgggcgtgagccaccacgcctggcccgggcccttattttttaattgacacattgcagttgtatgtatttatggggcgcagttcgatgttttgagaccaccccttcttgaggcaggtctctccacacatcagcataagcctcaggccaattccatggcccctggtccgattcacccacagcccctcctccgccccagcttcccacgactgggtg

SEQ ID NO: 143372 - DNA, 601 bp, Human
gtgatctcggctgactgcaacccgtctcccaggttcaaccgattcttctgcctcagcctcccaattagctgggactacaggtgcgcaccatcacacccggctaatttttgtatttttagtagagacagggtttcaccatgttggccaggctggtctcgaactcctgacctcaaatgacccacccaccttggcctcccaaagtgctgggattacaagtgtgagccaccatgcctggccaatttttttatttttagtagagatggggtttcaccatgttgcccaggctggtcttgaactccaracctcaggtggtccgcccaccttggcctcccaaagtgctgggatgacaggcgtgagccaccgcactcggcctgtatttatttttctagagacagggtctcactgtgccgtccaggctgctatgttgccctgggcttcagtgatcctcctgcctcagcctcctgaagagctggcattacaggcatgtaccactgtgtgggcccttattttttatttatttatttatttttgagacggagtcttgctctgtcgcccaggctggagtgctgtggcgcgatcctggctcactgcaagctccgcc

SEQ ID NO: 143373 - DNA, 601 bp, Human
catctcgtctggacacggagccgggcctgggtctgtccccagctctgtcccccagcagtagccacacagggtggaggaatcaaatgctctttgtcaactgagatgctacccttggaagaaacattctggagcggccatgccctcttttttttttttttttttttttgagacagagtttcactcttgttgcccaggctggagtgcagtggtgtgatctcggctgactgcaacccgtctcccaggttcaaccgattcttctgcctcagcctcccaattagctgggactacaggtgcgcaccaycacacccggctaatttttgtatttttagtagagacagggtttcaccatgttggccaggctggtctcgaactcctgacctcaaatgacccacccaccttggcctcccaaagtgctgggattacaagtgtgagccaccatgcctggccaatttttttatttttagtagagatggggtttcaccatgttgcccaggctggtcttgaactccaaacctcaggtggtccgcccaccttggcctcccaaagtgctgggatgacaggcgtgagccaccgcactcggcctgtatttatttttctagag

SEQ ID NO: 143374 - DNA, 601 bp, Human
gtgacatcattccttctcatggattcagtgggatctaaataccccagcgacgtgatacccacactcatccatttaaaaactacacgaggccaggcgtggcggctcacgcctgtaatcccagcactttgagaggccaaggcaggcagatcacgagctcaggagatcgagaccatcctggctaacacggtgaaaccccgtctctactaaaaatacaaaaaattagccgggcgtggtggcgggcgcctgtagtcccagctacttgggaggctgaggcaggagaatagcgtgaacccgggaggcrgagcttgcagtgagccgagatcgcgccactgcactccagcctgggcgacagagcgagactccgtctcaaaaaaaaagaaaaaacatctaaacaatgttgaaaaagaacacagctatagggctaatattacccaatttcagggcttattatataaaactctcaaaattcaatattaagaaaacaggccaggcacggtggctcatgcctgtaatcccagcactttgggaggccgagggaggcggatcacgaggtcaggagatcgagaccatcctggctaacacggtgaaaccccgtctctac

SEQ ID NO: 143375 - DNA, 601 bp, Human
ccatcctaaaataaaagtgtgacatcattccttctcatggattcagtgggatctaaataccccagcgacgtgatacccacactcatccatttaaaaactacacgaggccaggcgtggcggctcacgcctgtaatcccagcactttgagaggccaaggcaggcagatcacgagctcaggagatcgagaccatcctggctaacacggtgaaaccccgtctctactaaaaatacaaaaaattagccgggcgtggtggcgggcgcctgtagtcccagctacttgggaggctgaggcaggagaatrgcgtgaacccgggaggcagagcttgcagtgagccgagatcgcgccactgcactccagcctgggcgacagagcgagactccgtctcaaaaaaaaagaaaaaacatctaaacaatgttgaaaaagaacacagctatagggctaatattacccaatttcagggcttattatataaaactctcaaaattcaatattaagaaaacaggccaggcacggtggctcatgcctgtaatcccagcactttgggaggccgagggaggcggatcacgaggtcaggagatcgagaccatcctggctaacacg

SEQ ID NO: 143376 - DNA, 601 bp, Human
ttccaaaatcatgtcaatattgccatcctaaaataaaagtgtgacatcattccttctcatggattcagtgggatctaaataccccagcgacgtgatacccacactcatccatttaaaaactacacgaggccaggcgtggcggctcacgcctgtaatcccagcactttgagaggccaaggcaggcagatcacgagctcaggagatcgagaccatcctggctaacacggtgaaaccccgtctctactaaaaatacaaaaaattagccgggcgtggtggcgggcgcctgtagtcccagctactygggaggctgaggcaggagaatagcgtgaacccgggaggcagagcttgcagtgagccgagatcgcgccactgcactccagcctgggcgacagagcgagactccgtctcaaaaaaaaagaaaaaacatctaaacaatgttgaaaaagaacacagctatagggctaatattacccaatttcagggcttattatataaaactctcaaaattcaatattaagaaaacaggccaggcacggtggctcatgcctgtaatcccagcactttgggaggccgagggaggcggatcacgaggtcaggagat

SEQ ID NO: 143377 - DNA, 601 bp, Human
ccatccacgtggaggtgttgaagagtcaggagcccgcgcacaggaggctgcctgggtttgaatcctggcaagttttaaactcactaagcctcagttattccatctgcaacagaacctgcctccctgggattgctgggaagattcagggagaaaacttgggtcaagccattggctcccaaataagcaaatcctccacaggggaagtccccaggctcgggctggagcccagggaggtgcggaccccaggggaggtcagaggcaaccctcacacaggactgttccacgttctgtttctgtaackcgggggccttcgcgcccgtctgcctgtgcacctgcgaactaattctgagcaactgtgcgctccctggcactttctgaagtcaaaatctgaacatttccaagtttaaatagttgcaaagagtatgatttccaaaatcatgtcaatattgccatcctaaaataaaagtgtgacatcattccttctcatggattcagtgggatctaaataccccagcgacgtgatacccacactcatccatttaaaaactacacgaggccaggcgtggcggctcacgcctgtaatcccagcactttgagaggc

SEQ ID NO: 143378 - DNA, 601 bp, Human
gggcaccgacgccaggactgggagacccgaggcagcacctacttcgtcaccacgctgatcttcacaccgaagacgccggtctgctttttggacggggtcctcttcaggctcatatctcggctggtgaatttcatggaaaattccactttgatctggttggggggtgaggcaggtaaagattccccagggtgtgagtgcccgaggaatgcccccaaaacacaggggtcccctccccaagactgcaaatgagggctagctcacacccaggtctccctcaacacaacacctgcaggacagcagygggcagggtgtgggcaggaggggagagggggctgggctgcggggaggtcgaggcggcacagcggccccaggagcagccacagggccgggctgcccacctgctgcacagacgttccacctcccggctcacgccactgatcattcccatccccggctcaccccgttcatctcaatcacgtccgtgtgccagttcttggtctccacggtttgtgggtccagctgcagagagagaatgtgggtgagagaggtgccagctcggaggccaagccagagatctccccgtgggtcagcactgctcaga

SEQ ID NO: 143379 - DNA, 601 bp, Human
gggctctcaccctgccattctgagcattctatggtcaatatttgaggttactactggttacgggacccaaatatttctcaaaacagaaaaacatgagtgcaagaacttggaaagcaaactctcactccccacagacagcccgatggaggccagcacccacgaggagggactgaggaggtggggttggggccactccccgttaccttttcacgaggagggactgaggaggtggggttggggcccctccccgttaccttttcatgaggagggactgaggaggtggggttggggccgctccccrttaccttttcaagtgttccagcaggaagaggaaggtgatgaggttggggtcgggcagggagcggagcaggtgcatcatgcagttttccttggcagcagggtctgacagggctgtgggagagaagggccagtgtggcgtttggctcctggggctccccgccagggcccctgtggtcgtgaggctgtgggcccctgcgggagagagcccaggcttccaggcctttggggagcagaccccacaggggagggcctggtgtctgggtgggctgtcagcagctgcttcctccaggaggccccacca

SEQ ID NO: 143380 - DNA, 601 bp, Human
tgtccattccccactgctgtccaccccccactgctgtccaccccccactgctgtccaccccccactgcatctagaaatggctacattcgttgaatgaaccaccagtaggttgggacccactgattataaaacctgcctgtagtcctgggctctcaccctgccattctgagcattctatggtcaatatttgaggttactactggttacgggacccaaatatttctcaaaacagaaaaacatgagtgcaagaacttggaaagcaaactctcactccccacagacagcccgatggaggccagcrcccacgaggagggactgaggaggtggggttggggccactccccgttaccttttcacgaggagggactgaggaggtggggttggggcccctccccgttaccttttcatgaggagggactgaggaggtggggttggggccgctccccgttaccttttcaagtgttccagcaggaagaggaaggtgatgaggttggggtcgggcagggagcggagcaggtgcatcatgcagttttccttggcagcagggtctgacagggctgtgggagagaagggccagtgtggcgtttggctcctggggctc

SEQ ID NO: 143381 - DNA, 601 bp, Human
ccatgaggacaagggcccagcatctccccacccctgggcttgctttctgagactgaggccctcctgagaatgcagccagcatctctgggccctggtctaggctcacatgtttgttttggcctgggaggggcagaagtgtctgcagtcctgcctccctggtgacaccccatagcccatcaacccagcttcccacgagggaagaggtgtggggactctgagctgttctctctcctcctaaggggctggtctcaccctccgccagccacgggcccaggcggtgccagggtacctgtgccatgaygtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggc

SEQ ID NO: 143382 - DNA, 601 bp, Human
gcttccacccatgaggacaagggcccagcatctccccacccctgggcttgctttctgagactgaggccctcctgagaatgcagccagcatctctgggccctggtctaggctcacatgtttgttttggcctgggaggggcagaagtgtctgcagtcctgcctccctggtgacaccccatagcccatcaacccagcttcccacgagggaagaggtgtggggactctgagctgttctctctcctcctaaggggctggtctcaccctccgccagccacgggcccaggcggtgccagggtacctgygccatgatgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgg

SEQ ID NO: 143383 - DNA, 601 bp, Human
cccttggaagcaacctcagagcttccacccatgaggacaagggcccagcatctccccacccctgggcttgctttctgagactgaggccctcctgagaatgcagccagcatctctgggccctggtctaggctcacatgtttgttttggcctgggaggggcagaagtgtctgcagtcctgcctccctggtgacaccccatagcccatcaacccagcttcccacgagggaagaggtgtggggactctgagctgttctctctcctcctaaggggctggtctcaccctccgccagccacgggcccrggcggtgccagggtacctgtgccatgatgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccg

SEQ ID NO: 143384 - DNA, 601 bp, Human
tgtacaaggtggcacaaaagacgtacgcattccagttcttggaagctggcttccctcgagtctggagtgctgggtttgggagttttctattgcagtctttcaagtctgagttggaccccaggctggaggggctggttccaccacccgcccgcagccaccctgcctcgggctacacgtcggtggagaagtacagtgtgttccgcttgagttctgcgaaggaaatgggggggtgctgcaggtagtagaggaggacctggacctgtggggagacaggaaggcggaggctgggctccctgtcctwggcctcgtccttgctgactccagcctgtgttgcccctcccactccctagactggctccggccaccgccccttcctggggagcccaggtgtgtttgcctttctgcagccgtggaaggtgctacggggcagagggtcgggggcctagggccacttccccaacctggccataagcttctgctctgtcctgaggcggccacagtccggcccctgctctgggtcttgcaggaatcccagggaagcctcccgcccttggaagcaacctcagagcttccacccatgaggacaagggcccagcatctc

SEQ ID NO: 143385 - DNA, 601 bp, Human
gtagaagaaacagtcagagatgcctcactgataggcaggaggccgaacaggtaaaccccagaagtggagattcccaaacggaaaattccagaaatgggcgctccagctctgtgctaagctggggacgagtgtgagtgtgtctgcttgtccaacatttgcacaggcagcaaggcaaagcaggtgtgctcccaaaggcggagtctgaggaggggccggcagcggcaaacggcagcatcaaacagaccactgctgccgcggcaacccagggcctcttcagagctttcaaggcgatggagcgaaraccaagggtgcacatgcatgcaggcaggctgggaaggaagagcgggtggaggaagactgaggggaggctgccaggagaccgccatctgggagcagggccaagagaagctggcagcagttacacagcgcaaaataaaaggccttgggctggactcaggcggaaagaaagtgctggaggaaatgaaagaacaaagcgggctgtctgtgtgcccacgccgggccggtcactaccttttctgcctgacaagtgtacataaaacaattcccgaacagcacggagcatcagacacaactagaggta

SEQ ID NO: 143386 - DNA, 601 bp, Human
aatagaacagcagggaagggaactgaaaagcagtagaagaaacagtcagagatgcctcactgataggcaggaggccgaacaggtaaaccccagaagtggagattcccaaacggaaaattccagaaatgggcgctccagctctgtgctaagctggggacgagtgtgagtgtgtctgcttgtccaacatttgcacaggcagcaaggcaaagcaggtgtgctcccaaaggcggagtctgaggaggggccggcagcggcaaacggcagcatcaaacagaccactgctgccgcggcaacccagggyctcttcagagctttcaaggcgatggagcgaagaccaagggtgcacatgcatgcaggcaggctgggaaggaagagcgggtggaggaagactgaggggaggctgccaggagaccgccatctgggagcagggccaagagaagctggcagcagttacacagcgcaaaataaaaggccttgggctggactcaggcggaaagaaagtgctggaggaaatgaaagaacaaagcgggctgtctgtgtgcccacgccgggccggtcactaccttttctgcctgacaagtgtacataaaacaattcccga

SEQ ID NO: 143387 - DNA, 601 bp, Human
ggccacatcagtcaccctccaggaagcctggcccctcttgaaaagcccccacaacttgctcctaagagctgagctgcctccccgcgacccgggacacccagcgtggcatgtgcattcctcccccgttcagcctgtggtgtttcctcagcagcctgaccgcctcctcccccattctctcctgaccctctggctatctcgatagcaggtcacctgtgagtctttacactcaaaggaaatagaacagcagggaagggaactgaaaagcagtagaagaaacagtcagagatgcctcactgatagrcaggaggccgaacaggtaaaccccagaagtggagattcccaaacggaaaattccagaaatgggcgctccagctctgtgctaagctggggacgagtgtgagtgtgtctgcttgtccaacatttgcacaggcagcaaggcaaagcaggtgtgctcccaaaggcggagtctgaggaggggccggcagcggcaaacggcagcatcaaacagaccactgctgccgcggcaacccagggcctcttcagagctttcaaggcgatggagcgaagaccaagggtgcacatgcatgcaggcaggctggga

SEQ ID NO: 143388 - DNA, 601 bp, Human
cagcctacctgcctggacacctgcttcggccacatcagtcaccctccaggaagcctggcccctcttgaaaagcccccacaacttgctcctaagagctgagctgcctccccgcgacccgggacacccagcgtggcatgtgcattcctcccccgttcagcctgtggtgtttcctcagcagcctgaccgcctcctcccccattctctcctgaccctctggctatctcgatagcaggtcacctgtgagtctttacactcaaaggaaatagaacagcagggaagggaactgaaaagcagtagaagraacagtcagagatgcctcactgataggcaggaggccgaacaggtaaaccccagaagtggagattcccaaacggaaaattccagaaatgggcgctccagctctgtgctaagctggggacgagtgtgagtgtgtctgcttgtccaacatttgcacaggcagcaaggcaaagcaggtgtgctcccaaaggcggagtctgaggaggggccggcagcggcaaacggcagcatcaaacagaccactgctgccgcggcaacccagggcctcttcagagctttcaaggcgatggagcgaagaccaagg

SEQ ID NO: 143389 - DNA, 601 bp, Human; identical to SEQ ID NO: 143218

SEQ ID NO: 143390 - DNA, 601 bp, Human; identical to SEQ ID NO: 143219

SEQ ID NO: 143391 - DNA, 601 bp, Human; identical to SEQ ID NO: 143220

SEQ ID NO: 143392 - DNA, 601 bp, Human; identical to SEQ ID NO: 143221

SEQ ID NO: 143393 - DNA, 601 bp, Human; identical to SEQ ID NO: 143222

SEQ ID NO: 143394 - DNA, 601 bp, Human; identical to SEQ ID NO: 143223

SEQ ID NO: 143395 - DNA, 601 bp, Human; identical to SEQ ID NO: 143224

SEQ ID NO: 143396 - DNA, 601 bp, Human; identical to SEQ ID NO: 143225

SEQ ID NO: 143397 - DNA, 601 bp, Human; identical to SEQ ID NO: 143226

SEQ ID NO: 143398 - DNA, 601 bp, Human; identical to SEQ ID NO: 143227

SEQ ID NO: 143399 - DNA, 601 bp, Human; identical to SEQ ID NO: 143228

SEQ ID NO: 143400 - DNA, 601 bp, Human; identical to SEQ ID NO: 143229

SEQ ID NO: 143401 - DNA, 601 bp, Human; identical to SEQ ID NO: 143230

SEQ ID NO: 143402 - DNA, 601 bp, Human; identical to SEQ ID NO: 143231

SEQ ID NO: 143403 - DNA, 601 bp, Human; identical to SEQ ID NO: 143232

SEQ ID NO: 143404 - DNA, 601 bp, Human; identical to SEQ ID NO: 143233

SEQ ID NO: 143405 - DNA, 601 bp, Human; identical to SEQ ID NO: 143234

SEQ ID NO: 143406 - DNA, 601 bp, Human; identical to SEQ ID NO: 143235

SEQ ID NO: 143407 - DNA, 601 bp, Human; identical to SEQ ID NO: 143236

SEQ ID NO: 143408 - DNA, 601 bp, Human; identical to SEQ ID NO: 143237

SEQ ID NO: 143409 - DNA, 601 bp, Human; identical to SEQ ID NO: 143238

SEQ ID NO: 143410 - DNA, 601 bp, Human; identical to SEQ ID NO: 143239

SEQ ID NO: 143411 - DNA, 601 bp, Human; identical to SEQ ID NO: 143240

SEQ ID NO: 143412 - DNA, 601 bp, Human; identical to SEQ ID NO: 143241

SEQ ID NO: 143413 - DNA, 601 bp, Human; identical to SEQ ID NO: 143242

SEQ ID NO: 143414 - DNA, 601 bp, Human; identical to SEQ ID NO: 143243

SEQ ID NO: 143415 - DNA, 601 bp, Human; identical to SEQ ID NO: 143244

SEQ ID NO: 143416 - DNA, 601 bp, Human; identical to SEQ ID NO: 143245

SEQ ID NO: 143417 - DNA, 601 bp, Human; identical to SEQ ID NO: 143246

SEQ ID NO: 143418 - DNA, 601 bp, Human; identical to SEQ ID NO: 143247

SEQ ID NO: 143419 - DNA, 601 bp, Human; identical to SEQ ID NO: 143248

SEQ ID NO: 143420 - DNA, 601 bp, Human; identical to SEQ ID NO: 143249

SEQ ID NO: 143421 - DNA, 601 bp, Human; identical to SEQ ID NO: 143250

SEQ ID NO: 143422 - DNA, 601 bp, Human; identical to SEQ ID NO: 143251

SEQ ID NO: 143423 - DNA, 601 bp, Human; identical to SEQ ID NO: 143252

SEQ ID NO: 143424 - DNA, 601 bp, Human; identical to SEQ ID NO: 143253

SEQ ID NO: 143425 - DNA, 601 bp, Human; identical to SEQ ID NO: 143254

SEQ ID NO: 143426 - DNA, 601 bp, Human; identical to SEQ ID NO: 143255

SEQ ID NO: 143427 - DNA, 601 bp, Human; identical to SEQ ID NO: 143256

SEQ ID NO: 143428 - DNA, 601 bp, Human; identical to SEQ ID NO: 143257

SEQ ID NO: 143429 - DNA, 601 bp, Human; identical to SEQ ID NO: 143258

SEQ ID NO: 143430 - DNA, 601 bp, Human; identical to SEQ ID NO: 143259

SEQ ID NO: 143431 - DNA, 601 bp, Human; identical to SEQ ID NO: 143260

SEQ ID NO: 143432 - DNA, 601 bp, Human; identical to SEQ ID NO: 143261

SEQ ID NO: 143433 - DNA, 601 bp, Human; identical to SEQ ID NO: 143262

SEQ ID NO: 143434 - DNA, 601 bp, Human; identical to SEQ ID NO: 143263

SEQ ID NO: 143435 - DNA, 601 bp, Human; identical to SEQ ID NO: 143264

SEQ ID NO: 143436 - DNA, 601 bp, Human; identical to SEQ ID NO: 143265

SEQ ID NO: 143437 - DNA, 601 bp, Human; identical to SEQ ID NO: 143266

SEQ ID NO: 143438 - DNA, 601 bp, Human; identical to SEQ ID NO: 143267

SEQ ID NO: 143439 - DNA, 601 bp, Human; identical to SEQ ID NO: 143268

SEQ ID NO: 143440 - DNA, 601 bp, Human; identical to SEQ ID NO: 143269

SEQ ID NO: 143441 - DNA, 601 bp, Human; identical to SEQ ID NO: 143270

SEQ ID NO: 143442 - DNA, 601 bp, Human; identical to SEQ ID NO: 143271

SEQ ID NO: 143443 - DNA, 601 bp, Human; identical to SEQ ID NO: 143272

SEQ ID NO: 143444 - DNA, 601 bp, Human; identical to SEQ ID NO: 143273

SEQ ID NO: 143445 - DNA, 601 bp, Human; identical to SEQ ID NO: 143274

SEQ ID NO: 143446 - DNA, 601 bp, Human; identical to SEQ ID NO: 143275

SEQ ID NO: 143447 - DNA, 601 bp, Human; identical to SEQ ID NO: 143276

SEQ ID NO: 143448 - DNA, 601 bp, Human; identical to SEQ ID NO: 143277

SEQ ID NO: 143449 - DNA, 601 bp, Human; identical to SEQ ID NO: 143278

SEQ ID NO: 143450 - DNA, 601 bp, Human; identical to SEQ ID NO: 143279

SEQ ID NO: 143451 - DNA, 601 bp, Human; identical to SEQ ID NO: 143280

SEQ ID NO: 143452 - DNA, 601 bp, Human; identical to SEQ ID NO: 143281

SEQ ID NO: 143453 - DNA, 601 bp, Human; identical to SEQ ID NO: 143282

SEQ ID NO: 143454 - DNA, 601 bp, Human; identical to SEQ ID NO: 143283

SEQ ID NO: 143455 - DNA, 601 bp, Human; identical to SEQ ID NO: 143284

SEQ ID NO: 143456 - DNA, 601 bp, Human; identical to SEQ ID NO: 143285

SEQ ID NO: 143457 - DNA, 601 bp, Human; identical to SEQ ID NO: 143286

SEQ ID NO: 143458 - DNA, 601 bp, Human; identical to SEQ ID NO: 143287

SEQ ID NO: 143459 - DNA, 601 bp, Human; identical to SEQ ID NO: 143288

SEQ ID NO: 143460 - DNA, 601 bp, Human; identical to SEQ ID NO: 143289

SEQ ID NO: 143461 - DNA, 601 bp, Human; identical to SEQ ID NO: 143290

SEQ ID NO: 143462 - DNA, 601 bp, Human; identical to SEQ ID NO: 143291

SEQ ID NO: 143463 - DNA, 601 bp, Human; identical to SEQ ID NO: 143292

SEQ ID NO: 143464 - DNA, 601 bp, Human; identical to SEQ ID NO: 143293

SEQ ID NO: 143465 - DNA, 601 bp, Human; identical to SEQ ID NO: 143294

SEQ ID NO: 143466 - DNA, 601 bp, Human; identical to SEQ ID NO: 143295

SEQ ID NO: 143467 - DNA, 601 bp, Human; identical to SEQ ID NO: 143296

SEQ ID NO: 143468 - DNA, 601 bp, Human; identical to SEQ ID NO: 143297

SEQ ID NO: 143469 - DNA, 601 bp, Human; identical to SEQ ID NO: 143298

SEQ ID NO: 143470 - DNA, 601 bp, Human; identical to SEQ ID NO: 143299

SEQ ID NO: 143471 - DNA, 601 bp, Human; identical to SEQ ID NO: 143300

SEQ ID NO: 143472 - DNA, 601 bp, Human; identical to SEQ ID NO: 143301

SEQ ID NO: 143473 - DNA, 601 bp, Human; identical to SEQ ID NO: 143302

SEQ ID NO: 143474 - DNA, 601 bp, Human; identical to SEQ ID NO: 143303

SEQ ID NO: 143475 - DNA, 601 bp, Human; identical to SEQ ID NO: 143304

SEQ ID NO: 143476 - DNA, 601 bp, Human; identical to SEQ ID NO: 143305

SEQ ID NO: 143477 - DNA, 601 bp, Human; identical to SEQ ID NO: 143306

SEQ ID NO: 143478 - DNA, 601 bp, Human; identical to SEQ ID NO: 143307

SEQ ID NO: 143479 - DNA, 601 bp, Human; identical to SEQ ID NO: 143308

SEQ ID NO: 143480 - DNA, 601 bp, Human; identical to SEQ ID NO: 143309

SEQ ID NO: 143481 - DNA, 601 bp, Human; identical to SEQ ID NO: 143310

SEQ ID NO: 143482 - DNA, 601 bp, Human; identical to SEQ ID NO: 143311

SEQ ID NO: 143483 - DNA, 601 bp, Human; identical to SEQ ID NO: 143312

SEQ ID NO: 143484 - DNA, 601 bp, Human; identical to SEQ ID NO: 143313

SEQ ID NO: 143485 - DNA, 601 bp, Human; identical to SEQ ID NO: 143314

SEQ ID NO: 143486 - DNA, 601 bp, Human; identical to SEQ ID NO: 143315

SEQ ID NO: 143487 - DNA, 601 bp, Human; identical to SEQ ID NO: 143316

SEQ ID NO: 143488 - DNA, 601 bp, Human; identical to SEQ ID NO: 143317

SEQ ID NO: 143489 - DNA, 601 bp, Human; identical to SEQ ID NO: 143318

SEQ ID NO: 143490 - DNA, 601 bp, Human; identical to SEQ ID NO: 143319

SEQ ID NO: 143491 - DNA, 601 bp, Human; identical to SEQ ID NO: 143320

SEQ ID NO: 143492 - DNA, 601 bp, Human; identical to SEQ ID NO: 143321

SEQ ID NO: 143493 - DNA, 601 bp, Human; identical to SEQ ID NO: 143322

SEQ ID NO: 143494 - DNA, 601 bp, Human; identical to SEQ ID NO: 143323

SEQ ID NO: 143495 - DNA, 601 bp, Human; identical to SEQ ID NO: 143324

SEQ ID NO: 143496 - DNA, 601 bp, Human; identical to SEQ ID NO: 143325

SEQ ID NO: 143497 - DNA, 601 bp, Human; identical to SEQ ID NO: 143326

SEQ ID NO: 143498 - DNA, 601 bp, Human; identical to SEQ ID NO: 143327

SEQ ID NO: 143499 - DNA, 601 bp, Human; identical to SEQ ID NO: 143328

SEQ ID NO: 143500 - DNA, 601 bp, Human; identical to SEQ ID NO: 143329

SEQ ID NO: 143501 - DNA, 601 bp, Human; identical to SEQ ID NO: 143330

SEQ ID NO: 143502 - DNA, 601 bp, Human; identical to SEQ ID NO: 143331

SEQ ID NO: 143503 - DNA, 601 bp, Human; identical to SEQ ID NO: 143332

SEQ ID NO: 143504 - DNA, 601 bp, Human; identical to SEQ ID NO: 143333

SEQ ID NO: 143505 - DNA, 601 bp, Human; identical to SEQ ID NO: 143334

SEQ ID NO: 143506 - DNA, 601 bp, Human; identical to SEQ ID NO: 143335

SEQ ID NO: 143507 - DNA, 601 bp, Human; identical to SEQ ID NO: 143336

SEQ ID NO: 143508 - DNA, 601 bp, Human; identical to SEQ ID NO: 143337

SEQ ID NO: 143509 - DNA, 601 bp, Human; identical to SEQ ID NO: 143338

SEQ ID NO: 143510 - DNA, 601 bp, Human; identical to SEQ ID NO: 143339

SEQ ID NO: 143511 - DNA, 601 bp, Human; identical to SEQ ID NO: 143340

SEQ ID NO: 143512 - DNA, 601 bp, Human; identical to SEQ ID NO: 143341

SEQ ID NO: 143513 - DNA, 601 bp, Human; identical to SEQ ID NO: 143342

SEQ ID NO: 143514 - DNA, 601 bp, Human; identical to SEQ ID NO: 143343

SEQ ID NO: 143515 - DNA, 601 bp, Human; identical to SEQ ID NO: 143344

SEQ ID NO: 143516 - DNA, 601 bp, Human; identical to SEQ ID NO: 143345

SEQ ID NO: 143517 - DNA, 601 bp, Human; identical to SEQ ID NO: 143346

SEQ ID NO: 143518 - DNA, 601 bp, Human; identical to SEQ ID NO: 143347

SEQ ID NO: 143519 - DNA, 601 bp, Human; identical to SEQ ID NO: 143348

SEQ ID NO: 143520 - DNA, 601 bp, Human; identical to SEQ ID NO: 143349

SEQ ID NO: 143521 - DNA, 601 bp, Human; identical to SEQ ID NO: 143350

SEQ ID NO: 143522 - DNA, 601 bp, Human; identical to SEQ ID NO: 143351

SEQ ID NO: 143523 - DNA, 601 bp, Human; identical to SEQ ID NO: 143352

SEQ ID NO: 143524 - DNA, 367 bp, Human; identical to SEQ ID NO: 143353

SEQ ID NO: 143525 - DNA, 601 bp, Human; identical to SEQ ID NO: 143354

SEQ ID NO: 143526 - DNA, 601 bp, Human; identical to SEQ ID NO: 143355

SEQ ID NO: 143527 - DNA, 601 bp, Human; identical to SEQ ID NO: 143356

SEQ ID NO: 143528 - DNA, 601 bp, Human; identical to SEQ ID NO: 143357

SEQ ID NO: 143529 - DNA, 601 bp, Human; identical to SEQ ID NO: 143358

SEQ ID NO: 143530 - DNA, 601 bp, Human; identical to SEQ ID NO: 143359

SEQ ID NO: 143531 - DNA, 601 bp, Human; identical to SEQ ID NO: 143360

SEQ ID NO: 143532 - DNA, 601 bp, Human; identical to SEQ ID NO: 143361

SEQ ID NO: 143533 - DNA, 601 bp, Human; identical to SEQ ID NO: 143362

SEQ ID NO: 143534 - DNA, 601 bp, Human; identical to SEQ ID NO: 143363

SEQ ID NO: 143535 - DNA, 601 bp, Human; identical to SEQ ID NO: 143364

SEQ ID NO: 143536 - DNA, 601 bp, Human; identical to SEQ ID NO: 143365

SEQ ID NO: 143537 - DNA, 601 bp, Human; identical to SEQ ID NO: 143366

SEQ ID NO: 143538 - DNA, 601 bp, Human; identical to SEQ ID NO: 143367

SEQ ID NO: 143539 - DNA, 601 bp, Human; identical to SEQ ID NO: 143368

SEQ ID NO: 143540 - DNA, 601 bp, Human; identical to SEQ ID NO: 143369

SEQ ID NO: 143541 - DNA, 601 bp, Human; identical to SEQ ID NO: 143370

SEQ ID NO: 143542 - DNA, 601 bp, Human; identical to SEQ ID NO: 143371

SEQ ID NO: 143543 - DNA, 601 bp, Human; identical to SEQ ID NO: 143372

SEQ ID NO: 143544 - DNA, 601 bp, Human; identical to SEQ ID NO: 143373

SEQ ID NO: 143545 - DNA, 601 bp, Human; identical to SEQ ID NO: 143374

SEQ ID NO: 143546 - DNA, 601 bp, Human; identical to SEQ ID NO: 143375

SEQ ID NO: 143547 - DNA, 601 bp, Human; identical to SEQ ID NO: 143376

SEQ ID NO: 143548 - DNA, 601 bp, Human; identical to SEQ ID NO: 143377

SEQ ID NO: 143549 - DNA, 601 bp, Human; identical to SEQ ID NO: 143378

SEQ ID NO: 143550 - DNA, 601 bp, Human; identical to SEQ ID NO: 143379

SEQ ID NO: 143551 - DNA, 601 bp, Human; identical to SEQ ID NO: 143380

SEQ ID NO: 143552 - DNA, 601 bp, Human; identical to SEQ ID NO: 143381

SEQ ID NO: 143553 - DNA, 601 bp, Human; identical to SEQ ID NO: 143382

SEQ ID NO: 143554 - DNA, 601 bp, Human; identical to SEQ ID NO: 143383

SEQ ID NO: 143555 - DNA, 601 bp, Human; identical to SEQ ID NO: 143384

SEQ ID NO: 143556 - DNA, 601 bp, Human; identical to SEQ ID NO: 143385

SEQ ID NO: 143557 - DNA, 601 bp, Human; identical to SEQ ID NO: 143386

SEQ ID NO: 143558 - DNA, 601 bp, Human; identical to SEQ ID NO: 143387

SEQ ID NO: 143559 - DNA, 601 bp, Human; identical to SEQ ID NO: 143388

SEQ ID NO: 143560 - DNA, 601 bp, Human
ggccagggggtgggtcggggggaggtctggccatgtggtagggtgataggactgaggggccccagggagctggctgcagggcagtttgtttctcctgatggagaatgctccctggtgggtggggcgatgggctggggactggtttgttcatggggacagagatcagaagtgggcttgagaagaacagggccagaaggcctggactctggccccagcctagcccctaatttgtgcagggtggctttgggcaagtcactaagtcactgtctagactgggccctcagccttcctgtctacccamtggagggtctttctgtccacctgggaacagcctgataggactgaagcacagcccttagtttccagatgagaattctggactggaggccctgacattacaattgccaacactgactctggtgtttggcaaaatttggtgtatgtgggaaacacgtgcctctggttgaggtccttaacttcagaatttccctctagatcaatgctttttaaagcactaactccaacaccaccatcttctgtaggagctttcgagctttccagcttttccagcatacgctcctgatctgttactcaggcatgc

SEQ ID NO: 143561 - DNA, 601 bp, Human
gggttgctgggaaaattaaatagcttaacacaggtaaaacatttagggcagtacctggcgctcagcacctggtgggtgctgcataaatggtaatcatgttatgtggagggggagggggagaagagcagtaaccagggtagtactggctgtgccgccattcgaagtaccaccagaccccatttctcaccttcctgacactgctgcaaagtggacaggcacttggcttacagtgggaggctgaggctagtgagagatattttgtccccagccacacagcagcaagtgatgatggcactggacraggcctcaccattgtctagtcagtcctctgtggctctgccctagactctgagacctcatgctgatgaggggccgggggtgggggactggcagagggacagtggcaggttcccccatgacttctatcttcctggctttggcctggctcttctgggagggtcccctgatgctgatgggccactattcctaggcaatgccaggcaagaggtgaagaggggaggggtgaagtgttcaggctgtggagtcagacagacccaggttcaagtctcagctctgcctcctcctccctggctctgagacc

SEQ ID NO: 143562 - DNA, 601 bp, Human
attctttgacagtgaggagaccacaggctgcagcccttccctggccctgcttccttcctcccctgcaggggactggcctgggcagaggtggtccacagagggtgccagccctgtttcactaagctcccacgtaggtcagagatcagacgagaggaccccaaaaatgccttccagctccaagacgataataccttcaagcctcctatttttaaaaagcctaaagaattatttcggatgtgtaaacaagtaagtatagagtttaaatccactgtttccacgtggttccatggggcctgccagsctgggctggatcggagagggcagccatggatggccagggagccccagaagtccgaccaggaccaatagggaaaccagctgagccctgctcacagacgagcgctcagtcactagtgggctctggacccagaccacagttctctgctacttgttagttcagagagcccaggccagttatcaaactgccctgggcatctgtttcctcagctgcacactgaggggaaatatcagtaactagctcttagaatcgttgccaagattaaatgagataaagtatgttaaaacactttggcccggcacc

SEQ ID NO: 143563 - DNA, 601 bp, Human
gtcgtgttacggagtttgaatgttatcccgagggcactagggagccatggaaagctataaggcaagagaggtgcactcaggcctgtgtaatgatttattttatacactgctgaccatctcaggtctcctttgaacttcagaatcctgacttaatcattatgatcctgattttagaaattaaggaatagaggcttagagaggggcagggattggcctagtgacacagcagaagccctgccctctcacctgctcactgcctgcaatgaagcctctgtcctgagtgccagccgtctggcttctycccagtgagctggggacctgactgtcccaggaggagatccctgtggccggagagtctgccaggccgattccacttcatggccaggctgttcccagcagtggggtttccctccctcacctgtgtgccgcgggtgggggctttggggatggaaggggctggtggcagggaatgttgggtctctgagcctctgtttacttaggcaggagttcctgggtgcccagactgcatcgtgtctgtcttctctccgcagatgagcggggctgacaccgttggggatgatgacgaagcctcccggaagag

SEQ ID NO: 143564 - DNA, 601 bp, Human
ctacggtaataataagaataaccattaatgtttattatgccccgcactgttctgtgtgtatttcatatgtaatctaatttaatctttaccactacttttattttccgttctgttctttcttattgaccttacccttattttacacgtgaataaactactgtgcaaagaggctaagttacatggcaagaaagtggtggggttgggacctggagacctggcctgctggcttctgtttgaggaaacagcttgacagagaaaaaaccttgataggaaacttgagagatcaggaaacgtgtcaaarggcacacagctggtaactgctggagctgggatttgaacccaagactagctccagagcctgggatcagcctcccctgcaggactctccttcattagacagggtgtctaggtcttagtgccattttaagcttgaatagcatcagaagtataaatgcttcaaacttaccaaacccccttgaaagtttaattattaaatttcttttgcacgtctttagttatgtgatttttgaataatcaatttttcattttcatttttggtttgagtcagcattttccatctttgggaggatggagaccaaaa

SEQ ID NO: 143565 - DNA, 601 bp, Human
tggttcttggctaaaaatagccagtcctgccaccccggtggtgggcagtgcctcccctggctccctccttccctttcagcaatttgctgacttgtcccccaccccccaccactgtctccctgctgccatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctstctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggagtaggtgccctcgacccagctctcccgactctggatttgcaggggcgagtgggcc

SEQ ID NO: 143566 - DNA, 601 bp, Human
cagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctrcagaccaatctgcggccccaaggtggggggccctacagagatgctccgaggcatgtacctcactcgcaacgggaacctgcagaggcgacacacgatgaaggagtaggtgccctcgacccagctctcccgactctggatttgcaggggcgagtgggccaggctgagcaaccctcttttctgcttctgtccccagagccaaggacatgaagaacaagctggggatcttcagacggcggaatgagtcccctggagcccctcccgcgggcaaggcagacaaaatgatgaagtcattcaagtagg

SEQ ID NO: 143567 - DNA, 601 bp, Human
ctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgsggccccaaggtggggggccctacagagatgctccgaggcatgtacctcactcgcaacgggaacctgcagaggcgacacacgatgaaggagtaggtgccctcgacccagctctcccgactctggatttgcaggggcgagtgggccaggctgagcaaccctcttttctgcttctgtccccagagccaaggacatgaagaacaagctggggatcttcagacggcggaatgagtcccctggagcccctcccgcgggcaaggcagacaaaatgatgaagtcattcaagtaggtcctccctggcac

SEQ ID NO: 143568 - DNA, 601 bp, Human
agggcagtaaacaaaggccgcctggcccagcttcccccaaggttcccaagcctctcagtgccctcactgtgtttcctccctcacccctcaggcccacctcagaggaagccctcaagtggggcgagtccttggagaagctgctggttcacaaatgtaagttgggcctgcctgcccactccctgtgccctctctccctctccccttcgcccccatccagaccctgtgtagctggtgctagagaggccgccttccctctcctcggccgtcagggtgtccttgctgttgcggaggggctgagccyaagctgaggcccttggtctggccttggagccagcttctgccagcccctccccgtccatgtgagctggcactgcctgccggaggcccgtgggacctgtgtgctcagatccatattcccagaataagaataaacatttctacgtactgagggctttcacggcgccaaatgtgcctgccatctcatgggcagggtcccatcggctcctcccagggctccgggagacagaatcgatagtccccatttcacagatgaagacactgaggcatagagagggggagaccccactgagaccctgaaaga

SEQ ID NO: 143569 - DNA, 601 bp, Human
aaaaatacaaaaatgggccgggcgtggtgtcgcgcgcctgtagtcccagctactcgggaagctgaggaagaagaatcgcttgaacccaggaggcggaggttgaagtgaaccgaggtcacgccactgcacttcagcctggagacagagcgagaccccgtctcggggggaaaaaaaaaaccgtcactatcatttcacttttctaagggacctgaatcaagatgagggagtctacgtgtgattctgcaagaactccattaaggctgcatacataatgaccactaaatcattaacaggagtccayagcaattgggctaaaacatctgggagcatttatgctggtaaaagagctcacttgggggctaaaaaaaaagtcaaattaggcccaactctaaacggatctttaacaaatcaagagagtaatgttagtttatccttcctgaaacgccagcagtacgatattaaaatccacttagaagtaaaaacttcaagacggaaatatgccaccaacactggcgtcagtaatccattttagaaagcctgcgcggagaccaccattagcaccgctgaggatatttaatgaaagccgttggctgcaaacaga

SEQ ID NO: 143570 - DNA, 601 bp, Human
gcctgtgagttcacattaattttcacagttgtattcagcattttgctcctaaacaaagtgaaaacattaaagattcaattaaaatctctttaaaaagaattttaactaatctttctatctagctacaatacttggtaaaacataccttctatggcatttctaaaattatgattgaaatttgaatacatttccgaaacagacttatatttactttataacagtaagatacagaaaattctgcaagtattaattacactaaggaacgcagagtgttttcctaaaaacagctgaaaagagctayagtgtgtctagtagaatctcagtctacaatcttaataactctagttctatgacctcaagaattggcttcacctcgaaatactttctcacctgaaaaaaggaataacaccatcttttcctccctcaatgtggctgctcaaataaaatgaaataatatatgtagcacagtacctgccacgaagggttcaataaattattagtttactttcttcagtcaacacaaaagacacattcacaagattcagatttaaggaaatctatttccacaagtcctcaccagcacaaaatgctatcgctagtt

SEQ ID NO: 143571 - DNA, 601 bp, Human
tctgtcaatacaaaactcctcacctccatctgctaccttccgctgccactttattactgcacctctaggtggttaggctttcctaatttattcctccactccggttcttcttccttcattcccactagtgttgatttgtcttcccaaaaaatttcaaaattgaccatgtatgactgcctctttcaaaaaaaggccgggcacggtgactaaagcctgtaatcacagcactttgggaggctgaagtcagggggaccacctgaggtcaggagtttgagaccatcttggccaacatggcaaaacsctgtctctacaaaaatacaaaaaaaaaattagctgagcatggtggcacgcgcctgtagtcccagctactcaggaggctgaggcaggagaatcgcttgaacctaggaggcagaggttgcagtgagccgaggtcatgccactgcactacagcctaggcaacaagagtgagactccacctcaaaaaaaaaaataaacaaataaataaataaataagatgcttcctccactgaacaaatatacagtcaaacttagttttgcctttggagtcctctacagtttgccacctaagtacatttccaag

SEQ ID NO: 143572 - DNA, 601 bp, Human
agagttcaataaacattttctgagtaaataactctacatgaaaggttttaaaggctaaaaagtgatacaagcaaaagcagacaacagatatttcttgttactgaaataatctattttctcaactctgatctttggtggagcactacttaggaaccagaaaaactggggttgcttcatcacttcctagctgtgtgtcattgggcaagttaactaacctctgtgtgcctcaagtttcttcacttgtggggtaaaaaacaaacagaagttaccacttttgctgtacagttatatggcttagcaytaatgtatgtaaaatacaaaacaagagtgctgaaaaagtggtagttctactagtctgctataatcacaataaccttaacaagacaggaggacattgtaccatcaggaatgtgatcacaatgaaattttagttgaaaccatccccctcttttttcttttattcattcagctttcccaagttgaacatccccgctttaaaaaaaaaaaaaaagaggccaggcacagtggttcacactgtaatcctagcactttgggaggctgaagcagggggatcacctgaggtcaggagtttgagaccagc

SEQ ID NO: 143573 - DNA, 601 bp, Human
ctcaggcaggtggcctttcctagagggagcagagacagcgcagctactggatgagctcctaggcacctttcagtgtgggagcctcaagaagtgaaagaaaaaaagcaaatctaaaggggagcaaaatagcatctcaggattaggcaagagggtgggtggagtaggccggaggcaaggagctctagatgtttgttggggaatgaggtgtttttcaattaataggtatataaattgtgagcaaggtgaggaataaattacatacagttttggggaaaagtcaacttgaatttacacaaatcarattatgggaatggtgtaatggttatagctaactaccaggaatacatcattagggatgctattaatataaaaattaattttgttttgacttatccttttactctaaactctgctcagaaacactagattcttctgttactcatgtaagctgctgtccttgcatctttgagctccaaaagtgtagaggagacttcttgattaaaaaagttaagtaaacaatgagcaagcaaaattaagaatctcaatatctctgtctccaggtctagagtttttatatatgatatatgttattgctgttcct

SEQ ID NO: 143574 - DNA, 601 bp, Human
agagcccagtcctttcatgttatagcaggggaaatagaaacacataaattttgttcagctgcctatagctttctcctcctgtggttctgctcagtttccagaaagcctgggtaacgtctgaatcctcctggaatctctcttcttccttctggtacggtgtgggccatttcaaagctcaggcaggtggcctttcctagagggagcagagacagcgcagctactggatgagctcctaggcacctttcagtgtgggagcctcaagaagtgaaagaaaaaaagcaaatctaaaggggagcaaaayagcatctcaggattaggcaagagggtgggtggagtaggccggaggcaaggagctctagatgtttgttggggaatgaggtgtttttcaattaataggtatataaattgtgagcaaggtgaggaataaattacatacagttttggggaaaagtcaacttgaatttacacaaatcaaattatgggaatggtgtaatggttatagctaactaccaggaatacatcattagggatgctattaatataaaaattaattttgttttgacttatccttttactctaaactctgctcagaaacactaga

SEQ ID NO: 143575 - DNA, 601 bp, Human
ccttgcagtaatatgacaaaggcccccagatcttaatcataaacttttcattttctataatgcagtctctacaaagtagtgcctaaaacattccagcactctaccctaccttttacccagctagctctaagtcttccttcaggtcccagcttaaacaccacttcctcccggaaacccttcatgactactcagaatatcttatatcatccagtggcactccacacctcaccatactcagtaaatgttattactgccctgttggactgtaaacaccaaagagtaagaacaacttttgttcackactttgttcctactgcctagcacataatccggtacgtgtttaataatattaaatgaatgaaaatcaagaaactggtagaggtaactagaaggaatgggaagaaatcaatactgcttcctgataaaaattaagttgctagatgacagatcctttggagataaagaaaaaacaaaaacaaaaaacaaagttactttaactctaatcctttctagcctcttcttcaggtctgtctgcaatggcataatcattttatactttagggctaatccattcaggaacccaggctgtaggaagtacgtt

SEQ ID NO: 143576 - DNA, 601 bp, Human
ctcataaggtgaaatgcttgttttttttgggaaagtttcttgctctgttgccaggcgggaatgcggtgacacgacgacggctcactgtagccttgaccactcaggttcaagcgatcctcagccccaggctcccaagtagctgggactataggcacgtaccaccacacctggctaattttttttttttttaatttttagtacctttagtacagaaaaggcctcactatgttgcctagattggtctcaaactcctaagctcaaggaatcctcatgcctcggtctcccaaagtcctgggattayaggcatgagtcctgcacccagcctagctgaaaatacatttaatacacctaacttaccaaacatcacagcttagcttagcctaccttaaacatgttcagagcacttacattagcctacagttgggcaaaatcatctaacgcaaagcccattttataataaaagtgttgagtaactcatatgatgtatgaaatactatactgaaaatgaaaaacagaacagttgcgtgggtactcggaagtaaggtttctactgcatgtgtatcacttccataccattgtaaagtcatctgaccaccaagcc

SEQ ID NO: 143577 - DNA, 601 bp, Human
aataaaaaataaaaatagtcattttcctcaagggtttaattgtgggcttttaatgttgaagtaaatcaatttactagtttttaacctcaagtttttccctatttcattatatctcaataatgattatccagagatttctgaggtaaattacattaaagacagcgctagtaactgggaaacaatccacacatgaatcttaatatattgcatatatgctaatttcatgtaatgttcctgagggcggtgacaatattagagctgtacgagaccctagagaccatcccaatcccttaactccacmgatgagaaacacaaaaacttgcagaagcagagtgacgagcacatgcccatgtgacatgtcatcagaagcagggaccaagactcaggtctcttgccttccaggccagtcctcttttggtaggctaaaagctgcctttcacagcttcccacaaatttcaacacatcctcactcaagtacgtttctgaaagggactcaccgacaactctttagagaaaaggaactatatctcaaaccataggaaaagttctatatctagcttatcaaacttttagtctctgaagcatgtgagagtaagtttgc

SEQ ID NO: 143578 - DNA, 601 bp, Human
tgaagaggtttgatgtgacagcagtgaaagcaatttaaaaagtacaaagtgctgtataaaagaagacgttttcataattattctgttttcacatgctatctttattccaatgatctcaaagtacctacccaagcacagttctaactctagtatatgtaagcaaacgtgcaagtctgtcaccttccacacaaagagtccccccacccccgccaaacacaccactccctctccctctccttctccctctccctctctccttctcccgctttccacggtctccctctgttgccgaagctggacygtaccgccgtgatctccgctcgctgcaaccttcctgcctgtttctcctgcctcagcctgccgagtgcctgggattgcaggcgcgcgccgccacgcctgactggtttttgtattttttggagacggggtttcgccatgttggatcggctggtctccagctcctaaccgcgagtgatctgcctgcctcggcttcccgaggtgccgggattgcagacggagtctcgctcactcagtgctcaatgttgcccaggctggagtgcagtggcgtgatcttggctcgctacaacctccacctcccagc

SEQ ID NO: 143579 - DNA, 601 bp, Human
attttaaaaatctttcatgggagattggagagatgctggtaaaaaaaaatacagcattaaaataaaatctttcactataaaactagctagtacggccaggagtggtgactcacacctgtaatcccagcactttgggaggctgaggcggggtggatcacctgaggtgaggagttcaagaccagcctggccaacatcgtgaaaccccgtctctactaaaaatacaaaaattagccaggccgtggtggttcatgcctgtaattccagctacttgggaggcggagacagaattgcttgaacccgrgaggcggaggttgcagtgagctgagatcgcaccactgcactccagcccgggcgacagagcaagactcggtctcaaaaaaataaaataattaattttttaaaatgctagtgtaacttcagaaaacttagaatatgattttaaataaaaataataactaaactaaaaaagcaaatcctgtataagcccttagttacttgggaagtcatttaaaagttaagcccatatcatctcaaattccaaaacttattgcaaggtaaataatcaaaagggtggtgctggcacaaagaaaaaagatataga

SEQ ID NO: 143580 - DNA, 601 bp, Human
caacatagtgagaccctgtctcttgaaaataaaataaaaaatttaaaaatttttaaaaactgaaaaaatgaagcaatataaatgcccaacaaatgggggcaacagttatataaataacctgtttttaataaaatttaacattatgttgatgttacatgttggagtcagatacatagaaaaaggaaaaaataggacacaatagtatgggataatcattacgtaggtttaaaaaaacaaaagaatccttgctgagaacaggtctggcagagcaaagtgagctttagcctgaagtgggagggaraaagtaaaacagtgggcagggctctggaggaaagaaggatggtagtgcttcaaagggaagcagaagttttggctttgttttatttttaggacagaagagtgatcagcccctaggaatttggatgagatcatccagagagtgtgtatgggacacagagggcccaagaactaagaacaaagagtcaaagacttgggaaaaccagaggtgtctcagcaaagtagtagatgtaactttttaaaaaggaaatggcttataacatcaagtgctccagaaaaaatcaaaatcttttgattttccagg

SEQ ID NO: 143581 - DNA, 601 bp, Human
gcatgcagaaatgtaagcaaacaagagtgcaaaagaatacctgcacactcagagtcaagtagggctggttctacattgttaaaggacacagaggctggctgctacacgctgggggagggaagaaatggagagtgactgctcatgggaatggggttgctttttgaggtaataaaatgttctgggattagacagtggtggtggttccaaaactttgtgaatatatactgaaaacaactaaattatattctttttaaaggtgaagtttttcttttctctggtaggtaaattatgtccaaaaaaaaaaaaaaaaaaagcatggtcccttcaaacaaaaatcccttttctcagatcattatttcaggagctaacacttaaaagagagatcccttcactctggaaagctgacagtaatcaaaacagggcatgaaagcctggagcagggagacagatcagctctgggagttgggatggggaagaagagagaaatggcatcttgatgatactttttatcctggccaacccacttcaccagcgaaaagctgataagcactcaagacagaggccctacactaaagaatttaaaagtatacaggccgggtgt

SEQ ID NO: 143582 - DNA, 601 bp, Human
gatggcttgcccctaccagtttcagaccagcctgggcaacacagaaagcagtctccatcaacacgaaacattttaaaaattagctgggtgtgatggctcctgcctgtagtcccagctactcgagaggctgaactgagggaggaagggacccagaatcacccagctatgatcactgcagtctagcctgtgcaacagagaccctgtctctaaaactaactaaagaaataaatagcaggaagaagtaaaaagaaagatctaggatgcaggaagagaatgagaagacacatacccggacccagcyaaaaaaataaaaatcaacaatgattactctcgaaattgatgttatgaaatcaatgccaaacagtaatacataaataaataaatcctgatacaaaatagtaaaatgcatgcagaaatgtaagcaaacaagagtgcaaaagaatacctgcacactcagagtcaagtagggctggttctacattgttaaaggacacagaggctggctgctacacgctgggggagggaagaaatggagagtgactgctcatgggaatggggttgctttttgaggtaataaaatgttctgggattagacagtggt

SEQ ID NO: 143583 - DNA, 601 bp, Human
attggggaaaaaaatcagaattaggcaaaaaccacaataataagtttcagacaagacccatggatggatgctaaaatcagtgagtaaaattgatcacagtctcagagtacatcccctaagatgtctacgataatagtcgtaaaaggataaacaggcagataccaccaccttaaccaaatgattaacatctaagacacagcaacatcatgaattctcagatatgatgtgctgagaagagcacaacacacttaaaaatgcataatctcattctaatcatgaaaaaactcagacaagtccaggygcagcggctcacgcctgtaatcccagtgctttgggaggctgaggcggatggatcacctgaggtcaggagaccagcctggccaacatgatgaaaccccatctctattaaaaatacaaaaaactagctgggcacgatggcaagcgcctgtaatcccagttatttgggaggctgaggcaggagaatcgcttgaacctgggagacagaggttgcagtgagccaagattgcgccactgcactccagcatgggcaacaggggcaaaactccatctcaagcaaacaaacaaacaaacaaaaacaaaa

SEQ ID NO: 143584 - DNA, 601 bp, Human
acacttaaaagcatattgacagccaggctgtaatcccactttgggaggccgaggtgggtggatcatttgaggtcaggagtttgagaacagcctggccaacatggtgaaactcctcttttactaaataaattcctttactaaataaaaaaattagccaggcgtggtggcgggcatctgtaatcctagctactcaggaggctgaggttcaagaatcacttgaacccgggaggtggaggttccagtgagccaagattgcaccattgcactccagcctgggcaacaagagcgaaactccatttcaaaaaaaaaaaaaaaaaatacaaaagcatattgaaagggcctagaggccaacctgaaagagcaaactaaagttgaaattgtaacaatctgagcaacaaaataaatcacagtattagactaaatccatagaataaaacacatatccatgcatccacacctatataaataagtgaataaatgagagggaggatagttcttccttacagatgcactccaattaatacagaaggaatgaaggaaattggggaaaaaaatcagaattaggcaaaaaccacaataataagtttcagacaagacccat

SEQ ID NO: 143585 - DNA, 601 bp, Human
cagtgacacccagtagcaatgagcacacttaaaagcatattgacagccaggctgtaatcccactttgggaggccgaggtgggtggatcatttgaggtcaggagtttgagaacagcctggccaacatggtgaaactcctcttttactaaataaattcctttactaaataaaaaaattagccaggcgtggtggcgggcatctgtaatcctagctactcaggaggctgaggttcaagaatcacttgaacccgggaggtggaggttccagtgagccaagattgcaccattgcactccagcctggrcaacaagagcgaaactccatttcaaaaaaaaaaaaaaaaaatacaaaagcatattgaaagggcctagaggccaacctgaaagagcaaactaaagttgaaattgtaacaatctgagcaacaaaataaatcacagtattagactaaatccatagaataaaacacatatccatgcatccacacctatataaataagtgaataaatgagagggaggatagttcttccttacagatgcactccaattaatacagaaggaatgaaggaaattggggaaaaaaatcagaattaggcaaaaaccacaa

SEQ ID NO: 143586 - DNA, 601 bp, Human
agatgtctaagaacagacacagaatgaattccaagatatattgttaagtgaaaaaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagyaatgtagcgcataccaaaaaaattaaagaacccagaatacaaacagtaacaagtgaatctaactgcgttacaaaggaataacataaccacactgaagggcatgaggaagaaactttgaaaacctattttgactggatattgtaaagctaaaggcataaagaactgtaacacaaatgctgctacctagtaagtaaatttgtttctcacaaagatgtgagttagcaattctgacactaattcatgtagacagtggtactgactgaaaaagtaagtttaaaaaaatgaaggataatgacagcc

SEQ ID NO: 143587 - DNA, 601 bp, Human
agagacactggctgaattacttagtatctctgagtaatcacttgcttggctagaaaatgaggaaagcccggggattgtgaagattagaaaaagcagatgcagcctaaaagatagtaggccttcaaaaaaaagttgtatggtcttttaaaaattattttacttggccgggcgcggtggctcacgcctgtaataccagcactttaggaggccgaggcaggaggatcacgaggtcaggagatcgagaccatcctggctgacacggtgaagccccgtctctactaaaaatacaaaaaattagctgggcatggtggcaggcgcctgtggtcccagctatttgggaggctgaggcaggagaatggcatgaacccgggaggtggaggttgcagtgagctgagattacgctactgaactccagcctgggcgacagagcgagactccgtctcaaaaaaaaaaaaaattattttacttattattattcattacatttatcatgtgataccctaaaaaggaagtaacatcagaaaagaacactgggcttcaaatcaggaggtctgagttttagtcctaactcagctatgccctacatatatgctttgataat

SEQ ID NO: 143588 - DNA, 601 bp, Human
cagaaaaggtttcaattctggtcctatccctcactagctgagagacactggctgaattacttagtatctctgagtaatcacttgcttggctagaaaatgaggaaagcccggggattgtgaagattagaaaaagcagatgcagcctaaaagatagtaggccttcaaaaaaaagttgtatggtcttttaaaaattattttacttggccgggcgcggtggctcacgcctgtaataccagcactttaggaggccgaggcaggaggatcacgaggtcaggagatcgagaccatcctggctgacacsgtgaagccccgtctctactaaaaatacaaaaaattagctgggcatggtggcaggcgcctgtggtcccagctatttgggaggctgaggcaggagaatggcatgaacccgggaggtggaggttgcagtgagctgagattacgctactgaactccagcctgggcgacagagcgagactccgtctcaaaaaaaaaaaaaattattttacttattattattcattacatttatcatgtgataccctaaaaaggaagtaacatcagaaaagaacactgggcttcaaatcaggaggtctgagtttta

SEQ ID NO: 143589 - DNA, 601 bp, Human
caggctgttagccagaagtactttggtcttgacaactcagcttccacctgtcctagccccaagatacatgaaataccagtgggccccaggctcaagtgacccaaggatatttcaaatgtctttttcttttctttttttttttttttaaagacagaatcttgctctgtcatccaggttggagtgcactggcgtgatctcggctcactgcaatctccccatcccgggttcaagtgattctcctgcctcagcctcccaagtagctgggacaacctacaggcacaagccaccaagcccagctaatttttttttttttttttttaagtagagacagagtttcaccatgttggccaggctggtctcaaactccagacctcatgtgatccacccacctcggcctcccaaagtgctgggattacaggcatgagccactgtgcccagcctattctttattcttaatactttattcatttgaaagctttccttttgtggtaaggtacagttcctttcactgatgtttatttgttctatcatttctcataacccccccacccccacatcctgaaggtacttgctttcttgtagaaatacttaggtctgtccg

SEQ ID NO: 143590 - DNA, 601 bp, Human
acagagaacatactttgccttttatcacattaaagcacttctgaaacccaaggaggagctgggttaacttcaaatactaagggaaggattaaaagaagatgaggcccgcaaaagccttatcctgaaggatgagtaggcttctgacagaaaagcaagaccgcaaagaaaagaaagaggaaacaggaggcgaggtaagagactgagacatctgtggtcactggccactaaccctcacccagacatgcccatgcccatgagagaaggttattggggtcggggaaaatgctcctcaggtgcccgrgaattccctgcatctggaaaagtgtaggtctgtacccagcaggtgcacttgaggtggtggtcaaaggggcagctgcttgctggcgtgtattgcacctacattgtgcaggcaggaggccacacacgtgctcaagctcacaacacatggatagtgctgtggctgggaagggaagagcactatgctgaaggtctgctctgccggaactactgacatagaactctaaggagcctgagtattttctatttgaacccaaccttccaggtcattaagaaggtatattaggcctggtgtgggcatggt

SEQ ID NO: 143591 - DNA, 601 bp, Human
aaaacttatccaactttatactttaaatgtgtgcaatattttgtatatcaattacttcttagtaaagcagttaaaaaaaaaaaaaaagaaccagggttctttggccacatgattcattccagtgctggggcaattgggatacagattctagaagtgtaccgatcaataaacgtagaagtccatgaaattctgaagtagattatttaacagatgttttatgattgcttagggaaggaaagggaaccagcatgagtcaattatgaacaagtcatgctaaactagctttatttcctgttttgayagggttaccacaacaacacgaaatgaagacagagttctggtgaattcaagccacgcttgtcaagaacttcccatttgtgaggcttcatgttaggactggtggcaaaaacaaataatgatcctgctcttaagaaacttgcaattttgtgagagaaggagacaggaacagagaacatactttgccttttatcacattaaagcacttctgaaacccaaggaggagctgggttaacttcaaatactaagggaaggattaaaagaagatgaggcccgcaaaagccttatcctgaaggatgagtag

SEQ ID NO: 143592 - DNA, 601 bp, Human
cacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggttgagtgagctgagatcacgccactgtactccagctctgggcgacactgcaagactccatctcagggggaaaaaaagcgagagagacagagagagagagagagagagagagagagagagagagagagagagagagagagagagakaatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaattaagtattaatttttttttgatggagtctcgctctgttgcccaggttggagtgcagtggtgccatctgggctcactgcaacctccgcctcctgggttcaagcgattctcctgcctcagcctcctgagtagctgggactactggt

SEQ ID NO: 143593 - DNA, 601 bp, Human
gcactctgggaagctgaggtgggtggatcacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggttgagtgagctgagatcacgccactgtactccagctctgggcgacactgcaagactccatctcagggggaaaaaaagcgagagagacagagagagagagagagagagagagagagasagagagagagagagagagagagagagagaatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaattaagtattaatttttttttgatggagtctcgctctgttgcccaggttggagtgcagtggtgccatctgggctcactgcaacctccgcctcctgggttcaagcgattctcctgcctc

SEQ ID NO: 143594 - DNA, 601 bp, Human
tgattaagatggcaaattgtatgctttttaccaaaacatataattaaccaaaacaattttactttgtaaagagatgaagtctcggctgggcacggtggctcacgcctgtaatcccagcactctgggaagctgaggtgggtggatcacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggytgagtgagctgagatcacgccactgtactccagctctgggcgacactgcaagactccatctcagggggaaaaaaagcgagagagacagagagagagagagagagagagagagagagagagagagagagagagagagagagagagaatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaat

SEQ ID NO: 143595 - DNA, 601 bp, Human
ttcatgatgatgaccatcttttcttatgtcttcttttgaaacgtgtattcaacgttatgccttttttttttttgagacggagtctcgctatgtcgccaggctggggtgcagtggctcaatctcggcttactgcaacgtctgcctcctgggtttatgcaattctcctgcctcagtctcctgagtagctggaattacaggatctcctgacctggtgacccgcctgccttggcctcccaaagtgctggaattacaggcgtgagccacccaccacgaccagccaggactgccactatttaaaaaaaaacaaacaaacaaacagaaaaccgtaagtgtgatgtggataaatttgaaccttcatactctattgttgagtgtgcaaaatggtgtaaccacttggaaattcctcaaaaaattaaaaatagaattcccatatggtccagcaatcccacttctgagcatatatccaaaacaattcaaagtagaatctctaagagctactggcaggttcattgtgcagcattacgcacaatacccaagatgtggaagcaaccgaaatgtccactatggatgaatggataaagaaaatgtagcatatacatag

SEQ ID NO: 143596 - DNA, 601 bp, Human
caggcagtaagacaacatttcttgtttccttggggtaagtgctagaatagaaagcagtaaaataactttattctaaaatttatgcttctagggccgggtgcagtggctcacacctgcaatcccagcactttgggaagctggggcggctggatcacttgaggacaggagttttgagaccagcctggacaacatggtgaaaccccgcctctactaaaaatacaaaaaaattagccaggcatggtggcaagtgcctacaatcccagctacttgggaggctgaggcacaagaatcacttgaaccygggagatgcacgtggcagtgagccaagattgtaccactgcactccagcctgggcgacagagtgagactccgtctctaaattaaataaagtttatgcttctataatatttatcagtctactaatcctaagaattattgatacatttgtctgattctatgacaagataatgctctggaggggaactttgtcttactaggatccaattatcctacaacaccattaacatatagtacacaggtggccccaaatgctttgaaatgaagtatattttcttaagtaaaataaccactactcaaatct

SEQ ID NO: 143597 - DNA, 601 bp, Human
gctcaaaggggctgattttcttgatagctactcgaactttgttgacattatcataagcagagcttaaaaaagagagagagagatggcattaaaaacagccctcagaatatttgaagaaggcaagttggtaaagtattatatttttaacactgtgtaaacacctgtttcatacccgtgaaggcagcatgtatattatccacaaaaaggcctcaagctagggaggatggatgcaactgacatgagagagcacacagtgactctcaaaactaacagagaacctagccctgttaactgggtgaawgtcttgcctttataaacccagaaatacacaaacaagcattctcccattgtcttaaacagcaactgcattctggtgagagtaatcacttctgtctctgaaacaccttcttactgttgtatcaaattcctctgacacagaagaaacattcaaataacctacaactgtacatctttatccctaacaaaaatggacccaagagaacaccttgattacttctattaactttgtttctctcacttgcaaaacaacatgaccatttcttcccccaagaaactgaatcaagatgtttgggtagtttta

SEQ ID NO: 143598 - DNA, 601 bp, Human
ccaccacgcccggctgatttttgtatttttagtagagatggggtttcgccatgttggccaggctggtcttgaactcctgacctcaggtgataaggcccaccttggcctcccaaggtgctaggattacaggcgtgagccaccgcaactggccaccaatttgttatagtagttagttatcacggcctggtgctgtggcccacatacataatcccagcactttgggaggccaagaaaggaggactgcttgagcccaggagttccagaccggcctgggcaacatactaagactctgtctttaagaaaaaaaaaaaaaaaggtatctctggggagaaaggagcaatgggataaggaagaagaagaggactaccacactttattagcatttttgccataaacatgtttttgggtatttctggtgtaatttaaaatatgaataatgacaaatataactatgcttcagtgaaagggtttttcaatatatatcaccttaatagtaaataacctggctgaccttgagatcacaggtggtgttgagcagcaggttggaaggcttgaggtcacggtgcagaacgttagctgaatggatatattttaaccctct

SEQ ID NO: 143599 - DNA, 601 bp, Human
tagcattatcagtacttcactcctttctcttctactgtgtggatccaccacactgtatttattcatcatcagctggacatttggattgtttctacttactggctatagtgaacaataccactatgaagatttgtgttcaagtttttgtatagatgcatgttttcattttcactaaggagtggaatcctcaccaacacttattatctgactttttaactacagccatcctagttagcatgaagttgtttcaatgtaattttgatttgcatttttctactgactaatgatgtcaagcatctaycattccatgtgcttattgccatctgtatatcttctttagagaaatgtctattcagatcctttgtccattttttaaactaggctatttatcttttcattattgagttataagagttcttcatatattctagttttaagtcccttatcagatgtatgatttgcaaataccttctctcattctgtggcttgccttttcacttttttgatggtttgctttgtagcacaagtttctaatcttgatggaatccacttacttttttcttttgttgcttgtgcttttggtgtcatgtctaagaagctt

SEQ ID NO: 143600 - DNA, 601 bp, Human
tcttcctgctgcctcccagtcccagccagcgctagcccacctctctcctttgcatttgtacaccatctttttctccatctcagttacagaacatctcattataatcacctactgtctaccagatttctgatctatcagttttcagatttcaagggcagaccctcatctctcttgtctggcgtatctcaaagggcttctcataggagtgtctgttgaactgaaatccaataaatgattattgctatacatatatatgtacttaagcagctttattaacctataattcacacaccatacaatytgctcatttaaagtgtataactcaatggttttagtattataatggtggaaattaaccattaccaccatccaatttgaaaatatttttataacctcaaaaagaaattccagtgagttagtattccttccttctttattctcccaactcctctagccctaggcaatcagtaatccactaattctaatttttgtctctatggatttgcctattctagacatttcacgtaaacagaatcatacaatatgtgtcttctgtggctgccttccttcacagacatgtttccaagattcatccatgttg

SEQ ID NO: 143601 - DNA, 601 bp, Human
accgtgacaaaacccaccgctttttacacacagttctagaaggttccccacgatctacttgcaaccaacctttttagcttagtgtcgatgactccctattactcatccaatgctgcagccacagggaggaagactcagtgctttcggtagtagtcccttccttcttattttatttctgtactctctgcctatgataccctatgtccaatagagccactggcctcccgcaagaaaagctacccaacctcgagggccggcacagataccaccttcttcctgctgcctcccagtcccagccagmgctagcccacctctctcctttgcatttgtacaccatctttttctccatctcagttacagaacatctcattataatcacctactgtctaccagatttctgatctatcagttttcagatttcaagggcagaccctcatctctcttgtctggcgtatctcaaagggcttctcataggagtgtctgttgaactgaaatccaataaatgattattgctatacatatatatgtacttaagcagctttattaacctataattcacacaccatacaatttgctcatttaaagtgtataactcaatggt

SEQ ID NO: 143602 - DNA, 601 bp, Human
gattctttgtgttaacttgggttttcaagacgatgcctaaattatgccacggccaacaactcgtgtgtgtgagtgtgagtaggtgaacagaatggccttaaagacaagtccataaactgggaagagacaacagagagagtagtctggttctatttgttttattcttaaagatgaacactttcaagcaaaaataagagccaattcttcccagaaatgttatatgcttaaaatattgattgagaatgtctctccaaaaacaaaagcaatctgccataacagggctatgatgataaccaaaagaaaaaaaaaacacgaggagacataaaaatattcactgcaaattttcaagacaatcattaagtgccaaagaagtagtacagccatcctaaacatagctttattcgttttgtgcccacctgactcttggttgcactgatccaggtaaaggagctggttccatcccatgtggaaaagacataaacctgtatcagaaggatcctaagaggggacagagtccaatccacacaatatctgatgaaggaagctgtcctttacatctcactggacattggccaccgtgttcacccaccgtgacaaaacc

SEQ ID NO: 143603 - DNA, 601 bp, Human
cggagcttgcagtgagctgagattgtgctactgcactctgcctgggcaacagagtgagactccatctcaaaaaaaaaaaaaaattagccaggtgtagcggtgcactctgtagtcccagcaactccggagactgaggtgaggagggtcacttgagcccaggaggttgagactggtaagccgtgatggtgccactgcactccagcctgggtgacagagtaacaccctgtctcaaaaaagacagcaccttgtctctggccagacaggcaaactctcaacgcagagggagacttacggcttactrcaatgcattcagaaagttctcttacttactggatttctttttatgcaaacttcatccttaccttggaattcaacataatttctggagccctgtaccaacgtgtggccacatattctgtcaggaaccctgtgtgatcatggtctggatctgcaacacgggccaggccaaagtcacagatctaagagagaaaaaaaacaggataacttcttagaaattctaacctttcatatcaaaacatcacaaaaataaaaaaggcaataggaataataatgctactaagtggcagatactttctgggca

SEQ ID NO: 143604 - DNA, 601 bp, Human
ttaaaaattagccagatgtggccaggcacagtggctcacgcctgtaatcccagcactttgggaggctgaggtgggcggatcataaggtcaggagatagagaccatcccggctaacacggtgaaaccccgtctctactaaaaaatacaaaaaattagccgggcatggtggcgggagcctgtagtcccatctacttgggaggccgaggcaggagaatggtgtgaacccaggaggcggagcttgcagtgagctgagattgtgctactgcactctgcctgggcaacagagtgagactccatctcaaaaaaaaaaaaaaattagccaggtgtagcggtgcactctgtagtcccagcaactccggagactgaggtgaggagggtcacttgagcccaggaggttgagactggtaagccgtgatggtgccactgcactccagcctgggtgacagagtaacaccctgtctcaaaaaagacagcaccttgtctctggccagacaggcaaactctcaacgcagagggagacttacggcttactgcaatgcattcagaaagttctcttacttactggatttctttttatgcaaacttcatccttaccttggaa

SEQ ID NO: 143605 - DNA, 601 bp, Human
ggataagaaatatgacaaggtgttaatagctggagaaccaaggacaggggcatatgggtattcactctactctcaatttttctatgggtttgataattttctacattaataaaaataaacaaaatgaagacaactgctagaagtaacattctcaggctacaggtatcgcaaataagaaaaaaatgaacactcaattttcactttggtgaccctgcaagtagaaggaaaagctggtcatcttgaagaacaccctctctggctacttctccctggagggtaatagagaagtggagacagtggsggcgtctaagtcagaacggagactgcaagaccaagccacaccaggacaaaggcacaccaacagctccctttacaactggcactgaacactggcatgccaatgctccttgtttagaatggctgtcacgtggccagtcagagaaagaacctgttgtgtgggattatttgtgatatagaattacagagaatcaacatggcattttcttctctgaaacatctgttacaccaaatccttctttataatggaatttatgttaatgagattttacttttataactaaactgaacaaatgtaggatat

SEQ ID NO: 143606 - DNA, 601 bp, Human
ttgaagtaaagacatactgaaacaaggtgaaggggtgtatctacaatttactctcaaatgactcagagtgcgtgggagtgcccacacacatgcacacaaagaatgataaagcaaatggggcaaaagataaaaaatcggtgagcctgaatctggggtaaagggtatttaggagttctatctggcggttctacaagagtgttccagagactcctatgggttccctctagaggatctgagaggtcacagtacatttattatactactatgacattttcatccttttcagtcacgagtgaaaagragatttttccagatgcaatatgatgagtgatgatgtgtacatgaaaatgtgacacttggaatatctgtgtaactcagtgaaccagtattttccaaatacgctaaaaaatcatgcatgagtatgagtgcaaggtagactaatggattttaacgaaatagtatcaagaattcactgatatgatttcagattccacactgcaattaacctttaagaaaccaccacttgtttaaactgggggtaggatcaaagaatagccacaagtggctgaaaagactactaaaatttccctcctttttccag

SEQ ID NO: 143607 - DNA, 601 bp, Human
tgcagtgagccgagatggtgccacggtaccccagcctgggtgacagaatgagaacccgtcctttttttttgagacggagtcttgctttgtcacccaggctggagtgcaatggcacgatctcagctcatgcaacctccacctcctgggttcaagcgattctcctgcctcagcctcctgagtagctgggatcacaggtgcctgccactatgtccagctaaattttttgtatttttagcagagacagggttttgccatgttggccaggctgatctcgaactcctgaccccatgtgattcacccrccttggcctcccagagtgctgggattacaggtgtgagccactgtggctggcctgcgaacctggtcttaaaacaagcaagcaaacaagcaaacaaacaaaactcatgacagtacaacatgtgaacctgtgcccaggtcggggggtggtttgggtggggtatagttcaaaggttattgggataatatctaaaatgtgaatataaactgtgcattagatactgaatcagtattaagtttcttgattttgaaaactgtactgtggtcatgttagagaatactcttaaggcagggtttttcaacc

SEQ ID NO: 143608 - DNA, 601 bp, Human
tttgcccaggctggtttcaaactcctgggctcaaatgatcctcctgcctcagcctcccaaagagctgggattacggcatgaggcaccatacctggctccagaagtgccttctaatacaacgaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccacgagcagtagcacgtgcctgtagtctcagmtacttgggaggctaaggtgggaggatggccttgagcccaggaggcggaggttgcagtgagccgagatggtgccacggtaccccagcctgggtgacagaatgagaacccgtcctttttttttgagacggagtcttgctttgtcacccaggctggagtgcaatggcacgatctcagctcatgcaacctccacctcctgggttcaagcgattctcctgcctcagcctcctgagtagctgggatcacaggtgcctgccactatgtccagctaaattttttgtatttttagcagagacagggttt

SEQ ID NO: 143609 - DNA, 601 bp, Human
gcaatggtgtaatcatgcctcactgcaaattcaacttccttgtctcaggtgatcctctcacctcagccaggtcctgagtagctggcactactgagtagctggcacacagtaggtgggccacaggcatacaccaccacacctggttgatttttaaattttttgtagagaaggggtcccactatttgcccaggctggtttcaaactcctgggctcaaatgatcctcctgcctcagcctcccaaagagctgggattacggcatgaggcaccatacctggctccagaagtgccttctaatacaaygaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccacgagcagtagcacgtgcctgtagtctcagctacttgggaggctaaggtgggaggatggccttgagcccaggaggcggaggttgcagtgagccgagatggtgccacggtaccccagcctgggtgacagaatgagaacccgtccttttttt

SEQ ID NO: 143610 - DNA, 601 bp, Human
ggagtttgagactagcctggccaacatggtgaaaccccatctctactaaaaatacaaaaaaattagccgggcatggtagtgggtgcccgtaatcccagctacgtgggaggctgaggcaggagaattgcttgaacccaggaggcagaggttgcagtgagccaagatcgtgccactgcactccagcctgggtgacagagcgagactctgtctcaaaacaacaacaaacccacaaagttgattaacttattaaattagaatttccaaagtatacatccgtccttttttgaaacaatttgagagrcagatttagaattgtcataaattggagctggaaaaagaaaaaaggtctaaaaaccttttctgggtttgggggagtgtgtgctagctccatcatattttaccaatctcttctaaaatattctcagctgggcatggtggctcacgtctgtaatcccagcactttgggatgccgagacgggcgaatcacctgatgtcagaagttcaagatcagcctggccaacatagtgaaaccctgtctctactaaaactacaaaaattagccgggcgtggtggtgggcacccatagttccagctacttggg

SEQ ID NO: 143611 - DNA, 601 bp, Human
tatgggtgtctaattgttccagcaccatttgctgaagagactgacacaaacaatgacatggatttttataaatctcaaatgcattatgctgaatgggagaatctagacataaaaaggctacatactacatgattccattaacatgacatgccggaaaaggcaaaactatagggatataaatcagatcaatgattgccagagcttggggttgcagagggatgactgactacaaacggcacaaggcaacttttggggatgatgggaatattccacatctcaattgcggtggttgttacatgayagtttatgtttgttaaaactcagaggcccacacaactaaaaagtgtgaattttattctgtgtaaattattcttcaataaacctgattttaaaaattatcaagtgacaagatgaaaaggtgtaatttgtttgcagggtcctagacttcctgagacctaaaaatgtgaccttaggctgaacgctgtggctcacgcctgtaatcccagttttgggaggccaaggtgggcagatcaaaaggtcaggagttcgagaccagcctggccagcatggtgaaaccctgtctctactaaaaatacaaaaa

SEQ ID NO: 143612 - DNA, 601 bp, Human
aagaattttaccttcttaaatatttctataatttctgaatttttaaaaaagttaacctttataataattatttttaaaaaataaattatagagaaaatatgcacatgtatgtagataaagatatggaaggacaagcaccctattcagattccctcctcaacttttaaggaaccctgtttttataaatgggcccacctagataatccacctacctagacaagacaatccaggataaccttcctatctttaaagtcagctgatgggcctattcggggcataccacactgcccgtggattagcyctgctctgtaaggagcagttaaaaaaaaaataaggtcagctgataaacaatcttgattgtatctgcaaccataattcctgtttgccaggtaacctaacatagttataggctctagaaattagaatacagccatgggggtgggtggggggtcattattcggcctatcatggttttataacagcatgaagttttaaaaactagctgcctaatatatttaacaggtacacgttaaatgggaataaagaataatacaattattaaacgaagctaacctaaaaaaaaaaaaggataaaaaaatca

SEQ ID NO: 143613 - DNA, 601 bp, Human
gcctgtaatcccaacactttgggaggccaaggtgggcagatcacaaggtcaggagatcgagaccatcctggctatcatggtgaaaccccgtctctactaaaaatacaaaaaattagccaggggtggtggcgagcgcctgtagtcccagctacttgggaggctgaggcaggagaacagtgtgaacccgggaggcggagcttgcagtgagccgagatcacgccactgtactccagcctgggcgacagagcgagactctgtctcaaaaaaaaaaaccacaaaaaacaaaaaaaacaaaaaaaamccacaaaacaccccaaaaccaaaatacattatataattacaaccacacagaagcttgcacacattagtgcaaaaaaagtgaaaggttactgtgggatcctggtgatcaatatcttactcccttaccattcctcccatacttcttaactgtctacaatgatgaaattcttctacctttatatgaaagattaaaagaaaatttctcccattttcaaaagaaattcatttctaaacaaccaagtatttctcaaccttcactcaggtcaatacataaaaccaattcaacatttaagtagacagt

SEQ ID NO: 143614 - DNA, 601 bp, Human
gtagagatggggtcttactatgttgtccaggcaggtctcaaattcctggcctcaagcgatcctcctgcgttgacctcccaatgggctaggatcacaggcatgagccacattaccaggcctaatgatgcagctttgttgcttatgcagctctttaaaaaagtgactcaggaaataacatttagtaacatttagataacatgcttaggtggtataatatacaagcaaatctaatcagtaacatgtattatgcatgtgacattctagctaaaaatatcctaccatcaaaatacattacaggccrggtgtggttgctcacacctgtaatcctaactcttcagaagcccagggtgagcagatagcttgagctcaagactttgggatcatcctgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctgggaggtggaggccgcagtgagcccagattgtgccactgtgctccagcctgggtgatag

SEQ ID NO: 143615 - DNA, 601 bp, Human
tcacctgaggtcaggagattgagaacggcctggccactgtgacgaaaccccatccctactaaaaatacaaaaaattagccaggcatggtggcatatgcctataatcccagctacttgggaggttgaggcaggagaatcgcttgaacctgggaggtggaggttgcagtgagacaagatcgcaccactgcactccagcttgggcaacaagagtgaaattctgtctcaaaaaaaagtaaaataaaaacaaaaaacaaaatgaaggccgggcactgtggctcacgcctgtaatccgagcacttcragaggctgaggcaggtgcatcacctgagatcaggagtttgagaccagcctgaccaacatggtaaaaccccatctctattaaaaatacaaaattagctgggcgtggtggcgcatgcctgtaatcccagctacttgggaggctgaggcaggagaatcacttgaactcgggaggcagaggttgcagtgagcccagatcacgccattgcactccagcctgctgggcgatagaagtgaaacttgaaagaaagaaaggaagaaagaaaggaggagaagggaggggagaaaaaagaaaatgaaaata

SEQ ID NO: 143616 - DNA, 601 bp, Human
cggtttaagggatacagcaatcaaaaatttccaacaaacatgaaaaaatttcaatctcactcttaattacagaaaaacaaattaaatgccactcccccatttggttggcagacctaaaagttcaatacccagaattgctggaacaaaagacatgtgacagaattgccagactgtcctctacagagactcaaccagtttacactccaccagctctctccgaaaacacccttttccccacagccttgaccacacagtagggtgtcaaactttgatgtctgctactctgttgaggagggcgttaaaaaaaaaaaagaattactgacttttcaatgtttgtatcttgtataatgagtaaacatgagtaccttttatatatttaagagctgtttcatcttccttttctgtgaactctcattaaaaattctagcttgtaagttttttaatctcttgagttccctgaggtcttccattcatttcctgacaaatctagactatcagttctgtaagaaagctctctctctcttttttttttaatgagtcctcagacttcccatctccaaacaggttcttaatccctcttattgctggtactatgtatgtc

SEQ ID NO: 143617 - DNA, 601 bp, Human
aagtgggggccaggagtggtggctcacgcctgtaatcccagcactttgggaggctgaggcaggcagatcacgaggtcaggagatcaagaccatcctggctaacacggtgaaaccccgtctctactaaaaaatacaaaaaattagctgggcatagcggtgggtgcctgtagtcccagctactccagaagctgaggcaggagaatggcgtgaacctgggaggtagagcttgcagtgagccgagatctcgccactgcactccagcctgggcgacagagtgagattccatctcaaaaaaaaaaamaaaaaacaaaaaaaaaaaaaacggggggcggggggggtccgggtgtggtagtggcaggaggatcccttgagtccaggagttcaagacaggactgggaaacatagcgagaccccatctctacaaaatttatttaaattagccaggcacggtgcttgcccgagcccaggagttcgaggctgcagtgagctgtgattgtgccactgcactccagccttccagcctgggcaacagagggagaaccctgtctcttcaggaaaaaaaaaagggggggggtgggggggagaaaatagaattccttat

SEQ ID NO: 143618 - DNA, 601 bp, Human
ctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgttctacaaaaactcaagattttcagcctcatcaaggccctcaacagcttctggaaagctttggtcagtcccctcctctactctcagatttcacccaacttgcacggcttgaatcatgaccttcttgctaactgaccctcattactctcagcatatcttcttgagggtgctacagagaaaactgaggcacccaagagtgatcttcgcggaattccctcctagccagattcacacacacccttactgacactgccaagaaagatatcctctctctactcaaagtcaattctccccaacttgtggcctggtccacaaccccttcccctcatgtggaccagtcgtttctgtctccactttccatttcaaatttctcacttccattcactgtttcaactcctcttgcatggtcaccaacaagcccctcattggaaaatcaacccacat

SEQ ID NO: 143619 - DNA, 601 bp, Human
aagacatgtattaaggatggatttaatatggtgagtactttttactggcactggttttgagcagtgggggtgtggcagtgcagagctcagtaacctctctagttccactgccttgacctgcctgtggtgctggggactctgctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgtkctacaaaaactcaagattttcagcctcatcaaggccctcaacagcttctggaaagctttggtcagtcccctcctctactctcagatttcacccaacttgcacggcttgaatcatgaccttcttgctaactgaccctcattactctcagcatatcttcttgagggtgctacagagaaaactgaggcacccaagagtgatcttcgcggaattccctcctagccagattcacacacacccttactgacactgccaagaaagatatcctctctctactcaaagtcaattctccccaacttgtgg

SEQ ID NO: 143620 - DNA, 601 bp, Human
agtgcttctcaaactttctgatctcagaactctttatactcatcaaaactgagggacgatttaaaaaccagttaattctgctcatagctcaaatagttacataagtgcttttccctgagaaaaccactgcattcagtatgcagcagaaatgctatacgtgtttgtcacacagacatcgtgaagacatgtattaaggatggatttaatatggtgagtactttttactggcactggttttgagcagtgggggtgtggcagtgcagagctcagtaacctctctagttccactgccttgacctgsctgtggtgctggggactctgctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgttctacaaaaactcaagattttcagcctcatcaaggccctcaacagcttctggaaagctttggtcagtcccctcctctactctcagatttcacccaacttgcacggcttgaatcatgacctt

SEQ ID NO: 143621 - DNA, 601 bp, Human
actacattttctctttctgtgttttttaaaacagagtttggattttgttctatggcccaggctggagtgcagtggcatgatcatagcttactgcagccttgaactcctgggctcaagcaatcctcctgcctcagcctctcgagtagctggtactacaggcacatgttaccacacccagctaatttttttaaattaatttttctgtagagatggggagtcactatgttgcccaggctggtcttgaactcctgggctcaagtgatcctcctgcctaagcctcccaaagtgctgagattacagstgtgagccactgtgcctggcccttgtctttttttttttgaaacgggagtctcactctgttgcccaggctggagtgcagtggcgctgtctcggctcactgcaacctccacctcctgggttcaagcgattctcctgcctcagcctcccgagtagctgggattacaggtgcctgccaccacgccaggctaattttttgtatttttagtagagacgggggtttcaccatgttggccagcgtgttctcaaactcctggcctcgtgatccacccgccttggcctcccaaagtgctgggattacagg

SEQ ID NO: 143622 - DNA, 601 bp, Human
aatggcgtgaacccgagaggcggagcttgcagtgagccgagattgcgccactgcactccagcctgggcgacagagcgagactccgtctcaaaaaaaaaaaaaaaaaaaaaaaaagattcctgtggtctataatataggtaataaatcccactttgcttcctgctcccaaccagccctccccacatagaactcacagacattttctcaaggactttcttgaaactagattaagtcatttggcttttcacccaattagatactgtctgtgctaagaaaagtccagaaggcctggaccacaatragattctaacagtattacttctaaaccactgggggcagaagggtcctactcaaacttgttcgtattaagtagacaggcactccaagccaactggatgttttgcagcttaagcatttctaaaacagatccattagttccttaaagttaaataaattctaggcccttaaacctccaggcataaatttcaaagaagacagctttttaaaaaaagatttgctacttgaaaagtagctagatctccagccttctgttactgcaagtgctatttctacattattcatagctacagaaggagaaaag

SEQ ID NO: 143623 - DNA, 601 bp, Human
agatatgggtgggccagagcctgttctacttcaatcctcttgtgtgggttgaatgtcaacattttgtccaataagtccagagctataaagagaaaggttttgcagtagtgagagcagaagtagtcacagaaatacttcaatttcctgtttaagtaacttacccacaaaacaactgagctaagcatgactacagagagagcagccagcacaaagggtgctgactatatctccaagcctcccgagactgtgaacatagggaccgaccatctgacaattgcagaccgcaaacaaaaacactggyactacttaatgaagcgtcttttctgacaatgatcatttcttttttttttttttttttttttttttgagacggagtctcgctctgtcgcccaggctggagtgcagtggtgcaatctcggctcactgcaagctccgcctcccgggttcatgccattctcctgcctcagcctcctgagtagctgggactacaggcgcccgccaccacacccggctaattttttgtatttttagtagagatggggtttcaccgtgttagccaggatggtctcgatttcctgacctcgtgatccgcctgcctcag

SEQ ID NO: 143624 - DNA, 601 bp, Human
gagaacatgacatgcagcatcttctacctgaatgccctgcctgctctgaagagctgccatatccactctggcctcatcacttcttacaacaggctctcgtgtccttgtctctagggaatagcacacccgacatggagtcgccaagccacagtggaaactgtccaagttgacttccctccccactctgtgtgctgtccctgtcagcaggctgcccacctcctctccaccccggccatcctcagggccagcacttcacttcaggtgtctcttcctgtcacaccatgacaatggcctccagtcycagacccatgccctctgtgctccatactggtgcagctgtcccctttatacatgcgtttaccccgcccctacctgttgcaggtggcctggaggaagtcttctgagatagacagagttacggggggagggatttcaagctgtgccccacagcactcgtcctcaaggcaaaggtgggcttgttggaagaaccgggtatggcagcaggtatatctcaggaaaatctaagcaagatatggttggtccactgctggctgatctatgtccctgaagcagcagccaggaacatgagctcttacctcgt

SEQ ID NO: 143625 - DNA, 601 bp, Human
gtgcctgtagtcccagctactcgggaggctgaggcaggagaattgcttgaacctgggaggtggaggttgaagtgagccgagatcacaccacggtactccagcctggcctggtgacagagcaagactccatctcaaaaaagaaaacaaaattaagctgcaaggaagattaataggaaaatgcctatgttgtgtcaagagaatgaaaactattttatttttaaaatttagatacagaaatacaagactgagaaggaaatactccaaaatgttagtaactgtaacaagattataaagctacatmtttgtagtatgaaaaaaatctctcctgtattttcttacaagtttgcttttctctttttttttctatacaaaacctcgctttgttgcccaggctggagtgcagtggtacgatcccggcttactgcaacctctgcctcctgggttcaagcgattctcctgcctcagcctccggagtacctgggattataggcgcctggcaccacacttggctaatttttgtatttttagtagagacagggtttcactatgttggccaggctggtctcgaactcctaacctcaggtgatccaccaaccttggc

SEQ ID NO: 143626 - DNA, 601 bp, Human
acacaaaaattagctaggcatggtggcaggcccccgtcgtcccagctactcgggaggctgaggaaggagaattgcttgaatccaggaggcggaggttgcagtgagccgagattgcgccacggcactctggccgaggcaacagagcaagattccatctcaaagaaaaataaaaaaaactggccaggcacggtggctcacacctgtaatcccagcactttgggagaccgaggcaggtggatcatgaggtcaagatattgagaccatcctggccaacacagtgaaactccgtctctactaaaartacaaaaattagctgggtgtggtggtgcgtgcctgtagtcccagctactcgggaggctgaggcaggagaattgcttgaacctgggaggtggaggttgaagtgagccgagatcacaccacggtactccagcctggcctggtgacagagcaagactccatctcaaaaaagaaaacaaaattaagctgcaaggaagattaataggaaaatgcctatgttgtgtcaagagaatgaaaactattttatttttaaaatttagatacagaaatacaagactgagaaggaaatactccaaaatgttag

SEQ ID NO: 143627 - DNA, 601 bp, Human
ggcccatgtaaatccccctgactggccagcccagcctccatctcctggatgaagtttctccagctctccagcctacactgctagtctgaactggtaacagggtctgggccccttgcatgtgacatcaactgtagaaccaggtcccagctaggagtttctgaaggggcaggcacagaggactctaatactaaatttatttaactggtggctctgctttccatgggagggagtcctgaggcgaaccctttccagagagatgctcatgtaactgtgaaactgctctggacaggcagcaaggaamggatgagaacccaaagatgaacaatctggaatatgaaaaagttgtttccaaataatcacattcactacccttgagagtaaaggaggtacttggagtttctaataaacgagagagagattcctaggagaatatatgtaactttctaaataatttttaattctaaatttaaaaaaataccttccaataaggagcttggaaaagaatacaaaataatggaccttgaggaacataatattctagaaacaaaaggcagcgcctcccttgctagagctcactgtattaaactccaggtacctgaca

SEQ ID NO: 143628 - DNA, 601 bp, Human
tagctgatctcctacccagtattccctcatttcaacccctcctgctttgatgtcagacttttgaaaacaccattttccggcccccaaactactagtgtctattccctaccaattcctcgttctgttgccctgcctggctttcagggctatctgcttggaggctgagttggtcatgtcagtcctcagctcatgtctacttggttctttgttcttactgacggggaatggacgcctctaactgcaacacggttctgtccaaagcatctccccagcaactgcttctaccttggctcacaattcttttttttttttttttttttgagacggagtcttgctctgtcgcccaggctggagtgcagtggcgcaatctcggcttgctgcaagctccgcctcccgggttcacgccattctcctgcctcagcctcccgagtagctgggactacaggcgcctgccactgtgcccagctaattttttgtatttttagtagagacggggtttcaccgtggtctcgatctcctgacctcgtgatccacctgcctcggcctcccaaagtgctgggattacaggtgtgagccaccgcacctggcccacaattcttta

SEQ ID NO: 143629 - DNA, 601 bp, Human
ccctactacatgggcccctctgaggctgtgtttaggtcctgcttgccgcgtttgctgttagtgtctaatgcagactaagcaggcagcactgccgcctgacctgaagcgacagagatgagatgctcacaagccaccacctggctgagggaaaatgactgtgaaaggaactgtgaaggaagaaaagcaacagaagttgctcagctcaatattctaggttctgtaaacggcaagagagtgctcttcacagaagggcaggcctcacaggccatccaggtctgttatgactaccccacgccgctgytgtagaggaaaggcagcgggctgaccaaggtctagttaacctgaccttgtacagacactgggagtgtgtcctggagcctcacggagggagagggacggactcttgagaaacagagacaattgctccactgtgagcacctcacagaggagccaggaaggaagttctgtggggactgcaggtgtgaaaatggttggatcctggggcccagctttctgtcagtgagtgattgtgcaaatcactgtggctaacacctcctccactagagagccacatgtgtatggggcaacagaagacatgaac

SEQ ID NO: 143630 - DNA, 601 bp, Human
tttcggccaccactacaaatatcacttcattgcttcctctaccaaaggggccccacagctgtgctctgtggtcctggggtgtatgtttctaagcctttcttgctgcagccaaacggtcaaccgtgccctcccagtgttcccatgttttattacacctttacctcctgagctctccaattcagagctcctgatctccagtgtgtgggctgggaactcagagacaatgctccttagtattgtgaatgagtcctgagaactttcccaaggagcaaggctaatcacaggcagtgtgcagcctgcyactgtttcatgctggcaaacatttcaagaaaatgacattctgggtccaaaatacctggattctctgcctagttttgccacttgatgtacaattttgagcgaagtgctcaaaggctcctgtcttcagtttcctcaattataaacatggatgcatgctgacttcccaaaattctgttgtgatcaccaaaatgaaatgtttatgaaagaacctatcccatagtttaatcagccaacccagccccagcttcccctggattcatgtgatattctagatgactaaattgtaagtcagtctagacgt

SEQ ID NO: 143631 - DNA, 601 bp, Human
ggcttcctgccctacacggcctcgtcggttccctgggccgcgcgcaggctcaaggtgctaacggggctggcctaggccgcagcctgggcgggagcgcaaggccgcgctgggagccgctgtcggcccctcagcccggcccggggcgttcacgccactctccgcccggagcttggccgcgtccccctgtcgcggaggccgcggtccgatctgagggcgtcgttaatgtgagagcccggttgggaggctccaaaccgggcgccttcggggaaggcccgagcgccggagcccctgcccggagccsgcgccgcggaaccgccccgccctgggccgcagcgcgccgggcttgcagctccgcttggcccggccgcagctcgggagtctgggaggttcgggctaggaaagagagaaggaggccaggcggccaaagttaggtcagtttgttggtgggtcgtttggaattgcgctgggtcctagcaaactgtcgccttgtgactgcagagtcacacagcgggtaagttccaactccaggaaggcctgaggtcggccccgatcgcggcgcggttctgcttccctctcctccactcagtcatcccgatctccc

SEQ ID NO: 143632 - DNA, 601 bp, Human
ggcctgcaacgggccggaaattaaaaaaaggcccaggagccagtttcctgaggggagataaagagctggggttcgttctaggcggagcagtgcttggtagagctagacattgaacttggagccacagtctctgagcattccctccgtccctgggaacgtttcctttcttttgttccctaagggctagagaggacattaactttataaaactggagtggaagtgggcacaaaagaacagtcagaggacttcagacctctcctcatctcttaagctagtgacaccaccattcaccagataagrggtcggttaatggctttctttcctaccctactcccaggtgcagtcgtccattaacccttgtggatttaaatttagaaagatttctggagtgcaggccgggcgcgatggctcacgcctgtaatcccagcactcctgggaggccgaggcgggcggatcacttgaggtcaggagttcaagaccagcctggccaacatggtgaaaccctgtctctactaaaaatataaaaattagctgggcgtggttgcatttgcctgtaatctcagctacccgggaggctgaggtggaagagtcgcttgaacc

SEQ ID NO: 143633 - DNA, 601 bp, Human
attaaggagatagagcaatgagtatgtcacatgtttcaggaggtgaggggagttttatatgtgatgttatgccagtgtaaatgtcctgaatccactgaggctttgtgaattgagaaaaacgttgcgtctttttttctaaattcatgcattccagtaagttgggactgtttcagcctcccttaatggtattctttgtaaatgtttgggacaggtgatgggaaggagtatactcaattattgcaacatttgggaccttttaaggtatttactagaaaactctgaggcaggccaggcgtggtgrctcacacctgtaatcccagctctttgggaggccgaggtgggcggatcatgaggtcaggagttcgagaccagcctggccaacatagtgaaacccccgtctctactaaaaatccaaaaaattagctgggcgtggtggtgggtgcctgtaatcccagctactcgggaggctgaggcaggagaattgcttgaacccgggaggcagaggttgcggtgagccaagattgtgtcattgcattccagtgcgagactccgtctcaaaaaaaaaaaaaaaaaaaaagaaaaccctgagacaaaaactctt

SEQ ID NO: 143634 - DNA, 601 bp, Human
ccatgcctggctaattttttttttttttttgagatggagtctcgctgtgttgcccaggctggagtgcagtggtacagtcttggctcactgaaagctccgcctcctgggttcacgccattctcctgcttcaccctctcgagtagctgggactacaggcgctcgccactacacccagctaatcttttgtatttttagtagaaacggggtttcaccatgttagccaggatggtctcgatctcctgacttcatgatccacccaccttggcctcccgaagtgctggtattacaggcgtgagccacygtgcctggcctgatttttgcattttttagtagagacggggtttcatggtgttggccaggctggtcgtgaactcctaacctcaggtgatccgcctgcctcagcctcccaaatagctgggattacaggcgtgagctaccgcacccagcccttgtcttctctttcaaccttgaagcagaaagttaagaaagttgcttctggtggctgtgtagtttctccttctgacccttgctgcacacatactctagaattccagagctgtgtgagggatcttggaaagcagacaccagtggcctctgttta

SEQ ID NO: 143635 - DNA, 601 bp, Human
gaacagtcagcggccgggcacggtggctcaggcctgtaatctcagcactttgggaggctgaggtgggaggatcatgaggtcaagagatcgagaccatcctggctaacacagtgaaaccctgtctctactaaaaatacaaaaaaaaattagccgggcgtggtggtgggcgcctgtagtcccagctactcgggaggctgaggcaggagaatggtgtgaacccgggagtcggagcttgtagtgagccgggattgcgccactgcactccagcctgggtgacagagcaagactctgtctcgaaagaaaaaaaaaaaaaagaacagtcagcataagaaaacctaagcttcctgaaggattctccacgagttttacacaggcagttcccgtcgtgcccatttgtcctgtgtcaggctttgtgtggttgagtctgttgtggacagacttgaagaggtcggtgtcccagccctcaaggagctgtcagtctggtaggggggtgctggactctggagtttgtaatggaggtcaggaatgccaggcacacccatgtacagatggacacggaaacaccttccaggaatgaggcccggcagccagaagctggtgt

SEQ ID NO: 143636 - DNA, 601 bp, Human
cttttaggagcttgtttctagctgtagaaatgacactgcattcatcaaggctccagttttttccttgccaagaaactgggtggtatgaatgtggtgggtttttttttgttgttgttttttttttttgcgatggagtctcgctctgtcacccaggctggagtgcagtggtgcaatctcggtctactgcaacctctgcctcccaggttcaggctgttctcctacctcagcctcccaagtagctgggattacaggcatgcatcatgactcctggctaatttttgtagttttttgttttttgagmcggagtttcactattgttgcccagcctggagtgcaatggcgcgatctcggctcactgcaacctctgcctcatgggttcaagtaattctcctgcctcagccacccgagtagctgggattacaggcgcttgccaccacgcccagttaatttttgtatttttagtagagacgaggtttcaccatgttggccaggctgctgttgaactcctgacctcaggttccacctgcctcagcctcccaaagtgctgggattacaggcgtgagccaccgtgcccggccctcaatatggtgattcttaagca

SEQ ID NO: 143637 - DNA, 601 bp, Human
gtggcttctttctgacagccctggccactggcagccctgtctgccccacccatttgagtatctataatgacatgacgactgctgccccgagtcaggggggcttagaccacgtgaaggtagcattaaagagtttggcactgagtcaaaagctgcctgggatagtgaacacttactggccccaattctttcttctttactcatatagaaggttgaatcctttgcaggtgaactttttaaattttaattttttttttcttctgaggtggagtttcactcgttgcccaggccggagttcaatggmgcgatcttggctcactgcaacctcctgcctcctgggttcaagcgattctcctgcctcagcctcctgagtagctgggattacaggcgtgtgccaccatgctgggctaattttgtatttttagtagagacggggtttctccatgttggtcaggctggtctcgaactcccgacctcaggtgatccgcccgccttggcctcccaaagtgctgggattacaggcatgagccaccgtgtctggcctaaatttttttttttttttttgagacagagtctcgctctgtcacccaggctggagtgcagt

SEQ ID NO: 143638 - DNA, 601 bp, Human
cctggaccttttgattgttcctggtaggacatggtccttgctgttcttgtcctgagcagcccttatttgatgtggtcttctaaagtatggtgtccagaactggacacagcatttggctctgaatagttcagggtggcctggacgctaaacatggcacaaacgattggtcagctaaaccagtcagtttttcatgctgctgctaaggttcatgccttgtgcttggtgaaaaattaagtgtttggaaccaagtccaggtctttactggatctctaaaatatttcattctgtgacttggggtgtkgttttgctatccaggatccttagaggtttggtctttaagcctgtattcgttccttccctgatatgtggtacctaactacatctctctcagcccacttcccaccagggtgacttcaggccaccagttctaaagccattcgattctcctcagctcttcttgatccagcctctgtttatccattttgtacagaaacattgtagtggctgttgagagaaaggagcatcccttttagccagggcttggggagctccttagaggaacaggcatttgagagaggctttcaatgatgagcatgttggg

SEQ ID NO: 143639 - DNA, 601 bp, Human
gattgttcctggtaggacatggtccttgctgttcttgtcctgagcagcccttatttgatgtggtcttctaaagtatggtgtccagaactggacacagcatttggctctgaatagttcagggtggcctggacgctaaacatggcacaaacgattggtcagctaaaccagtcagtttttcatgctgctgctaaggttcatgccttgtgcttggtgaaaaattaagtgtttggaaccaagtccaggtctttactggatctctaaaatatttcattctgtgacttggggtgtggttttgctatcmaggatccttagaggtttggtctttaagcctgtattcgttccttccctgatatgtggtacctaactacatctctctcagcccacttcccaccagggtgacttcaggccaccagttctaaagccattcgattctcctcagctcttcttgatccagcctctgtttatccattttgtacagaaacattgtagtggctgttgagagaaaggagcatcccttttagccagggcttggggagctccttagaggaacaggcatttgagagaggctttcaatgatgagcatgttggggatgtggggctg

SEQ ID NO: 143640 - DNA, 601 bp, Human
gactacaggcaggcgccaccatgtccacctaatttttgtatttttagtagagacggggtttcaccatgtggtctcgatctcctgacctcgtgatccacccgccttggcctcccaaagtgctgggattacaggtgtgagccaccgcgcctcgcctagatttcttgattagtggctcctgaggggttctgaaacctggccttgtgtgagggttacctggggagattttgaacagttttctaggcctcattgtagaccccaaaaagaagcaaaagaggaactttgttaactgctttgccaagaygcaggtgtgtacatctgagctgtgtgactgagcactggctatatacagcagtgtcctgttctcccatctcctctcaggacttgagtccgtggccttctgctggggcccagggcccatctctcctgttagtgcttgcaaagctgttaagtaaccatccctctctgccatgcttcacactttgccctggagtgggcatcaagctctctggggttgagtttggggcatgggtgttttccattttcaggagctgggtggcacccctgggctttttcagttcccctctatacactgaagtctact

SEQ ID NO: 143641 - DNA, 601 bp, Human
tgtggtctcgatctcctgacctcgtgatccacccgccttggcctcccaaagtgctgggattacaggtgtgagccaccgcgcctcgcctagatttcttgattagtggctcctgaggggttctgaaacctggccttgtgtgagggttacctggggagattttgaacagttttctaggcctcattgtagaccccaaaaagaagcaaaagaggaactttgttaactgctttgccaagacgcaggtgtgtacatctgagctgtgtgactgagcactggctatatacagcagtgtcctgttctcccrtctcctctcaggacttgagtccgtggccttctgctggggcccagggcccatctctcctgttagtgcttgcaaagctgttaagtaaccatccctctctgccatgcttcacactttgccctggagtgggcatcaagctctctggggttgagtttggggcatgggtgttttccattttcaggagctgggtggcacccctgggctttttcagttcccctctatacactgaagtctacttgggctccgaagtggacctcattctgagaagcattgctctctttctcctgcaccacctgccctggt

SEQ ID NO: 143642 - DNA, 601 bp, Human
atccacccgccttggcctcccaaagtgctgggattacaggtgtgagccaccgcgcctcgcctagatttcttgattagtggctcctgaggggttctgaaacctggccttgtgtgagggttacctggggagattttgaacagttttctaggcctcattgtagaccccaaaaagaagcaaaagaggaactttgttaactgctttgccaagacgcaggtgtgtacatctgagctgtgtgactgagcactggctatatacagcagtgtcctgttctcccatctcctctcaggacttgagtccgtgrccttctgctggggcccagggcccatctctcctgttagtgcttgcaaagctgttaagtaaccatccctctctgccatgcttcacactttgccctggagtgggcatcaagctctctggggttgagtttggggcatgggtgttttccattttcaggagctgggtggcacccctgggctttttcagttcccctctatacactgaagtctacttgggctccgaagtggacctcattctgagaagcattgctctctttctcctgcaccacctgccctggttgggaagcctgctgtccccatcaaga

SEQ ID NO: 143643 - DNA, 601 bp, Human
tgaaccactgcgcctggcctgaatttatcttcttgaagttgttttcctcagtggaggcatgattggaatttttttttttttttttttttgagacggagtctcgctctgtcacccaggctggagtgcagtggcgcaatcttggctgactgcaagctctgcctcctgggttcacgcctttctcctgcctcagcctcccgagtagctgggactacaggcgcccgccaccatgcccggctaattttttttgtatttttaatagagacggggtttcaccatgttagccaggatggtcttgatctcstgacctcgtgatccgcccacctcggcctcccgaaatgctgggattacaggcgtgaaccactgcgcccggcatgattggcattttgggctaaatagtttctgtccacaggaccgtcttgtgcagtgcaggtcttttagcatcctggccactcatagtgcccgtggttctcagtagaagctgtagaggatgttgggaaattggggtgggttggtcacagtgcctggcatctgtctcagggtaagggcttgggaggctcaagtgcagagtcgtatctggatgccagcaacaccctgttgagaa

SEQ ID NO: 143644 - DNA, 601 bp, Human
atgttagccaggatggtcttgatctcctgacctcgtgatccgcccacctcggcctcccgaaatgctgggattacaggcgtgaaccactgcgcccggcatgattggcattttgggctaaatagtttctgtccacaggaccgtcttgtgcagtgcaggtcttttagcatcctggccactcatagtgcccgtggttctcagtagaagctgtagaggatgttgggaaattggggtgggttggtcacagtgcctggcatctgtctcagggtaagggcttgggaggctcaagtgcagagtcgtatcyggatgccagcaacaccctgttgagaaactttctactatggtatgctcatcattctctgaagatgtcagggcctgtttgtttgtttgcctgtttctctcacttttgccttataatcagttcttccttgttggttagaatcatgtaaaggaggttgccttttctgtctttggagagcttaacttgacggcaaggtaagttgggagtttatgtgataaccctacttaggattctctgagcttcccaaccctgctgtcattagcatcctcagggttgcccattcttctttctggccaggtgtgt

SEQ ID NO: 143645 - DNA, 601 bp, Human
actttatactgttggagtgtggatttctgaaaccataaagtatatttacagatgattttaaaatttgttttgtcccataaatgttagatatcttcactgttgtttcttctttttttagttgtctagtttcaaagttctgtgtggcatatttttttcctatctgtatttggtttaaaacattttgtttgctaggactccagccttaagggacgtgcatggtataccctgtccttagccaagaatcttactctagtatcttgagccaaggtcaaaaaagccaaacacagcattggaactgtawttatagaaaatccttcccaccccagattcctttttcctcccaaagccccagcttcccatccacccaccaacctggtcattaagcacatgtttgagcaccactgtgagccaggcgctggcaggaccagggcttcctgatccctgcccttgttgagcttacattctatttggagagtggaaggaggtggcagtgtgggtgtgagatctcttcccctttctgagtctgcccaggcttcataatccccaggggagcatttcttatgagtcttgtgagcaggaggaccaggtggcagttggcagg

SEQ ID NO: 143646 - DNA, 601 bp, Human
gtcccttttctaattgagattgtgtagtctactgagcaaagaaatgaacagttaatctgtggctctttggaaaatgataaaaatgaatggaatggttttaagtggtaaggcttgggcagtctggccctgagaatttagtggcctgagagcctgctagccagctccacgggtagattgctgctgggcatgctctgccccaactcatgcaaaggcctccctctggtttcacgctggcaggggctatggagcagtgggctaagatcttactagggcaaaggtggaggctggctggtagaatccmagtgtgcttgggctgaggctctggggagctatccaggccaaagtttcaccttggagacggtaagcaacagccagggctgctcttgtccctgtgtataccacttcttctcggtcctctcccttgctttcttccagggcccctgggtttgtatgaggaatgtttcaatgaagtcttcttccttctccagagcagttaaggcattgttgacatctgacatccccagggtccacacttgtaccccaacctgggctttaggtcttcctgcattggacgggctgggccagcatgggaatctactat

SEQ ID NO: 143647 - DNA, 601 bp, Human
tgtgttttttgtttttttgtttctttttgagacagggtctcactctgttgcccaggccagaatgcagaagcacagtctcgtctcactgcaacctctgcctcccgggttcaagtgattctcccacctcagcctcccgagtagctgggactataggcgtgcaccaccacacctggctaatttttgtattttttggtagagacagggttttaccatgttggccaggctggtctcgaactcctgacctcaagtgatctgtccgcctcagcctaccaaagtgctgggattacaggcttgagccacygtgcctggcctgatgcactaaagttttaaattttttaatttaatttttatttttagagaaggggtcttgctctgtcatccaggctggagtgcagtggctcaataatggctctctgcagccccagactcctgggctcaagcagtcttcccaagtagctggcactataggcacatgctgcaacccccagctaattttaattattttttctgtagagatggagtcttgctgtgttgcccaggctagtcttgaactcccaggctcaagtggtcctcctggcttagcctctgaaagctctgggat

SEQ ID NO: 143648 - DNA, 601 bp, Human
aatggcgtgaacccgggaggcggagcttgcagtgagccgagattgcgccactgaactccagcctcagcgacagagactccatctcaaaaaaaaaaaaaaaaaagacaaaccagcctggggcactccgagcagggcaagccgcgtccccttgttctctcttaacaggggactggactgtgtagggataggcagcccacagggctggtctcagtagacatccctgtggcagggaaagcttcagctttgttagttcactgggtgaaaaaggttagccacagggaaaggatgctgctgtggagtygccaccaagctaggcagaagtgacaacagtgcacaggacccttcagtccatctgaagcctggcatgaagaaggagcagcatgctagttagatccaaactaggatccagctcttcaggtcagccatgagtcctgtctgtggtgtcctacagccagctaggaacacaccacaaggacgtgccatgtagcagcagtccaagtcagacaaccagaagacaccttgacttcctctgtggctgccagagagctgtatggtggtcttccctgcttcacagcagtgacatgaaacggtgacttctgtg

SEQ ID NO: 143649 - DNA, 601 bp, Human
agaagtgacaacagtgcacaggacccttcagtccatctgaagcctggcatgaagaaggagcagcatgctagttagatccaaactaggatccagctcttcaggtcagccatgagtcctgtctgtggtgtcctacagccagctaggaacacaccacaaggacgtgccatgtagcagcagtccaagtcagacaaccagaagacaccttgacttcctctgtggctgccagagagctgtatggtggtcttccctgcttcacagcagtgacatgaaacggtgacttctgtgggatgaaggactctgsgtctttacttgggaagggaaaacatgaagtggaatggggttttaggattcttgaaaggttgccatgggaaaggaagattagatttgaccacagggttagagctaggacaagtgggtgaaagaccccagatagttcggtgccatatggcaaagagcttcctcttagtcttagctgccacaaaatggctttgtgccatgggaggttgatatcaagagctgtgaaggatctgagatttttaccctacttgcagcctgaaaaggtgtcctgccaatttattggatgttggtggaagactcgaga

SEQ ID NO: 143650 - DNA, 601 bp, Human
gcctgtagtcccagctacttgggagggtgaggcaggagaatcgcttgaactcaggaggtggaggctgcagtgaaccgagatcgtgccattgcactcctgcctgggtgacagagcgagactctgtcttaaaaaaaaaaaaaaaaaaaaaaaagacaagtgggctggtcgccgtggctcacgcctgtaatcccagcactttgggaggctgaggcgggcggatcatgaggtcaggagatcgaaaccatcctggttaacacggtgaaaccccgtctctactaaaaacacaaaaaattagccgggygtggtggtgggtgcctgtagtcctagctactcgggaggctgaggcaggagaatgatatgagaggcagagcttgcagtgagccgagattgcgccactgcactccagcctgggcgacagagccagactctgtctcaaaaaaaaaaagacaagtggataaaaagtctgtcctagaatttagacatggattgaaaaggtgttttttgattttttttttttttttttttttctgagacagggtctcactcttgccgaggctggaatgcagtggtgtaatcatagctcactgcagcctcaaactcc

SEQ ID NO: 143651 - DNA, 601 bp, Human
ctgaggcgggcggatcatgaggtcaggagatcgaaaccatcctggttaacacggtgaaaccccgtctctactaaaaacacaaaaaattagccgggtgtggtggtgggtgcctgtagtcctagctactcgggaggctgaggcaggagaatgatatgagaggcagagcttgcagtgagccgagattgcgccactgcactccagcctgggcgacagagccagactctgtctcaaaaaaaaaaagacaagtggataaaaagtctgtcctagaatttagacatggattgaaaaggtgttttttgattttttttttttttttttttttctgagacagggtctcactcttgccgaggctggaatgcagtggtgtaatcatagctcactgcagcctcaaactcctgggcttaagcaatcctcccacctcggccttccaaagtgctggagtttaagtttttgaactagtttagagtgtgtaaaattatcataaggaattaatttacatctcaaatgacttcctcaatacagcagtatgagcttagggagcacaagacagtcaaaggcaggcataacagaaaaacactagtcgtgttcatgtgaagataat

SEQ ID NO: 143652 - DNA, 601 bp, Human
gagctcaggagttcaagaccatcctgggcaacacggtgaaaccccgtctctactaaaatacaaaaaattagccggacgtggcagcctgcgcctgtaatcccagctacttgggaggctgagagacaggacaatcgtttgaacccgggaggcggaggttgcagtgctgagatcccaccattacactccagcctgggcaagcgtgagactctatctctaaataaatagataatgctaaaatctttggtttatttgacattgaaatgttgcagcttaagttggaggcaaattttctgcaatgttktataatatatatattttttacaacaaaaccatgttttttcattaacatcccttgttatttctgagtggccttcccaaagggcaagtttagctctaatgttgaaattcacttgtagagctgtaggcctttacccggaaggtatatcttatgttttaatttttgcatgcctctttcaccaaaaatctctgggacaggcacatagtttgtgtgacttatgcacacctgagccactcctttgaccatccacagatccccagactaggaaagaggcccagagaagttcagatgagtttggccaag

SEQ ID NO: 143653 - DNA, 601 bp, Human
tcaaaactttgtggcttaaagtaataccagtttattagtttttactctggaggttggctgggcttagctacatggttctacagctgactgttcattcctggggtcactcatgcagctgtattgaggtgggaactcaacttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacrgtgtcacttctgtggattcttttggtcaggcaagtccagatttaatgagagggaaaatagacttcagctcttgatgggaggagtatgcaggatgggagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctg

SEQ ID NO: 143654 - DNA, 601 bp, Human
tcattcctggggtcactcatgcagctgtattgaggtgggaactcaacttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacggtgtcacttctgtggattcttttggtcaggcaagtccagatttaatgagagggaaaatagacttcagctcttgatgggaggagtatgcagsatgggagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctgcaaagcctgcctttttaaatgcctcaccattccttcatttgtttcttaaatatgggaagtgaaagtgccacctgaggccgggcacagtggc

SEQ ID NO: 143655 - DNA, 601 bp, Human
cctggggtcactcatgcagctgtattgaggtgggaactcaacttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacggtgtcacttctgtggattcttttggtcaggcaagtccagatttaatgagagggaaaatagacttcagctcttgatgggaggagtatgcaggatggsagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctgcaaagcctgcctttttaaatgcctcaccattccttcatttgtttcttaaatatgggaagtgaaagtgccacctgaggccgggcacagtggctcacg

SEQ ID NO: 143656 - DNA, 601 bp, Human
acttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacggtgtcacttctgtggattcttttggtcaggcaagtccagatttaatgagagggaaaatagacttcagctcttgatgggaggagtatgcaggatgggagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctgcaaagcctgcctttttaaatgcctcaccattccttcatttgtttcttaaatatgggaagtgaaagtgccacctgaggccgggcacagtggctcacgcctgtaatcccagcattttgggaggctggggcaggcagat

SEQ ID NO: 143657 - DNA, 601 bp, Human
tgagaccccatctctacaaaaaactaggccaggagcagtggctaacacccgtaatcccaactactctcaaggccaaggtgggaggattgtttgagcccaggagataagactgcagtgagctgtgattgcaccactgtactctagcctaggttaaaaaaaaaaattagctggacgtgatggcatgtgcttgtagtctcagctactcaggaagctgaggcaggaggatcatttacacccaggagtttgagggtaccgtgcagtaaagtatgattgagccactgcactccagtctgagtgacascaagactgtctaaaaaaaataagaaggaatttgtggcatcagcagttcggagaagaggggcactgttttacagtgggaaggaacattctgagggtgctggtcctgacagggtcagggggcaactgtggcaaagtatgtgaggaggtgtgggtagcagctgcttctgattccccactatccttccaccctggggcacgtctgggctacggcacctagggggagtactgtggcacccatcagagccatcagcgtgacatctgcctgtggtcttgacaatgtgatgcgatggcggttgtcagc

SEQ ID NO: 143658 - DNA, 601 bp, Human; identical to SEQ ID NO: 27229

SEQ ID NO: 143659 - DNA, 601 bp, Human; identical to SEQ ID NO: 27230

SEQ ID NO: 143660 - DNA, 601 bp, Human; identical to SEQ ID NO: 35609

SEQ ID NO: 143661 - DNA, 601 bp, Human; identical to SEQ ID NO: 35610

SEQ ID NO: 143662 - DNA, 601 bp, Human; identical to SEQ ID NO: 35611

SEQ ID NO: 143663 - DNA, 601 bp, Human
ccctttattcagaattttgcacgatagtatctaagactggtgaacactacactctgaagtcagttttttgtgcataggttacctgtatacaatggataaaaataattgcaaaagttaagcttgtaacttgatacatattatcctgttatttttaaaggttttgtgttggggaagagaattttcctgtctcaaggtagcattttatttctaagacttttcagagtaaaaaaagttcagtaaaaaaattgctgattttcttttttgttttcattgtgtattaccagtttaaattcagttgctstacctctcagaaattaaagttaggatgaaattagaactaacacttaatttaaatgatttgaatttacctacaactgcaataataccttactggtaaacacttactctttttaaaacagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggtaagttaatacgtagaaggaagaca

SEQ ID NO: 143664 - DNA, 601 bp, Human
gggaaaatgtgaactaaagattctgctttgtattggaatttcagtcttttctacagaaatcaggaaaggaaaagctatagttaacctcaattttgttctaatttttactacagctttaattctttatttactttatatacacttggaaagcagttttattgcatgtatcttttcaaagttaaaaagtaaacaggtttttaaaattatcattggtaatgattatttttcctttcatcttcatgcttctgttgatctaatcccattcaagagcttaaatagacttacaatggttggatttggktgtgtgaaagtaaatgtgtattatgtgtataaatctaatattttggtatttgaaaagtaaatgtgtgttaggaatattagtctaatccataatatataaaattttcagaaaagttattaaaaattcataaagttagcatctttaaggttaaaattatacattgttactataataatagtgaaagatttgagcaaagaacattaactcccaaaagaaagccaaatgtatcctttacttctgaaatatttgtgggagattttacaggcatcctctagagatactgcgtgttcagttccacac

SEQ ID NO: 143665 - DNA, 601 bp, Human
gtgtctccttgcaaactcagacaaactaatagctgaagggggtagtggatttatttgtaaagttattaatttatgtactgcttggagcaacaaaagtaatatcttattcctaaagggccttttgaccgggcatggtggctcactcccataatcccagcactttgggaggccaaggcagcaggatcacttgagcctaggagtttgaggtcagcctgggcaacatagtgaaaccccatgatttttcatttaaaaaaaaaattaaaaataaaacagagggccgttccatagttttcattgtagyagaataaataaatatctaatttgtcagcaaaatatgtgaaagcaagatcttatgataacctcacctgggaagtaagaaatatatgtattttggtatgttaatgtatgggtgacagaacaagctgcagaggagactaataatttatttttaaaatatcaaaatataggctgggcatggtagctcccgcctgtaatcccagcactttgggaggccaaagcaggcagatcgttttgagctcaggagtttgagaccagcctaggcagcatggcgaaactgtatctctacaaaaaacacaaaaat

SEQ ID NO: 143666 - DNA, 601 bp, Human
tcgtatgctaccaataataaatattttaaacataccataattatcatcatcattgctagtttttctagcccctcagattctgcatattgtcttaaattactaggttatcactgaatcattagtcattgccagtgctagatactgtccaaggcaaacatagtcctcaaaacatagtcctggtccctgtatgttatataattttagaataatgtcatataaatcatatggtacatgcacacatagtaaaatatatttttacgttttgtgctttaactaatatctgtttagtatttgttaaccrtggagttatggaaaaacttaagctctgaagtgagacagaactttgttgagaactcgtcattgccattacaagctgacagctaaagtgcaatttcacaaatgccaatgagagaataatgaactcctcagagttgttgggggggttaatgatgacccatgcaaagtgcttatgtatcatgtatataaaaggcgttgaacaaatgtttttatccccagcagtaagaagcaatgaaagtaggctttgggtatatttgtgctgaaaattagattctatcaggatataaagaaatggtttaagcaa

SEQ ID NO: 143667 - DNA, 601 bp, Human
cattcattattcatcattctgtccctggttgcgggatgtggccttagactgctgcctagttagcgacacagatgtcactggcacatctgtgccagtaatgagatgtattcccaagcctactcctataacaccctaactcagtaggtttggggtaaggccagacaaaaaggttcttgttaagtaaagccaggtttaagaccctcttaaaaatctattttttgagcagagcctgcatttgtaaaatgttttcatatagtataagatggaacctcttggtaatcatgatgttgttgcactaggmcagtatatttcttatataggtctgtggttctcaaccaggggcaattttgcccaccgggaggcatttggcagtgtctggagacttttttttttttttttttttgagacgaagtcttgctctgtcaccccagctggagttcagtggcacgatcttggctctctgcaacctctgcctcccaggttctagccattctcctgcctcagcctcccaagtagctgggattacaggtgggcatcaccactcctggctaattttgtattttttatagagagggggtttcgccatgttggccaggctggt

SEQ ID NO: 143668 - DNA, 601 bp, Human
gtttaagaccctcttaaaaatctattttttgagcagagcctgcatttgtaaaatgttttcatatagtataagatggaacctcttggtaatcatgatgttgttgcactaggccagtatatttcttatataggtctgtggttctcaaccaggggcaattttgcccaccgggaggcatttggcagtgtctggagacttttttttttttttttttttgagacgaagtcttgctctgtcaccccagctggagttcagtggcacgatcttggctctctgcaacctctgcctcccaggttctagccaytctcctgcctcagcctcccaagtagctgggattacaggtgggcatcaccactcctggctaattttgtattttttatagagagggggtttcgccatgttggccaggctggtctcaaattcctgacctcaagtgatctgcctgccttggactcccacagtgctgagattataggcatgagccactgtgcctggcctggagacgtttttgattgtcacaactggaggaaagaggttgtcacaactggtatctagcagatagagcccagggatacagctgaacaccccacaatgtataggacag

SEQ ID NO: 143669 - DNA, 601 bp, Human
tgcactaggccagtatatttcttatataggtctgtggttctcaaccaggggcaattttgcccaccgggaggcatttggcagtgtctggagacttttttttttttttttttttgagacgaagtcttgctctgtcaccccagctggagttcagtggcacgatcttggctctctgcaacctctgcctcccaggttctagccattctcctgcctcagcctcccaagtagctgggattacaggtgggcatcaccactcctggctaattttgtattttttatagagagggggtttcgccatgttggscaggctggtctcaaattcctgacctcaagtgatctgcctgccttggactcccacagtgctgagattataggcatgagccactgtgcctggcctggagacgtttttgattgtcacaactggaggaaagaggttgtcacaactggtatctagcagatagagcccagggatacagctgaacaccccacaatgtataggacagcctccacaagaaaaaattaacccaaaatgtcagtaatgctgaggctaagaaaccctgttatatacaaactgttaggtaaaattttgttctcgtgtgaaagt

SEQ ID NO: 143670 - DNA, 601 bp, Human
gtcccagcatctctttctacaaccaccatcatctgtcattccagctcattccgtgtaataatctgactctgacaattcagctggcacttagaatctattgttcctactacccttttgttgtccttcactcccctttcttcattttattcttcacctaacttaaatttcattgtcaatcataattgcctataccttcagctccctaattccctaatctggcaaaccataactctggttaaatccagctctctgcctactccatgcctgcacccatgcaactacacataattggagaaaggtrctaattgacctttatttaaacacgtgactttgaacctcaggtgcccagcagtcttatatttcccttgtccatatattctcccactctcctagaaggctgttttataccttcttctctcctacactctaacacctccgcctttcttactttatgaccctattgcttatttcactgagaatagtcaggagaaagcatctatctttttttttttcttttgagactgagtttcactcttattgcccaggctgtagtgcagtgacaggatctcggctcactgcaacctctacctcccaggttcaa

SEQ ID NO: 143671 - DNA, 601 bp, Human
atatttcccttgtccatatattctcccactctcctagaaggctgttttataccttcttctctcctacactctaacacctccgcctttcttactttatgaccctattgcttatttcactgagaatagtcaggagaaagcatctatctttttttttttcttttgagactgagtttcactcttattgcccaggctgtagtgcagtgacaggatctcggctcactgcaacctctacctcccaggttcaagcgattcttctgcctcagcctcccgtgtagttgggattacaggtgcacgccatcaygcccggctaattattgtatttagtagagacggggttttaccttgttggccaggttggtctcgaactcctgacctcaggtgatccacccgccttggcctcatgaagtgctgggattacaggcgtgagccaccgcacccagccgcgtctatctttctttactgatctttcagtttctacccttgcccctgtacagtccattctcaacacaatagccagattgattctgatgaaacctacatcacgtcatgtcaccccatgatcaaaagcctgcatgatagagtcccgtgtgaccattcagac

SEQ ID NO: 143672 - DNA, 601 bp, Human
ttcaccatgattattttattttacttaaattatccatgttgttatagctgggtttttaaggcgtgaatgactttctccttccaccacctctcttcttaatttctcacaggtagttagggcccgaagaaggcatgttacattaatctaaaaaaatggaatcaggaaacagagttcctaacaaagtcgtgtaatagtttagaagccagatgtaacttttgagtcacttcagccactgctgaagttgagtcttttgcattgaataggcagatgattctaaaagtactggaaatgtaactatccttgtgtgtgtgtgtgtgtgtgtggtgtgtgtgtgtgtgtgtgtgttttaaggcatgtattttgttattgtcatttgtgctatttgattaacttatgaaggcatatgttaatttagttatttttggaaagtgactcatatactgttctgtcaaacataataagagaaaagtgccaacttgtttagcttttatgggacatgggatcataatctaaaaggttacacaaacaattttattgtgagcaaatcaatgtgattacttccttattttcttgacttttaggaccaaatgctactttagaa

SEQ ID NO: 143673 - DNA, 601 bp, Human
cttttatgggacatgggatcataatctaaaaggttacacaaacaattttattgtgagcaaatcaatgtgattacttccttattttcttgacttttaggaccaaatgctactttagaaagagaaactatagcttttcatataattactgaagctttaaattgtgaaagtcagtattaactgaatcttagataataggaatataaatgattggttgtatgctataaggttccaaagacttcagtaagatagtttgataatgatttttgacagataaacttaggatttctagataatttttttwaagttcttatttgaaattgagtactctgaagtttttgttattgtatctctgacctataggatctattttatttttggatagaatgtattctaggtgtctgtatcttgaactggtacttagtaagaccaacatttatgtaggaatgtacgtgttacatttgtatgttttgataattgcttttcacattctaatgaacatactctccagtgttaattgttatttttgagagtgactgcaattcttcaagaaagctttccagcttttgtagtttttctaataagatgcctgctgcagagtcca

SEQ ID NO: 143674 - DNA, 601 bp, Human
ttgtcatgtctccttaggctttgttagactgtgacagtttctcagactttctttggttttgatgatttcgacagttctgaagaatctgttcagattccatagtgcattttaaatttcattttctcttatgtcacttagcatttgtttgggttaccttcctttcaagtttagctgatgtgtagaaatagaatgtaaacttattttattgctaactggcaaagatcagttacagcaaatcacgtctgatttaatacatactttaaaccctcagttactcattttgtagcagtaagtcaatacygttgagcaaagtaatttgcaaaggctggatgatttttggatcaggatttgtgctaactagtattagccaaactataacattccagaaggttatttgttcaaaaaatctcttgaattccaaagccaaacatagatgattttcttactttttgctttatcctctataggataatgattagttgaatcggggtcgatatgttttgatacaaaaaggattagggaataaaactcctttggggttacagcttttttctttctttctttcttttttttttttttttttttttgagatgaagtctcg

SEQ ID NO: 143675 - DNA, 601 bp, Human
ggggtaagctagtgttgatgaatatagagtttaaactgtaaccttttttacttggctctgaatagattatagtgtcactattttattatttccttcatttctcttttagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaaggtaagctatcttaaattctgacrtgatatttctttagatttgttcctttttgtgtcttaacagagaatgtgggataaaacaagctaatatacagacatattccagaggttgtcagtgacagagtactagatacagtcaggttttttttttttttaaaccactttacaaacttccctttatacactttaagcattttcttactgtaggaataggctgtattttaatacagtggcctaaattttgatttgtgatgatagacttaatgtgggatgaaagcagagacttaggcttggaagtatcttttttttagtatttgtggaaat

SEQ ID NO: 143676 - DNA, 601 bp, Human
cttcttgttggatccctcatttctcatttctcctttttttttttttttttgtcttatttactgttatggtggtgcccaacctgagagtagtttcctgagagtgcaaggatggtgatacttttgagatcctctgtgttggaattctgagtcaaaccgcagaattgcaggctcttaagtttctttcttttctatccttataattgatagttttgactgggtatagaatctttgattagcaaccctcttagacttctgggtactaaaatgctaactggaggttctgtgtatgtgagtagcttaygacattgcaggctttactagagtgaatgatctggggacttgactctttttattgggtgcctgtcacccacctgccagtatttgtacgctctgtcacctgcttaagtagttttcccagaggagactttcagtactctgactagagggtataagctgggctgccagtgtttagtgaacctattggggaaaggaggtttggaggtggggctcacttacatagtggttaaattttcacttaatcttttaaatacatcatctcagctgtatctgaatatctctaattctgagtccctctgtttca

SEQ ID NO: 143677 - DNA, 601 bp, Human
tagttttcccagaggagactttcagtactctgactagagggtataagctgggctgccagtgtttagtgaacctattggggaaaggaggtttggaggtggggctcacttacatagtggttaaattttcacttaatcttttaaatacatcatctcagctgtatctgaatatctctaattctgagtccctctgtttcaaccatttcaaagagtggacctcttaagtttttcactgatctggaagaaagtggagaggctctaatatctttgaactttcattccttctgctttctttttctttccyttttttttttttttttttttttttgaaacagtctcactctgtcaggctggagtacagtggtgcaatcttggctcacttcaacctccacctcccaggttcaagcggttctcatgcctcagcctcccaagtagctgggaccacagacactagccaccacgactggctaatttttgtatttttaaggagacggggtttcgccatgttggctaggctggtcttgatctcctggcctcaagtgttctgcccacctcagcctcccaaagtgctgggattacaggtgtgagccactgtgtccagccc

SEQ ID NO: 143678 - DNA, 601 bp, Human
ccagggtggagtacagtggcatgatttcagctcactgcaacctccacctcctggattcaagcaattctcctgccttagcctcccgagtagctgggattataggcacccaccagcacgcccggctaatttttgtatttttagtagagacggggtttcaccatgttagccagactggtctcgaactcctgacctcaggtaatccgcccatgtcggcctcccaaaggcctgggattacaggcgtgagccaccatgcccagccgaactcattctttttttatggctgcagacccccgtctctttaaaaaaaaaaaaaagctgggcacagtggcacacactctgaagtgggacttcagagtcccagctactctgaagactgaggtgggaggatcacttgagctcagaagattgaggctgcattgagttaggattgtgctgttgtactccagcctgggcaacagagcaagaccctgtcttaaaaaaaaaaaattgaaattataactttttttttttgagataaggtctcttattttgtcacccaggctggagtgcagtggcacaatcatggctcattgcagcccaaactgccaggctcaagtagtcc

SEQ ID NO: 143679 - DNA, 601 bp, Human
cctgctttaagttcctttgggtgtctacccagaagtggaattgctggatcatatggtaatttgaagtacaatttttggaggaatttccatactgctttccatggtggctgcactattttacattcccaaaggcaatgcagaggagtgccattttctccacatcctcatcaacacttgttatttcctgttttttttaaagctatttttatgggtgtgaggtggtatcttactgtgtttttggtttgcatttccctaatgattagtgatgtgttgagcatgttatgtgtttatcggccatttktatatcatttttggagaaacgacttttgaagtcttttgcccatttttttaattggttgatagggtgtttagagtttgaagtcagcattctctttactagtattatgattttaacacaagccatttaacctctttgtgcctcggattctctactggcaaatgggatatcatttttctgtagctgcttaatacaaatgctagaaataggtttgatgtggcactgcctaatctagcatacatatggaattgttgctgttagagcagccagctttaatctataagcacgtcttcattttctgtt

SEQ ID NO: 143680 - DNA, 601 bp, Human
aaagtacccacatctgggacatgttaatctcatagcagaagacagaagtgagagaagctgcactgaccctgcaggcacatttaaagcttctgttaggatgtggcttatatcacatgcttacattccagagcaagtcacacagcctgacaatggagtgaagacatatactctacctcagagaggcatgagaggaggcatggagaaagtataatttaggagataattggaattagaatctaccatattgtatttaagggaatctaatggtaatgttagacgtgaagatcaccttatttcatcttttttttttttttttttttcctgagacggaatctcgctctgtcgctgctcaggctggagtgcaatggcgtgatctctgctcactgcaacctccacctcccgggctcaagcagttctcctgcctcaccctcccaagtagctgggattacaggtgcctgccaccacgcccagctaaattttgtatttttagtagagatggggtttagccatgttggccaggttgctcttgaactcctgacttcaaatgacccacctgcctcggcctcccaaagtgctaggattacaggtgtgagctaccact

SEQ ID NO: 143681 - DNA, 601 bp, Human
ggaatcaacctaagtgctcatcactgacagcctggataaagaaaatgtgcatgtacaccatggaatactgtgcagccataaaaaaaaatgagatcatgtcttctgcaggaacatgaatggagctggaggtcattttccttagcaaactaatgcaggaactgaaaattaaatattgcctgttctcacttataagtgggagctaaatgatgagaactcatggacacaaagaagggaacaacagacactgggtccagtggaggctgggaggagggagaggagcagaaaaaataactattggatrctagtcctttaatacctgtgtgatgaaataatctgtaaacaaacccccatgacatgagtttacctatataacaaacctgcgaatttacccctgaacctaaaataaaagttgagaaaaaaataaattaggattttctttcccactagtggaatttttatcaaatagttctgttttagttcctaaactagacttttttattctttttgaaaaggtggattttaagtattttgtctaaaatggttttagaggaaggcattaaaatatgcatgttggcaacacaggtttaaattcttggtcttt

SEQ ID NO: 143682 - DNA, 601 bp, Human
aatattgcctgttctcacttataagtgggagctaaatgatgagaactcatggacacaaagaagggaacaacagacactgggtccagtggaggctgggaggagggagaggagcagaaaaaataactattggatactagtcctttaatacctgtgtgatgaaataatctgtaaacaaacccccatgacatgagtttacctatataacaaacctgcgaatttacccctgaacctaaaataaaagttgagaaaaaaataaattaggattttctttcccactagtggaatttttatcaaatagttytgttttagttcctaaactagacttttttattctttttgaaaaggtggattttaagtattttgtctaaaatggttttagaggaaggcattaaaatatgcatgttggcaacacaggtttaaattcttggtctttaagctgaacttttatttttaaaaagttgttttctcttgtccaggcgcagtggcttatgcctgtaatcccagcactttgggttgctgaggcaggtggatcacgtgaggtcaggagttcaagaccagcctggccaacatggtgaaataccatctctattaaaaatacaaa

SEQ ID NO: 143683 - DNA, 601 bp, Human
atgctcattaagagtcatcaccactccctaatctcaagtacccagggacacaaacactgaggaaggccgcagggtcctctgcctaggaaaaccagagacctttgttcacttgtttatctgctgaccttccctccactattgtcctatgaccctgccaaatacccctctgcgagaaacacccaagaatgatcaattaaaaaaaaaaaaaaaaaaaaagaaagcaggccaggtgcagtgactcacgcctgaaatcccagcactttggaaggccaaggcgggaggatcacgaggtcaaaagatygagaccatcctggccaccatggtgaaaccccatctctactaaaagtacaaaaaaaaattagccgggcgtggtgatgcacacctgtagtcccagctacttgggaggctgaggcaggagactcgcttgaacctgggaggcagaggttgcagtgagccgagatcgtgccactgcactccagcctggcaaaagagcgagactgtctaaaaaaagaaaaataaaaagcaaactacagtataaagtgggttacagaaagtctcaatgatgtattcatatgtaaaaaattaaaggagctgcacactt

SEQ ID NO: 143684 - DNA, 601 bp, Human
ttcggcctattgctggatattgtcttggttgaagtatatgaagaaaatccagcctcatgtagctatgcaattggagaagggaagagagtattttaataactttttcagataattgtggatattcttctttgatactacaccaaaaattgacaagtggtagtttcttaagggttggttggaatgtggaatctaaagccctgtcagtggttgtacttcactaataactgaatggatctttcgattttgtaacatcatgcattggtcatttgaaaaatatcagttcactgggttatatagatckgaatgttggcacattttgttatatatactcatctctaaatatccgtgtaggatcgatattctagaaccctcacagataacaaaatctacggatgctcaagtccttcatataaaatgagttagtattcatataacccgtatgcatccttcagtatacttttttttttttttttgagatagggtctttgcctctgttgcccaggcaggagtgcagtggtgtcatcttggcttactgcaacctgcccctccctggctcgagcgattttcgtgcctcagcctcccaagtagctgggactacagg

SEQ ID NO: 143685 - DNA, 601 bp, Human
gctttccttaaagtctaaagttagagtctacgctctttttatggaatgaacaaagaccttggaatactttaatcttgctcctcaaatctttcatgcttttttttttttttttttagcattttagttctactctgttttgttattagaaacttcaaacatggacaaaagtaagcgaattgggcaatgaattcctgtttatcaaccattcgtattcacttactgtgtttgcttcaactagaccttttctcttgctgaagatctttaaaatttgtttaatttactttatttatttatttatttwttattattattatatattttttgaggtggagtctcattctgtcacccaggctggagtgcagtgacgtgatcttggctcacttgcaacctccacctcctgggttcaagtgattctcctgcctcagcctcctgagtagttgggattacaggcgcctgccaccacacccggctaattttttgtagttttagtagagacggggtttcactgtgttggctaggctggtctagaacccccgacctcaggtgttccgtccgccttggcctcccaaagtgctgggattacaggcatgagccaccatgc

SEQ ID NO: 143686 - DNA, 601 bp, Human
ttcctgttctgtgacttgcctagtcatcgtattttttagtccatttttcttttttttctgatgtattatttgcatgctctgggtattaatcctgcattagttttatgtgctataggtttcttcctccattggtggtttgccttctttgtccactgtattaatgttatactttgggcagaagaaggcttttttccaggtatcccttgactttctatgttgttattaatacatttatagtctgtctaataagccttttacatataaatttttctaaaaggtgaaaatcaaccagtaaaatacsattatgctcaatagaactgtctacctatttattagtacaaggccaaggaatgtacaaagattacgattccttccttatcagatcattgtcagtgaattaccttttttttagtgaattacttgcttattgcttaaatgctactaataggttaaataatgtcttagactttatttgcttaaaatgtcacattttcattatcgatttatgtttattttttaatgtagctttttttctcaacatcagattgctccagataatgtaactattatatggagtttaatactttcttatttctgttat

SEQ ID NO: 143687 - DNA, 601 bp, Human
cctccattggtggtttgccttctttgtccactgtattaatgttatactttgggcagaagaaggcttttttccaggtatcccttgactttctatgttgttattaatacatttatagtctgtctaataagccttttacatataaatttttctaaaaggtgaaaatcaaccagtaaaatacgattatgctcaatagaactgtctacctatttattagtacaaggccaaggaatgtacaaagattacgattccttccttatcagatcattgtcagtgaattaccttttttttagtgaattacttkcttattgcttaaatgctactaataggttaaataatgtcttagactttatttgcttaaaatgtcacattttcattatcgatttatgtttattttttaatgtagctttttttctcaacatcagattgctccagataatgtaactattatatggagtttaatactttcttatttctgttataatgtgaaccagttgctttctagacttgttttcagctctctaggatttcattttgattagactcaagttaataccacaattttttataactagtggcttctttttggttttgcctttatttt

SEQ ID NO: 143688 - DNA, 601 bp, Human
tctcaagtgatcagtctgtgtcagcctccccagtgctgggattacagacacgagccactctgcccatctatgattttatttttaattaaaattaatctggattgttaattaagagatatcagtatactcttagggattgtggaagacagtgagcttatttaatagtcagcaggtctcttgaaagtaaatgatatcttagggctgggcgtggtgggtcacgcctgtaatcccagcactttgggaggccacgcgggtggatcacctgaagtcaggagttccagaccagcctggccaacatggkgaaaccctgtctctactaaaaatacaaaaattagctgggtgtggtggcgtgcgcctgtaatcccagatacttggaggctaaggagaatcgtttgaacaaggaggcggaagttaacagtgagcagagatcactccactgcactccagcctgggcgacagagcgagactccgtctcaaaaaaaaaaaaaaaaaaaagtaaatgatgtcttagaaacaagccttaaaagatcttaatcttactcttgctaaatgtagtataagtctaagccagcctcagctcttggcctgagattactagtct

SEQ ID NO: 143689 - DNA, 601 bp, Human
ttcttcttagcatatatctgaaattatattatgtatttgctaatggtcttttccctattagaatgtaagctctatgagggcaaggactcttgtcttgtttactgctgtattcttctagcataaacacacacacccccttagaacaattctggatacacaatagaaattcagcaaatgtttgggtgaatgaaatggccctaaaatactattttaaaacttgttttctttccaggttatattttcttatttaatgtgtgtaaaaatgtggtggtatgaagttttttggttttaaaaccttcartagtgagtttttgtgggcacattgtattcataagagctgttaattctagccataactttaaataaatgtattggttgcttgtgtacatgactatctgtaagtaaaatgaaggtctcttagaagttaatacagtttaaccttaaaatctgttctaaaattatttgacatttttctcactgaataagaatgagaaggaggaagcatagtgtagaaaagtagcgtgcagggtagagtggtactggattgtaattatgtaagttaaggaaataacatgctttgcctattccttgtcaccctttt

SEQ ID NO: 143690 - DNA, 601 bp, Human
tttaaccttaaaatctgttctaaaattatttgacatttttctcactgaataagaatgagaaggaggaagcatagtgtagaaaagtagcgtgcagggtagagtggtactggattgtaattatgtaagttaaggaaataacatgctttgcctattccttgtcaccctttttttctgccttatagacaagggaaaaaaaagattgaataaaagagttttaattttaatcatatgtcttatgtgaatattgttttggttatactagttactgaaatgtgtatcatgtcacagttcactttttgccttttttttttttttttttttgagttttgctgttgttgctcaggctggagtgcaatggcacaatcttggctcactgcaacctctgcctcctggcttcaagcaattctcctgcctcaccctcccaagtagctgggattacaggcatgcaccatcacgcctgactaattttttgtatttagtagagacgaggtgtcaccatgttggtcaggctggtctcgaactcctgacctcaggtgatccacctgcctcagcctcacaaagtgctgggattacaggtgtgaggcactgcacctggccacaa

SEQ ID NO: 143691 - DNA, 601 bp, Human
tgatccttattctgattgttttttaagagatctctcagtctggcacagtggctcatgcctgtaatcccagcactttgggaggctgaggtaggcaggtcacctgaggtcaggagttcgagacctgcctgaccaacatagtgaaatcccgtctttactaaaaatttaaaattagctgggcttggtggtgggcgcctataatcccagctactcgggaggctaaggcaggataattacttgaacctgggaggcggaagttgcagtgagccaagatcgcactactgcactccagcctgggcaacargagtgaaactcccatctaaaagaaaaaaaaaatggctgggtgcggtggctcatgcgtctaatcccagcactttgggagactgaggtgggcagatcatgaggccaggagtttgagaccagcctgcccaatatggtgaaaaatacaaaaattagccagcatggtggggcgtgcctgtggtcccagctgctcaggaggccaaggcagaggagttgcttgaacctggggggcggaggttgtgttgagctgagataatgccactgcactccagcctgggcaacagagcaagacactctgttgcta

SEQ ID NO: 143692 - DNA, 601 bp, Human
agctgggattacaagcatgcaccaccacacctgactggtttaatcttttgaggaaccgccagattgttttccatagcagctgcaccattttacataactaccagcaatatatgagggtttcacttacacttgtcacattgtttttcttattatagtcatcttataatcaaagtatctcattgtgatactttgtgtgaagtagtatctcattgtggtttcatctgcatttccctaatgactaataatgttgaagattgtttcatgtgcttgttgtccatttgtatatcttctttggagaaaygacttttcagattttttgcccgtttttaaaattaggtttttatgtattgttgaatcctgagttctttatatatcttggatacaaggatataagcccccttatcacatgtgtgatttgcatatattttctcctgtactctggattgtcttttcattttttttttttttaagatacggggtcttgctactttgcccaggctggtctcaaactcttggattcaagggatcctcccgctgcagcctccccaagtagctaggactgcaggggcctactatcacactcagcttcttttcactttcc

SEQ ID NO: 143693 - DNA, 601 bp, Human
gcctcacgagtagctgggattacaggcatgcattaaccacacctggctaatttttgtatttttactagagatgggattttgccatcttgcccagtctgttcttgaactgcttgcctcaagtgatccacctacctaggcctcccaaagtgctgagattacaggcgtgagccaccatgcccagcccctgtaatatcagtttgaattcccaccagttaaagtgcctgttttcccaaagccttgcctagtaggatgctgattcagtggatgaaaaatggttatttcccattatagtttgagagaytaaatagtacagactgtggggatagatttcttgggtttaaattcctactctgctacttcttgtgaaatgctagagaaattgcttaacttcctcatttatgttttctcatctctaaaatgaagttaataatagtttctgccttatgttttttgtgaggattaaatgagttagtacatgcaaagagctttgaacagtacctagcacatagaattatcattgtttgctattattaattttaaattgcttttttaatgagaaagagcatctttttatgtgttagagatagttttgttttgtaat

SEQ ID NO: 143694 - DNA, 601 bp, Human
tttctgccttatgttttttgtgaggattaaatgagttagtacatgcaaagagctttgaacagtacctagcacatagaattatcattgtttgctattattaattttaaattgcttttttaatgagaaagagcatctttttatgtgttagagatagttttgttttgtaatctccatgttcttaacccatttttctattaggttgttggtcattttcttttaaaaatttttttattatggtaagaacactcaccaggcatgacgactcacgcctgtaatcccagcactttgggaggccgaggtgggcagatcacttgaggtcaggagtttgaaaccagcctggccaacatggtgaaaccccatctctaccaaaaattcaaaaattatcccggtatggtgatgtgtgcctataatcccagctactcaggaggctgaggtgagataattgcttgaacccaggaggtggaggttggagtgagtggagatcgcaccactgcactgcagcctaggcaacagagcaagactgtctcaaaaacaaaacaaaaaaaaactaaaagaaagaacacttaacatgagatctgcgctcttagtaaggttttttctt

SEQ ID NO: 143695 - DNA, 601 bp, Human
ggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacaggtaagagtgatagatgttgtgagttaaaattatgtaaaacagtttaatgttgtcagaagtttcagatactacttttctgtattcaaattgattatctaaaagccaagttctattataytgattttactttaatatcataatataaatcttagagaatttataaaagataaactttatagtcatatgacagtaataatacagaataaaaaaattccattaagtacattaaatgtttctcctgtgttacttttataagccaatttttaaattcatgagcctaaatagaaaaatgtagcatgtacctaaacaagacaggttgcaagaaaaggagaaagcaattaaccatattaagttgttagaagaaattttgaatttattttatagacttcaacaggactagtcaatggcattattaata

SEQ ID NO: 143696 - DNA, 601 bp, Human
agtcatagccactgttggctgggcacggttgcttatgcctgtaatcccaacactttgggagggcaaggtgggcggatcacctgaggtcaggagtttgagaccagcctggccaacataatgaaaccccgtctatactaaaaatacaaaaattaggcctcgcatggtggctcacgcctgtaatcccagcactttgggaggccaaggtgggcaggtcacgaggtcaagagatcaagaccatcctggccaacatgctgaaaccctgtctctactaaaaatacaaaaattagctgggtgtggtcgyacacgcctgtagtcccagctacttgggaggctgaggcaggagaatcccttgaacccaggaagcgaaggttgcagtgagccgagatcacaccactgcactccagcctggcaacagagcgagactcttgtctcaaaaataaccaaaaaacaaaaattagtggggtgtggtcgcacgcgcctgtagtcccagctactcaggaggctgaggcgggagaatagcttgaacccaggaggtggaaattgccatgagccgagaccataccattgcactctagcctgggtgatagagttagactccgtg

SEQ ID NO: 143697 - DNA, 601 bp, Human
aaaaaatgtctttcattttcagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatggtacgtaatttgttccattttggtagtctgaagaataccccccaaaataaattcatgtccaatacctgaaacgtgtgaatgttaccttgtttwaccaaaaaatgattttgcagatgtgataagttaaggatcttgagatggagagattatcctcaattacgcaggtgggcccttaatgcgataacatgtgttcttataagaaggaggcagaaggaggtttgactacatagaagagaagaaagccatgtggtggaaacagtgggaagcaaagtcaaagggagaagatgctatgttgctgactttgaagatggtgaaagagcccatgagccaaagaatatagttctagactctgaaaaagacaaggaaacagattatccctttcagccttgccaa

SEQ ID NO: 143698 - DNA, 601 bp, Human
ctatttgcttatgcttattcctgttacttttttcagtgctagacgtaggtatgtctgcgtagtcataaagggtgtcatatatcttaaggacagactactcaggtttaactactcaatttagtgcctccttaaacatttactttgcacatctaggcaaattagacttagcaggtaattagaaattctttttctaaggattattgtatggtctcaaaaacaataaagctaaagaaaaggaaatagattcaaagtaagttttgcacttaaaaatcacttctggctaggcacagtggctcatgcrtgtaatcccagcactttgggaggccaaggcaggaggattgtttgaggccaggagttcaagaccagcctggtcaacagaacaagaacctgcccctacttaaaaaaaaaaaaaaaaacatttctataatgaattagttaaaagagaacaagcatttttatagtggctttcattcataacataggactaaaatgtatttcatcattttataagatatattgggagaataaggtaaaactaaatagcagattattttctgtttggctgactgattgattacctgttaccttcttaggcctcttt

SEQ ID NO: 143699 - DNA, 601 bp, Human; identical to SEQ ID NO: 25232

SEQ ID NO: 143700 - DNA, 601 bp, Human; identical to SEQ ID NO: 25233

SEQ ID NO: 143701 - DNA, 601 bp, Human; identical to SEQ ID NO: 25234

SEQ ID NO: 143702 - DNA, 601 bp, Human; identical to SEQ ID NO: 25235

SEQ ID NO: 143703 - DNA, 601 bp, Human; identical to SEQ ID NO: 25236

SEQ ID NO: 143704 - DNA, 601 bp, Human; identical to SEQ ID NO: 25237

SEQ ID NO: 143705 - DNA, 601 bp, Human; identical to SEQ ID NO: 25238

SEQ ID NO: 143706 - DNA, 601 bp, Human; identical to SEQ ID NO: 25239

SEQ ID NO: 143707 - DNA, 601 bp, Human; identical to SEQ ID NO: 25240

SEQ ID NO: 143708 - DNA, 601 bp, Human; identical to SEQ ID NO: 25241

SEQ ID NO: 143709 - DNA, 601 bp, Human
tcgtgatcaggtatactaatcctttaacaccaagttcggaattaactcacatgcttcaaagcacaccgagaaatacaaactgttttacagaacagcttaagatgacggtctcggtgcgcctggaccggcatcagctgtttagttaattttaagaaatcaaggaatggctggcttacagcaggattgcacccagctggcccatccttcctcccgtgcccccacccgcccctaggggattaaaaccaagggagctaaaaccccaggttggcaaccgtgaggtattggtgctcagcaaatccayccgaggccgcgacactcgcagcgctcccgggggcgaacgcaaggccacactgtccagctcccgctccagcccagactgggcttctccaggccacgcggggcctgatcctggggcccactgcggctgcggagctttccccccagtctgcgggcccagccgctctcctagcaccgcagagctctccgagggcggcctacctctcctagggtcgccgtccccagctcctccctcagagtcccccgccaagggcccgctgcacctattcccgcagacgcgcagctgtaccggcctcagaccacg

SEQ ID NO: 143710 - DNA, 601 bp, Human
gttcagttccttttctgtaaaaaagcagtatctaccctgcctactcaactgaggtgttgtgaggatcaaaagctatactgtatttggaagcaatctataaaatggaaaacgttacgccacgtgcggtggctcacacctgtaatcccagcactttgggaggccaaggtgggtggatcacctgaggtcaggagttgaagaccagcctggccaatatggtgaaaccccatctctactaaaatacaaaaattagccgggaatgatggcgagtgcctgtaatcccagctactcagaaggctgagaygggagaatcgcttgaacctgggaaatagtggttgcagtaagccgaaattgcgccactgcactccagcctgggtggctgagggagactccgtctaaaaaaaaaaaaaaaggaaaaccttgaaggaacagaatggataatattacttttaagttgtttagctgaaagttttcttctttttttctggttctgtccagactggagtgcagtgggacaatcacttaagcagccttaaactccgaggctcaagtaatcctcctgcctcagcctcccaagtaactgggactacagttgcacaccagc

SEQ ID NO: 143711 - DNA, 601 bp, Human
tgtgtcaacaaacaaacaaaaacaaaaacagctctttcacagatattacgatttccctgagaggtaggctggggagaagtgacaggctttggtgagagtgctgatcactggcatggtgctgtagtgccacaaactgctgtgtctagaaaaatgagaaccatcttattcacaatattatcattattatcaaaaagtctctggaattccagacccaaccgtaaccttaattcacttttgcctgagttcagttccttttctgtaaaaaagcagtatctaccctgcctactcaactgaggtgttktgaggatcaaaagctatactgtatttggaagcaatctataaaatggaaaacgttacgccacgtgcggtggctcacacctgtaatcccagcactttgggaggccaaggtgggtggatcacctgaggtcaggagttgaagaccagcctggccaatatggtgaaaccccatctctactaaaatacaaaaattagccgggaatgatggcgagtgcctgtaatcccagctactcagaaggctgagatgggagaatcgcttgaacctgggaaatagtggttgcagtaagccgaaattgcgccactg

SEQ ID NO: 143712 - DNA, 601 bp, Human
ctggattcaagtgacctatctgcctcggcctcccagagtgttgggattacaagtgtgagccactgcgcccagcctcaaatatatttttaattcaacttccccaaataaaccgtactaactaataaattttcttcagcaatggatccaaaatggcactggtggcaataatttcaagaaaggcattaggtgggctgggcgtggtagctcacacctgtaatcacaccactttgggcagctaaggcaggaggattacttgaggccatgagctcgagaccagcctgaacaacttggtgagacccccatctctgcatataaataaataaatttaggccaggcaaggtggctcacgtctataatcccagcactttgggaggctgaggtgggtggatcacctgaggtcaggagttcgagaacaacctggccaacatggtgaaaccccgtctctactaaaaatacaacaattagccaggtgtggtggcgcacgcttgtagttccagctacttcggaggccaaggcaggagaatcgcttgaactcgggaggcagagattgcagtgagccaagatcgtgccactgcactccagtctggacgacagcgagact

SEQ ID NO: 143713 - DNA, 601 bp, Human
tgggccaggcgtggtgactcatgcctgtaatcccagcactttgggaggccacggcgggcagatcacgaggtcaggagatcgagatcatcctggctaacacggtgaaacccagtctctactaaaaaatatatatatataaaaaaacaattggccgggcatggttcctcacgcctgtaatcccagcactttgggaggccgaggcaggcggatcacgaggtcaggagatcgagaccaccctggctaacacggtgaaaccccgtctctactaaaaaatacaaaaaattagccgggcgtggtggtrggcgcctgtagtcccagctactcgggaggctgaggcaggagaatggcgtgaacctgggaggcggagcttgcagtgagctgagatcgcgccactgcactccagcctgggtgacagagcgagactccaacaacaacaacaacaaaaatatatatatattagctgggtgtggtggcaggcatctgcagtcccagctactcaggaggctgaggaaggagaatggcatgaacccaggaagcagagtttgcagtgaactgagatcacgccactgcactccagtctgggagacagagcaagactcca

SEQ ID NO: 143714 - DNA, 601 bp, Human
atgggccaggcgtggtgactcatgcctgtaatcccagcactttgggaggccacggcgggcagatcacgaggtcaggagatcgagatcatcctggctaacacggtgaaacccagtctctactaaaaaatatatatatataaaaaaacaattggccgggcatggttcctcacgcctgtaatcccagcactttgggaggccgaggcaggcggatcacgaggtcaggagatcgagaccaccctggctaacacggtgaaaccccgtctctactaaaaaatacaaaaaattagccgggcgtggtggygggcgcctgtagtcccagctactcgggaggctgaggcaggagaatggcgtgaacctgggaggcggagcttgcagtgagctgagatcgcgccactgcactccagcctgggtgacagagcgagactccaacaacaacaacaacaaaaatatatatatattagctgggtgtggtggcaggcatctgcagtcccagctactcaggaggctgaggaaggagaatggcatgaacccaggaagcagagtttgcagtgaactgagatcacgccactgcactccagtctgggagacagagcaagactcc

SEQ ID NO: 143715 - DNA, 601 bp, Human
tggatcacctgaagtcaggagtttgagactagcctggctaacatggtgaaatcccatctctactaaaaatacaaaaattagccaggtgtggtggcgcgcacctgtagtcccagctactcaggaggctgaggcagaagaatcgccttaacccgggaggcagaggttacagtgagccaagatcgcaccagtgcactccagcctaggtgacagactgagactctgtctcaaaaacaaacaaacaaacataaacaacagaattattgaacatattaagaagcaacgaatggatctaaagatatgrgccaggcgtggtgactcatgcctgtaatcccagcactttgggaggccacggcgggcagatcacgaggtcaggagatcgagatcatcctggctaacacggtgaaacccagtctctactaaaaaatatatatatataaaaaaacaattggccgggcatggttcctcacgcctgtaatcccagcactttgggaggccgaggcaggcggatcacgaggtcaggagatcgagaccaccctggctaacacggtgaaaccccgtctctactaaaaaatacaaaaaattagccgggcgtggtggtggg

SEQ ID NO: 143716 - DNA, 601 bp, Human
acccaggaggcagaggttgcagtgagctgagatcgcgtcattgcactccagctctgggcgacagagcgagattccatctcggcgggggtgggggagtggagtgggggtggggaaggaaaagatacacacatacacacaaggttacagaactatgaacaaggccaggaagactagatatgggatattaaactattaatgatgattgagggaacttccactttctattttctacatttctataaggtttgaatttttacaacacacgtgtaacttttaaaactatataaagtaaaaaaaaaaagacttgttttggctttcaacaacagaatgattggctgggcacagtggctcacatctgtaatcctagcactttgggaggccaaagcgggtggatcacctgaagtcaggagtttgagactagcctggctaacatggtgaaatcccatctctactaaaaatacaaaaattagccaggtgtggtggcgcgcacctgtagtcccagctactcaggaggctgaggcagaagaatcgccttaacccgggaggcagaggttacagtgagccaagatcgcaccagtgcactccagcctaggtgacagac

SEQ ID NO: 143717 - DNA, 601 bp, Human
ggctgaggcaggagaattgcttgaacccaggaggcagaggttgcagtgagctgagatcgcgtcattgcactccagctctgggcgacagagcgagattccatctcggcgggggtgggggagtggagtgggggtggggaaggaaaagatacacacatacacacaaggttacagaactatgaacaaggccaggaagactagatatgggatattaaactattaatgatgattgagggaacttccactttctattttctacatttctataaggtttgaatttttacaacacacgtgtaacttttamaactatataaagtaaaaaaaaaaagacttgttttggctttcaacaacagaatgattggctgggcacagtggctcacatctgtaatcctagcactttgggaggccaaagcgggtggatcacctgaagtcaggagtttgagactagcctggctaacatggtgaaatcccatctctactaaaaatacaaaaattagccaggtgtggtggcgcgcacctgtagtcccagctactcaggaggctgaggcagaagaatcgccttaacccgggaggcagaggttacagtgagccaagatcgcaccag

SEQ ID NO: 143718 - DNA, 601 bp, Human
tggagaaacccgtctctactaagaaaaaaaaaaaaaaaattagctgggtgtggtggcacgtgcctgtaatcccagctactcgggaggctgagacaggagaattgcttgaatccgggagacggaggttgcggtgagccaagatcgcaccatcacactccagcctgggcaacaagagcgaaactccatctcaaaaaaagaaaaaaaaatttcctttctcctagtctatttcatttccataagaaacaaactgtttcatatgaagaatacaactctgttgaaaaagacagacatggctgggcatggtggctcacacctgtaatcccagcactttgggaggccgaggcgtgtggatcaccaggtcaggagttcaagaccagcctggccaacatgatgaaaccccatctctactaaaaatacaaaaattagccaggcgtggtagtgtgtgcctataatcccaggtactcgggaggctgaggcaggagaattgcttgaacccaggaggcagaggttgcagtgagctgagatcgcgtcattgcactccagctctgggcgacagagcgagattccatctcggcgggggtgggggagtggagtgggggtg

SEQ ID NO: 143719 - DNA, 601 bp, Human
aagtacaaaaattagccaggcgtggtggtgtgcacctataatcccagctacgtgggaggctgaggcagaatcacttgaacccagcaggcagaggttgcagtgaggcaagatcacgccattgtactccagcctgggcaacagagcaacactcaatctcacacacaaagaaaagtttcataaagagtcacacatagcacacgtggtgccgctccaaacaccacccagtgtgcagcatacttacccacgccctgtgttgtcaggccggccaccatcagccagtgccacagtgatggtccgagcrtggtcagccagcacccggtaggccatgtcaatcccatcggcatcctcagcaccaactttcccagtgtatggtcgggcacctgtgccctatagataagaatcaggaggcagccctttaggaagcagactttctggcgctaccttgcccaaggaggttcctggaggattgaggagcattagcagaaaggatgccggtcttgccagatcctataaccccaagaacgtgacattggggaagtagagagactccagccagcccctacactcaaaaattatactgtctcaggtctagagcctcaca

SEQ ID NO: 143720 - DNA, 601 bp, Human
gtcaaggcttccctagggtaaacgctggtttgttttcctttcacattcagttacccatagagggaggaaagatggacagaccagatgtgtacttgatgcctgtgatcccaggtcctgcctgtcagtaagagagattcccagggctggtcaatacctaccctcaccctgcccctgccaatctcctatcaggcaactttgaatacaatccttatcatctgtactcagcagcagagatttaatatagtggcaactctgtgacactagctgaaactcccttcatcccttaaaaaaggggtgggggattcttccacctgcccaagacaaggaaacaataacgaaagatggctttaagtttcataaagaggccgggcatggtggctcacacctgtaatcccatcactttgggaggtcgtagcaggtggatcatctgaggtcaggagttcgagaccagcctggccaacatggcaaaaccccacctctggccgggcacggtggctcacgcctgtaatcccagcactgtgggaggccgaggcgggcggatcacctgaggttgggagtttgagaccagcctgaccaacatggaaggaaccccatctttact

SEQ ID NO: 143721 - DNA, 601 bp, Human
gaggggctggatgaagccagagactgttccctgccccgtcttaaaaaagctccttagctgggtgcagtggctcacgcctgtaatcctaccactttgggaagccgaggcaggtggattgcctgagctcaggagttcaagaccagcctgggcaacacggtgaaaccctgtctctactaaaacagaaaagattagccaggcttggcggtgtgcacctgtaatcccagctattcggaaggctgagacaggagaatcgcttgaacccaggagacagaggttgcagtgagccaagatcactctattkcactccagcgtgggtgacagagtgagactccgtctcaaaaaacagcaacaaaaagctgcttaacagtatgccctctcccactccatccctcttaacggactgctttagcacagaagggtaagcagagaaataaacctaccagggactggacgacaacatccactaacgtagcaaagaagcccctgctggcattgagcttttcatgggcgtatcggacagctcggcggagaatccgtctcaacacatatctgtaagaggcaaaaactagtccccaacgttcccagctgagggttttgtctt

SEQ ID NO: 143722 - DNA, 601 bp, Human
ctcagcctccccaaatgtatgtgtttataaatttttataaacagttttttttttttataaggagtttcgctcttgttgcccagtctggagtgctatggcatgatctcggctcactgcagcctccatctcccgagttcaagcgattctcctgcctcagcctcctgagtagctgggattacaggcatgcaccaccacacccggctaattttgtatttttagtagagacagggtttctccatgttggtcaggctggtctcgaactcccgacctcaggtgatctgctcgcctcggcctcccaaartgccgggattacaggcatgagccactgtgcccagccataaacaggtttattggaacacagccacacctgttcatttacatatggtcaatggctgcttgaacactccaactatagagctgagtactcatcaccaggaacatgtggtcagcaaagccaaaaatatttagtatccagttatttacacaaagtttgccaacccctggcctagacaatggatctgatagctatcctctgaaccaggaaatcaaaggcaatgccccaggaaagaaggtggagtgacaggtgaggagaaaccaggcc

SEQ ID NO: 143723 - DNA, 601 bp, Human
ggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgyagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaaaagactaaacataggaaagctaggagatcttgtgtggt

SEQ ID NO: 143724 - DNA, 601 bp, Human
caggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaa

SEQ ID NO: 143725 - DNA, 601 bp, Human
taggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggcccygatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaac

SEQ ID NO: 143726 - DNA, 601 bp, Human
atcctgtgtctgagcagctgcggaagccccggcggtaggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacrcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagac

SEQ ID NO: 143727 - DNA, 601 bp, Human
aaaggatggaggagccatcacccactccttgccctgggtgatactgctggaggccgagacagactttacggctggtacagggggcggccatggccactgccaggacaggacagagtggcaaagccaggtatcaaccagatgtcttcaccaataagaaggcctgggtaaggggtactggcaaaggtaaccaaccggtgggcagaaaggctgtttcgaatgcaggctgtacacacacaggcctcagccaacaaccttaagacctaacacttcccactggtgcgaggtggtgctgacctggggracttgacacaggcacgtgatcttgccagcctcattgtccaccgtgaagagcatggcagaagtctgaggggagtgcatcttgaagagcttcaaggcttcattcagggcctgtggggaggacctggctcaggccacggtgctggagcagggaccctcactagtgtgagcatttgcagccctcagaaggcctgccacccacccctaccccttcccagagcaggggctgtgcccagggcctgtggggaggaccccagcgccgggccctgcccctaccctggcccaggtatgcctcccacatgca

SEQ ID NO: 143728 - DNA, 601 bp, Human; identical to SEQ ID NO: 38738

SEQ ID NO: 143729 - DNA, 601 bp, Human; identical to SEQ ID NO: 38739

SEQ ID NO: 143730 - DNA, 601 bp, Human; identical to SEQ ID NO: 38740

SEQ ID NO: 143731 - DNA, 601 bp, Human; identical to SEQ ID NO: 38741

SEQ ID NO: 143732 - DNA, 601 bp, Human; identical to SEQ ID NO: 38742

SEQ ID NO: 143733 - DNA, 601 bp, Human; identical to SEQ ID NO: 38743

SEQ ID NO: 143734 - DNA, 601 bp, Human; identical to SEQ ID NO: 38744

SEQ ID NO: 143735 - DNA, 601 bp, Human; identical to SEQ ID NO: 38745

SEQ ID NO: 143736 - DNA, 601 bp, Human; identical to SEQ ID NO: 38746

SEQ ID NO: 143737 - DNA, 601 bp, Human; identical to SEQ ID NO: 38747

SEQ ID NO: 143738 - DNA, 601 bp, Human; identical to SEQ ID NO: 38748

SEQ ID NO: 143739 - DNA, 601 bp, Human; identical to SEQ ID NO: 38749

SEQ ID NO: 143740 - DNA, 601 bp, Human; identical to SEQ ID NO: 38750

SEQ ID NO: 143741 - DNA, 601 bp, Human; identical to SEQ ID NO: 38751

SEQ ID NO: 143742 - DNA, 601 bp, Human; identical to SEQ ID NO: 38752

SEQ ID NO: 143743 - DNA, 601 bp, Human; identical to SEQ ID NO: 38753

SEQ ID NO: 143744 - DNA, 601 bp, Human; identical to SEQ ID NO: 38754

SEQ ID NO: 143745 - DNA, 601 bp, Human; identical to SEQ ID NO: 38755

SEQ ID NO: 143746 - DNA, 601 bp, Human; identical to SEQ ID NO: 38756

SEQ ID NO: 143747 - DNA, 601 bp, Human; identical to SEQ ID NO: 38757

SEQ ID NO: 143748 - DNA, 601 bp, Human; identical to SEQ ID NO: 38758

SEQ ID NO: 143749 - DNA, 601 bp, Human; identical to SEQ ID NO: 38759

SEQ ID NO: 143750 - DNA, 601 bp, Human; identical to SEQ ID NO: 38760

SEQ ID NO: 143751 - DNA, 601 bp, Human; identical to SEQ ID NO: 38761

SEQ ID NO: 143752 - DNA, 601 bp, Human; identical to SEQ ID NO: 38762

SEQ ID NO: 143753 - DNA, 601 bp, Human; identical to SEQ ID NO: 38763

SEQ ID NO: 143754 - DNA, 601 bp, Human; identical to SEQ ID NO: 38764

SEQ ID NO: 143755 - DNA, 601 bp, Human; identical to SEQ ID NO: 38765

SEQ ID NO: 143756 - DNA, 601 bp, Human; identical to SEQ ID NO: 38766

SEQ ID NO: 143757 - DNA, 601 bp, Human; identical to SEQ ID NO: 38767

SEQ ID NO: 143758 - DNA, 601 bp, Human; identical to SEQ ID NO: 38768

SEQ ID NO: 143759 - DNA, 601 bp, Human; identical to SEQ ID NO: 38769

SEQ ID NO: 143760 - DNA, 601 bp, Human; identical to SEQ ID NO: 38770

SEQ ID NO: 143761 - DNA, 601 bp, Human; identical to SEQ ID NO: 38771

SEQ ID NO: 143762 - DNA, 601 bp, Human; identical to SEQ ID NO: 38772

SEQ ID NO: 143763 - DNA, 601 bp, Human; identical to SEQ ID NO: 38773

SEQ ID NO: 143764 - DNA, 601 bp, Human; identical to SEQ ID NO: 38774

SEQ ID NO: 143765 - DNA, 601 bp, Human; identical to SEQ ID NO: 38775

SEQ ID NO: 143766 - DNA, 601 bp, Human; identical to SEQ ID NO: 38776

SEQ ID NO: 143767 - DNA, 601 bp, Human; identical to SEQ ID NO: 38777

SEQ ID NO: 143768 - DNA, 601 bp, Human; identical to SEQ ID NO: 110263

SEQ ID NO: 143769 - DNA, 601 bp, Human; identical to SEQ ID NO: 110264

SEQ ID NO: 143770 - DNA, 601 bp, Human; identical to SEQ ID NO: 110265

SEQ ID NO: 143771 - DNA, 601 bp, Human; identical to SEQ ID NO: 110266

SEQ ID NO: 143772 - DNA, 601 bp, Human; identical to SEQ ID NO: 110267

SEQ ID NO: 143773 - DNA, 601 bp, Human; identical to SEQ ID NO: 110268

SEQ ID NO: 143774 - DNA, 601 bp, Human; identical to SEQ ID NO: 110269

SEQ ID NO: 143775 - DNA, 601 bp, Human; identical to SEQ ID NO: 110270

SEQ ID NO: 143776 - DNA, 601 bp, Human; identical to SEQ ID NO: 110271

SEQ ID NO: 143777 - DNA, 601 bp, Human; identical to SEQ ID NO: 110272

SEQ ID NO: 143778 - DNA, 601 bp, Human; identical to SEQ ID NO: 110273

SEQ ID NO: 143779 - DNA, 601 bp, Human; identical to SEQ ID NO: 110274

SEQ ID NO: 143780 - DNA, 601 bp, Human; identical to SEQ ID NO: 110275

SEQ ID NO: 143781 - DNA, 601 bp, Human; identical to SEQ ID NO: 110276

SEQ ID NO: 143782 - DNA, 601 bp, Human; identical to SEQ ID NO: 110277

SEQ ID NO: 143783 - DNA, 601 bp, Human; identical to SEQ ID NO: 110263

SEQ ID NO: 143784 - DNA, 601 bp, Human; identical to SEQ ID NO: 110264

SEQ ID NO: 143785 - DNA, 601 bp, Human; identical to SEQ ID NO: 110265

SEQ ID NO: 143786 - DNA, 601 bp, Human; identical to SEQ ID NO: 110266

SEQ ID NO: 143787 - DNA, 601 bp, Human; identical to SEQ ID NO: 110267

SEQ ID NO: 143788 - DNA, 601 bp, Human; identical to SEQ ID NO: 110268

SEQ ID NO: 143789 - DNA, 601 bp, Human; identical to SEQ ID NO: 110269

SEQ ID NO: 143790 - DNA, 601 bp, Human; identical to SEQ ID NO: 110270

SEQ ID NO: 143791 - DNA, 601 bp, Human; identical to SEQ ID NO: 110271

SEQ ID NO: 143792 - DNA, 601 bp, Human; identical to SEQ ID NO: 110272

SEQ ID NO: 143793 - DNA, 601 bp, Human; identical to SEQ ID NO: 110273

SEQ ID NO: 143794 - DNA, 601 bp, Human; identical to SEQ ID NO: 110274

SEQ ID NO: 143795 - DNA, 601 bp, Human; identical to SEQ ID NO: 110275

SEQ ID NO: 143796 - DNA, 601 bp, Human; identical to SEQ ID NO: 110276

SEQ ID NO: 143797 - DNA, 601 bp, Human; identical to SEQ ID NO: 110277

SEQ ID NO: 143798 - DNA, 601 bp, Human; identical to SEQ ID NO: 110263

SEQ ID NO: 143799 - DNA, 601 bp, Human; identical to SEQ ID NO: 110264

SEQ ID NO: 143800 - DNA, 601 bp, Human; identical to SEQ ID NO: 110265

SEQ ID NO: 143801 - DNA, 601 bp, Human; identical to SEQ ID NO: 110266

SEQ ID NO: 143802 - DNA, 601 bp, Human; identical to SEQ ID NO: 110267

SEQ ID NO: 143803 - DNA, 601 bp, Human; identical to SEQ ID NO: 110268

SEQ ID NO: 143804 - DNA, 601 bp, Human; identical to SEQ ID NO: 110269

SEQ ID NO: 143805 - DNA, 601 bp, Human; identical to SEQ ID NO: 110270

SEQ ID NO: 143806 - DNA, 601 bp, Human; identical to SEQ ID NO: 110271

SEQ ID NO: 143807 - DNA, 601 bp, Human; identical to SEQ ID NO: 110272

SEQ ID NO: 143808 - DNA, 601 bp, Human; identical to SEQ ID NO: 110273

SEQ ID NO: 143809 - DNA, 601 bp, Human; identical to SEQ ID NO: 110274

SEQ ID NO: 143810 - DNA, 601 bp, Human; identical to SEQ ID NO: 110275

SEQ ID NO: 143811 - DNA, 601 bp, Human; identical to SEQ ID NO: 110276

SEQ ID NO: 143812 - DNA, 601 bp, Human; identical to SEQ ID NO: 110277

SEQ ID NO: 143813 - DNA, 601 bp, Human; identical to SEQ ID NO: 110263

SEQ ID NO: 143814 - DNA, 601 bp, Human; identical to SEQ ID NO: 110264

SEQ ID NO: 143815 - DNA, 601 bp, Human; identical to SEQ ID NO: 110265

SEQ ID NO: 143816 - DNA, 601 bp, Human; identical to SEQ ID NO: 110266

SEQ ID NO: 143817 - DNA, 601 bp, Human; identical to SEQ ID NO: 110267

SEQ ID NO: 143818 - DNA, 601 bp, Human; identical to SEQ ID NO: 110268

SEQ ID NO: 143819 - DNA, 601 bp, Human; identical to SEQ ID NO: 110269

SEQ ID NO: 143820 - DNA, 601 bp, Human; identical to SEQ ID NO: 110270

SEQ ID NO: 143821 - DNA, 601 bp, Human; identical to SEQ ID NO: 110271

SEQ ID NO: 143822 - DNA, 601 bp, Human; identical to SEQ ID NO: 110272

SEQ ID NO: 143823 - DNA, 601 bp, Human; identical to SEQ ID NO: 110273

SEQ ID NO: 143824 - DNA, 601 bp, Human; identical to SEQ ID NO: 110274

SEQ ID NO: 143825 - DNA, 601 bp, Human; identical to SEQ ID NO: 110275

SEQ ID NO: 143826 - DNA, 601 bp, Human; identical to SEQ ID NO: 110276

SEQ ID NO: 143827 - DNA, 601 bp, Human; identical to SEQ ID NO: 110277

SEQ ID NO: 143828 - DNA, 601 bp, Human; identical to SEQ ID NO: 110263

SEQ ID NO: 143829 - DNA, 601 bp, Human; identical to SEQ ID NO: 110264

SEQ ID NO: 143830 - DNA, 601 bp, Human; identical to SEQ ID NO: 110265

SEQ ID NO: 143831 - DNA, 601 bp, Human; identical to SEQ ID NO: 110266

SEQ ID NO: 143832 - DNA, 601 bp, Human; identical to SEQ ID NO: 110267

SEQ ID NO: 143833 - DNA, 601 bp, Human; identical to SEQ ID NO: 110268

SEQ ID NO: 143834 - DNA, 601 bp, Human; identical to SEQ ID NO: 110269

SEQ ID NO: 143835 - DNA, 601 bp, Human; identical to SEQ ID NO: 110270

SEQ ID NO: 143836 - DNA, 601 bp, Human; identical to SEQ ID NO: 110271

SEQ ID NO: 143837 - DNA, 601 bp, Human; identical to SEQ ID NO: 110272

SEQ ID NO: 143838 - DNA, 601 bp, Human; identical to SEQ ID NO: 110273

SEQ ID NO: 143839 - DNA, 601 bp, Human; identical to SEQ ID NO: 110274

SEQ ID NO: 143840 - DNA, 601 bp, Human; identical to SEQ ID NO: 110275

SEQ ID NO: 143841 - DNA, 601 bp, Human; identical to SEQ ID NO: 110276

SEQ ID NO: 143842 - DNA, 601 bp, Human; identical to SEQ ID NO: 110277

SEQ ID NO: 143843 - DNA, 601 bp, Human; identical to SEQ ID NO: 110263

SEQ ID NO: 143844 - DNA, 601 bp, Human; identical to SEQ ID NO: 110264

SEQ ID NO: 143845 - DNA, 601 bp, Human; identical to SEQ ID NO: 110265

SEQ ID NO: 143846 - DNA, 601 bp, Human; identical to SEQ ID NO: 110266

SEQ ID NO: 143847 - DNA, 601 bp, Human; identical to SEQ ID NO: 110267

SEQ ID NO: 143848 - DNA, 601 bp, Human; identical to SEQ ID NO: 110268

SEQ ID NO: 143849 - DNA, 601 bp, Human; identical to SEQ ID NO: 110269

SEQ ID NO: 143850 - DNA, 601 bp, Human; identical to SEQ ID NO: 110270

SEQ ID NO: 143851 - DNA, 601 bp, Human; identical to SEQ ID NO: 110271

SEQ ID NO: 143852 - DNA, 601 bp, Human; identical to SEQ ID NO: 110272

SEQ ID NO: 143853 - DNA, 601 bp, Human; identical to SEQ ID NO: 110273

SEQ ID NO: 143854 - DNA, 601 bp, Human; identical to SEQ ID NO: 110274

SEQ ID NO: 143855 - DNA, 601 bp, Human; identical to SEQ ID NO: 110275

SEQ ID NO: 143856 - DNA, 601 bp, Human; identical to SEQ ID NO: 110276

SEQ ID NO: 143857 - DNA, 601 bp, Human; identical to SEQ ID NO: 110277

SEQ ID NO: 143858 - DNA, 601 bp, Human
accggtggcaagtatgcctcccagtatgacaggtgagaactgagggatgggcttctccttggccttgatccgtgtttggagcccacgtgtctggtccgcccaacactggcctgcagagtggccggaccagggccctcagcaggctgctgtgaacggggcccagtgagcaagggtggccattgtctcttggcttcctatggcctactgggtggcccttgggtactctgggcagggagagtggcatagtcccccaagtctgcgtggtgtcagggttggcaggctgtggacagggggcctagcrtcacctggcctatgagccgccctacttgcagaaggcagagtattcgactctaacctcaggcatgcacctttgtatgtgagcgccatggggctggggccacacgtagagtccccttctcttcctgcatgttccagggactcaggcccaaatccctaagcctgtccctgtgccagggaggatgcagcggaagctccctgggaggccctgccagtgggccccaggcccccagaggctttttggaggtgctgcagatgcttgggcccattcccgcacccccaccccaccccagcaagaacagcg

SEQ ID NO: 143859 - DNA, 601 bp, Human
tatgcctcccagtatgacaggtgagaactgagggatgggcttctccttggccttgatccgtgtttggagcccacgtgtctggtccgcccaacactggcctgcagagtggccggaccagggccctcagcaggctgctgtgaacggggcccagtgagcaagggtggccattgtctcttggcttcctatggcctactgggtggcccttgggtactctgggcagggagagtggcatagtcccccaagtctgcgtggtgtcagggttggcaggctgtggacagggggcctagcgtcacctggcctrtgagccgccctacttgcagaaggcagagtattcgactctaacctcaggcatgcacctttgtatgtgagcgccatggggctggggccacacgtagagtccccttctcttcctgcatgttccagggactcaggcccaaatccctaagcctgtccctgtgccagggaggatgcagcggaagctccctgggaggccctgccagtgggccccaggcccccagaggctttttggaggtgctgcagatgcttgggcccattcccgcacccccaccccaccccagcaagaacagcgttcttcctgccc

SEQ ID NO: 143860 - DNA, 601 bp, Human
tcttggcttcctatggcctactgggtggcccttgggtactctgggcagggagagtggcatagtcccccaagtctgcgtggtgtcagggttggcaggctgtggacagggggcctagcgtcacctggcctatgagccgccctacttgcagaaggcagagtattcgactctaacctcaggcatgcacctttgtatgtgagcgccatggggctggggccacacgtagagtccccttctcttcctgcatgttccagggactcaggcccaaatccctaagcctgtccctgtgccagggaggatgcakcggaagctccctgggaggccctgccagtgggccccaggcccccagaggctttttggaggtgctgcagatgcttgggcccattcccgcacccccaccccaccccagcaagaacagcgttcttcctgccctgcagcgtctggagcccttcagccttgttccttttccaccagcccatcagcacctgtgcccgggtgccctgacggggattggtgccccatctgtggggcagggcctgtcctgtctgggggtctgccccagcccctcacttcagggcaagtggggagctgtgggccctgctgg

SEQ ID NO: 143861 - DNA, 601 bp, Human
gcaattcagtttgccttgactatctcattccggcagaggggagggtggatacgacgtgcagggctgacttgggacgaaggtgatgtggctgtggttggaagagggtccccctcccagactctgagctgccctcactggagaggtcagaattcctggaaggaagatgagacgggtgcagcaggatagtggcaggagggccccgggtgtgcaggcttctcagtggggctggggcctggcctcggcatctaggggtgaggaaagcctcaacagctttggtgcagatgagaggtttgccgggggkgtgaccttaggtgggtagcagctgctgtgagcgcacccattccacagcactcaccgcagcccccggcctccaggcagcggccccagccatccttcccttggccgctcctgtcccctgccagcagggtcctctggcctggcctccactccctgcttgctgtcccctggcttggagcctgtctcttgcagggtccctccaggcgaggctgcctgggctcagggtggctctgggcccgggcgtgctgcctgctagtgcgtagccatcaggaggctctggcttcccaggttccacatcccagcc

SEQ ID NO: 143862 - DNA, 601 bp, Human
gcctcctgccttctctcaggctgctgcccagtggctagggcccagcaccctagctgggtggccgtctgctgatgggccatcctgcccacagatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggtcaggggccgccagctgccgtcaccttgctcccaggacagcccagtggcctggccacgccgcctcccmcttgctcctacctgcctgggctgtggccccagctgccagcaggccacagtgctagcaggagcccaccctccctactctatgggaggagccgctttgcagggaacgggggaagccgggctgcctccaacgggcctgaggggtcggggtcctggacccggggtgagtccccagtggcactgcagggtccccagacaaggggtctcccgacagagctgctgatctccagtggggtctgtgggtcaccgggcccgaacttggcagcaccctctgtgctgggacgaggtttgcaggctgggagct

SEQ ID NO: 143863 - DNA, 601 bp, Human
cgtcgtcaaggtcaggggccgccagctgccgtcaccttgctcccaggacagcccagtggcctggccacgccgcctcccacttgctcctacctgcctgggctgtggccccagctgccagcaggccacagtgctagcaggagcccaccctccctactctatgggaggagccgctttgcagggaacgggggaagccgggctgcctccaacgggcctgaggggtcggggtcctggacccggggtgagtccccagtggcactgcagggtccccagacaaggggtctcccgacagagctgctgatcyccagtggggtctgtgggtcaccgggcccgaacttggcagcaccctctgtgctgggacgaggtttgcaggctgggagctaggggttccgaatggagggtggcagttcttcggagagaagttctctgacagaaacgttccctgatggggatgtagggtttcctgctacgaatatggggctgcctgacaggctccccggcctgggctatgggtgtgctgacggtggggccacccggtctcagtccggcctccttacaggcgccatcgggggtgcaggtgctgatgagtgccacccggagtgca

SEQ ID NO: 143864 - DNA, 601 bp, Human
tacctgcctgggctgtggccccagctgccagcaggccacagtgctagcaggagcccaccctccctactctatgggaggagccgctttgcagggaacgggggaagccgggctgcctccaacgggcctgaggggtcggggtcctggacccggggtgagtccccagtggcactgcagggtccccagacaaggggtctcccgacagagctgctgatctccagtggggtctgtgggtcaccgggcccgaacttggcagcaccctctgtgctgggacgaggtttgcaggctgggagctaggggttcygaatggagggtggcagttcttcggagagaagttctctgacagaaacgttccctgatggggatgtagggtttcctgctacgaatatggggctgcctgacaggctccccggcctgggctatgggtgtgctgacggtggggccacccggtctcagtccggcctccttacaggcgccatcgggggtgcaggtgctgatgagtgccacccggagtgcatacatggaggaagaaggcgtcttccacttccacatggagcaccccgtgcccgcctacctcgtggccctggtggccggagacctcaag

SEQ ID NO: 143865 - DNA, 601 bp, Human
cctccaacgggcctgaggggtcggggtcctggacccggggtgagtccccagtggcactgcagggtccccagacaaggggtctcccgacagagctgctgatctccagtggggtctgtgggtcaccgggcccgaacttggcagcaccctctgtgctgggacgaggtttgcaggctgggagctaggggttccgaatggagggtggcagttcttcggagagaagttctctgacagaaacgttccctgatggggatgtagggtttcctgctacgaatatggggctgcctgacaggctccccggcckgggctatgggtgtgctgacggtggggccacccggtctcagtccggcctccttacaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggtagggcctcctgctggggccttctggggctgcgcaggcctcggggagagccccaccgggggtctgtggcctgtgtccacggctgccctgct

SEQ ID NO: 143866 - DNA, 601 bp, Human
ggcctcctgctggggccttctggggctgcgcaggcctcggggagagccccaccgggggtctgtggcctgtgtccacggctgccctgctgaggacccccactggcctctgggtgctctgggccagccctgcccctgccttggtgccaccgccagggccctgccacccatgtgccctcagacccggcagcctggcccacccagtgcctgccctgcaaactggtccttcctgccaaggcccccgcacagcctggcaccctcataccttcgttggtcccttcagcccagagataaaatgagctamgtggcccctggaatgcagctctgccctgctgtgggaagggccagggtggctgcccatccagtgaggcagggcgggctgtaggctggggtggtcagccaggctgggtgaggtgtgggtgttactggagccccagggcagtgggagagcctggtggggtgagcggggctggggctgctcggcctcagctcaccctctctgcatgcaccaggagccgcgtgtgggccgagccatgcctcctgcccacggccaccagcaagctgtcgggcgcagtggagcagtggctgagtgcagctgagcggc

SEQ ID NO: 143867 - DNA, 601 bp, Human; identical to SEQ ID NO: 38642

SEQ ID NO: 143868 - DNA, 601 bp, Human; identical to SEQ ID NO: 38643

SEQ ID NO: 143869 - DNA, 601 bp, Human; identical to SEQ ID NO: 38644

SEQ ID NO: 143870 - DNA, 601 bp, Human
ttgttttgtacaaggtctccctctgtcacccaggctagagtgcagtggtatgatcttggctcatggcaacctcctgggctcaagcagtcctcccatctcagcctccagagtagctaggaccacagccaccacacccaactaatttttgtatattttgtagagatggggtgctgctgtgttgcccaggctggtcttaaattcctgagctcaagtgatccacctgctgcggcctccccaagtgctgggattccaggcgtgagccaccacgcctggccacctccaggcctcttcttttcctccragccccatctccagtgttttcaggaaccagagcacccagcctcccagctcttacctgaccttcatccatcctttccacagatttgccgttgcctattctccagcccgagatgcaggcaacagagagatgccctctctaccccgggcaggtcctgagggctccaccagacatgcagccagcaaacaggtgggaccagatgccaggtcctccgggaaggcattggaggtgcaaatggctcggtcccatctgtctctctctctctctcatctccacttcagaaatacctggagaattacctca

SEQ ID NO: 143871 - DNA, 601 bp, Human
actccccggttcaagtgattcttctgcctcagcctcctgagtagctaggattacaggcatatgccaccatgtccagctaatttttgtatttttagtagagccagggtttcaccatgttggccaggatggtctcgatctcctgacttcgtgatctgcccacctcggcctcccaaagtgctgggattacaggcttgagccactgcacctggctataaacttctaaaacagccaaaaccaatccacagtgatggaaatcagatcagcagttgcctgtggcagggtatggggaaatgattgcctrtagtggggcacacgagggaacattccaggacgataaaaatgtcctatattttgataggactggtgattgcgtgggaacatacacttgctgatcctcatggaactatacaagataaagaaaatgcagaacagtccaggcacagaagacagaaatagctcagggtgtttgggaaccaccaggacatattgttgttactgagtgaggaggagcagtcagaggagaagctgggagtcagtggcacctgatctcacagggtcccatgtgctaatatcacaggcacacagggcagtcatggaagga

SEQ ID NO: 143872 - DNA, 601 bp, Human
atcctcatggaactatacaagataaagaaaatgcagaacagtccaggcacagaagacagaaatagctcagggtgtttgggaaccaccaggacatattgttgttactgagtgaggaggagcagtcagaggagaagctgggagtcagtggcacctgatctcacagggtcccatgtgctaatatcacaggcacacagggcagtcatggaaggaagttttgtttgttcgtttgttttgttttggtttggtttggtttttgagatggagtctggctctgtcgcccaagctggagtgcagtggcgcrataccagctcactgcagtctctgccccctgggttcaagcgattctcctgcctcggcctcctgagtagctgggattacaggcgtgcaccactatgctcagctgatttttgtatttttagtagagataggatttcaccatgttggccaggctggtcacgaactcctgaccttaagtgatccacccgcttcggcttcccaaagggctgggattacaggcatgagccaccttgcccagccttcctgcatattttcacatgtgcatgcacgtgttacttttgtttcaacataaatgagatcatgc

SEQ ID NO: 143873 - DNA, 601 bp, Human
taaacccaccctcatgaaccctccatgcctgctccaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccaggtaatccccctgaggccttcctgagcacccccaaactcagataagctcaatcaacaccatttcccagctccagccttaccccctcagtcattscaggccctgccaacctcagggttcctcagactttctgggactccaagaacccactttgaaagtgctgtaactggccgggagccatggcttatgcctgtaatcccagcactttgggaggccaaggcgggtggatcacctgaggtctggagttcgagaccagcctgaccgacatggtgaaaccctgtctctactaaaaatgcaaaaaattagctgggcatggtggcagttgcctgtcattgaagctactcgggaggctgaggcaggagaatcacttgaacccaggaggcggaggttgcagtg

SEQ ID NO: 143874 - DNA, 601 bp, Human
tttcagtgctcctctctttggccctggctctgtacagccccatgacttccccttgcccctggcttgggtgtgttccccctacagcctcccaccccgcgcccagactcaccagccaccccagacctctctcacaaccaattcttctggctgggcaaggactacagcaatcttatcaccaaggactgggtgcagctggaccggcctttcgaaggtgaagcctcccacccgccaaagccccagagagctgagagcagggtcagaagctggggctggtactgagagtgggatgagaggggtcaasggtggtacagccctccctctggcaggctctttctccctgccccaagtgtcccaaggagtccagccctgacatctcccctgactctcctgggaccccccagatttcattgacagggagacgacccctcggatgccatggcgggacgttggggtggtcgtccatggcctaccggcccgggaccttgcccggcacttcatccagcgctggaacttcaccaaggtgttcattccctccgataggggctggaggtagggagggagccagggcagattggcacctcctgctgactctgccatccct

SEQ ID NO: 143875 - DNA, 601 bp, Human
aaaaaatcttttttttttgagacggagttttgctcttgttgcccaggctggagtgcaatggcgagatctcagctcactgcaacctctgccctgggttcaagcgattctcctgcctcagcctcccgagtagctgggattacaggcatgcgccaccacgcccagctaattttgtatttttagtagagatggggtttcgccgtgttggtcaggctggtctcgaactcccgacctcaggtgatccacccacttcagcattccaaagtgctgggattacaggcgtgagccactgcacctggccacraaaaagaaatcttttttgttgttgttgttgttgttgttgagacacggtttcactcttgtcgcccaggctggagtgcaatggcacgatcctggctcactgcaacctccgcctcctgggttcaagcaattcttctgcctcagcctccggagtagctgggattacaggcgcccaccaccacgcccagctaatttttgtatttttagtagagacagggtttcgctgtgttggccaggctgatcttgaactcctgacctcaggcttcggcctcccaaagtgctgggattacaggcatgaaccacc

SEQ ID NO: 143876 - DNA, 601 bp, Human
gctgggattacaggcgtgagccactgcacctggccacgaaaaagaaatcttttttgttgttgttgttgttgttgttgagacacggtttcactcttgtcgcccaggctggagtgcaatggcacgatcctggctcactgcaacctccgcctcctgggttcaagcaattcttctgcctcagcctccggagtagctgggattacaggcgcccaccaccacgcccagctaatttttgtatttttagtagagacagggtttcgctgtgttggccaggctgatcttgaactcctgacctcaggcttcrgcctcccaaagtgctgggattacaggcatgaaccaccgcccctggccaaaaaaaaaaaaaaatcttttttttttttctttttttttgagagggagtctcactgtcgcccaggctggagtgcagtggcgcgatctcggctcactgcaggctccgccgcccagggttcatgccattctcctgcctcagcctcccgagtagctgggactacaggcacccgccacctcgcccggctaattttttgtatttttagtagagacggggtttcaccgtgttagccaggatggtctagatctcttgacc

SEQ ID NO: 143877 - DNA, 601 bp, Human
ttacaggcatgaaccaccgcccctggccaaaaaaaaaaaaaaatcttttttttttttctttttttttgagagggagtctcactgtcgcccaggctggagtgcagtggcgcgatctcggctcactgcaggctccgccgcccagggttcatgccattctcctgcctcagcctcccgagtagctgggactacaggcacccgccacctcgcccggctaattttttgtatttttagtagagacggggtttcaccgtgttagccaggatggtctagatctcttgacctcgtgatctgcccgcctccrcctcccaaagtgctgggattacaggcatgagccaccacgcccggccaaaaaaaaaaaacttttgtgttttgtttgtttgtttgttttctttttgagacggagtcgctctgtcacccacgctggagtgcagtggcgcgatctcggctcactgcaagctccgcctcccgggttcataccattctcctgcctcagcctcccgagtagctgggattacaggcgcccgccaccatgcccagctaattttttgtatttttagtatagatggggtttcaccgtgttagccaggatggtctcgatctc

SEQ ID NO: 143878 - DNA, 601 bp, Human
tgttttctttttgagacggagtcgctctgtcacccacgctggagtgcagtggcgcgatctcggctcactgcaagctccgcctcccgggttcataccattctcctgcctcagcctcccgagtagctgggattacaggcgcccgccaccatgcccagctaattttttgtatttttagtatagatggggtttcaccgtgttagccaggatggtctcgatctcctgacctcgtgatccgcccatctcagcctcccaaagtgctgggattacaggcatgagccaccgtgcccggccaaaaaaaaaatcttttaaaagtaatttttttcacaggttctgaggattggggaaagaacagaaaaagaagaaaatttaaaataaaaataattttttaaagcatcaaggtagtcatcaaagtcaagacaaatcagaactctgttggcttcttttacacttattttactattttatattgcatttattttgtttttgtttgtttgtttgttttgagatagggtcttgctctgtcacccagctagagttcagtggcgttaccacggctcactgcaacctcgacttcgccagctgaagtgatcctcccacttca

SEQ ID NO: 143879 - DNA, 601 bp, Human
acaggttctgaggattggggaaagaacagaaaaagaagaaaatttaaaataaaaataattttttaaagcatcaaggtagtcatcaaagtcaagacaaatcagaactctgttggcttcttttacacttattttactattttatattgcatttattttgtttttgtttgtttgtttgttttgagatagggtcttgctctgtcacccagctagagttcagtggcgttaccacggctcactgcaacctcgacttcgccagctgaagtgatcctcccacttcagcctcccaagtagctgggactayaggcacatgccaccgtgcctggctaatttttgtatttttttgtagagatggggttttgccatattgcccaggctggtcttgaattcctgagctcaagcaatccacctgcctcatcctcccaaagtgctgggaatacaggcgtgagccaccgcacccagccaattttgaattacctgagtagggacaatgtaacttttctggtactcaggttctctaaggatcttaatctggccctgctgggacccctttctcctatagtgtgattcttggagcaaatacccggccagacttggatctccg

SEQ ID NO: 143880 - DNA, 601 bp, Human
tgttggcttcttttacacttattttactattttatattgcatttattttgtttttgtttgtttgtttgttttgagatagggtcttgctctgtcacccagctagagttcagtggcgttaccacggctcactgcaacctcgacttcgccagctgaagtgatcctcccacttcagcctcccaagtagctgggactataggcacatgccaccgtgcctggctaatttttgtatttttttgtagagatggggttttgccatattgcccaggctggtcttgaattcctgagctcaagcaatccacckgcctcatcctcccaaagtgctgggaatacaggcgtgagccaccgcacccagccaattttgaattacctgagtagggacaatgtaacttttctggtactcaggttctctaaggatcttaatctggccctgctgggacccctttctcctatagtgtgattcttggagcaaatacccggccagacttggatctccgagaccccatctgtgatgacttcttccagttgtggcaagacatggctgagagcaacgccaatatctatgagcaggtgggaacttgggaggggtgggggagagtggcct

SEQ ID NO: 143881 - DNA, 601 bp, Human
cttcttttacacttattttactattttatattgcatttattttgtttttgtttgtttgtttgttttgagatagggtcttgctctgtcacccagctagagttcagtggcgttaccacggctcactgcaacctcgacttcgccagctgaagtgatcctcccacttcagcctcccaagtagctgggactataggcacatgccaccgtgcctggctaatttttgtatttttttgtagagatggggttttgccatattgcccaggctggtcttgaattcctgagctcaagcaatccacctgcctcrtcctcccaaagtgctgggaatacaggcgtgagccaccgcacccagccaattttgaattacctgagtagggacaatgtaacttttctggtactcaggttctctaaggatcttaatctggccctgctgggacccctttctcctatagtgtgattcttggagcaaatacccggccagacttggatctccgagaccccatctgtgatgacttcttccagttgtggcaagacatggctgagagcaacgccaatatctatgagcaggtgggaacttgggaggggtgggggagagtggcctggggaa

SEQ ID NO: 143882 - DNA, 601 bp, Human
gtgtggctgggaggctgaggcaggagaatctcttgaactcaggagacagagatttcagtgagccgagatcacgccattgcactccagccacctgggcaacaagagcaaaactctgtctcaaaaaaaaaaagtacaaaagttagccgggcatggtggtgggcacctgtaatcccagctactcaggaggcagaggcaggagaatcacttgaacccgagaggtggagattgtagtgagccgagatcgcaccattgcactccagcctgggcaaaaagagtgaaactccgtctcaaaaaaaaaaaragagagagagttagtggcccagggtcaacggggggtatggagagatggtatgggggaaggggtctagcctagttggacttagattgttgggagagtctccccaagccttactggcgtccatgcccccgcccacagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgag

SEQ ID NO: 143883 - DNA, 601 bp, Human
aaaaaaaaagtacaaaagttagccgggcatggtggtgggcacctgtaatcccagctactcaggaggcagaggcaggagaatcacttgaacccgagaggtggagattgtagtgagccgagatcgcaccattgcactccagcctgggcaaaaagagtgaaactccgtctcaaaaaaaaaaagagagagagagttagtggcccagggtcaacggggggtatggagagatggtatgggggaaggggtctagcctagttggacttagattgttgggagagtctccccaagccttactggcgtccaygcccccgcccacagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgc

SEQ ID NO: 143884 - DNA, 601 bp, Human
gaggcagctcagtgggggcgggtcctaggaagccaaaattagctttggtggctggagggggtggggaatgttaaaggggagagaagagtcaggacagtggtgaggagtgggatgcttggattccaggggctggttggggtatgggcagggactgggaatacctgaccttgactttccttcctttaccctctcctgcccctcagccatcatcaatcctaaacagagcaaggatgcccccaaaagcttcacctttgactactcctactggtcacacacttcggtgggttgttgggctgggggragagcaaggcagtgagagacagaggatttaggtcctggggaggggacatgttaagaaataggacccccaggggattagtcagggtgaattgggaggatgatcctgggtgggggtggtaggacccttaggctgtgattgaggcctcgacaggaaggcggaatcccttggggtaattaggactagcaggggctggataggatccttggggtggtaaggacaatgatgagggtgggagggcacacaggacatttggggaatcgtcagtgatggaagcaagactcttgggacagagacacaaag

SEQ ID NO: 143885 - DNA, 601 bp, Human
ggttgactgcaagctggacaaccctctggggtgggagggtcttcgcccctatcagaggcaacgagcctcagtgagtagagcagggctttggcatcagtgagccttgggttcgagcgccagttttacgacttactactgttttacttggtttcataataatttgtgagtatagttctcctgcaggcttgtgtaccaccagcagagtgttaactgtagaaacgccaattgggataacggagttaaccataattgtccctggctgtccagcatagcaacctggcacacgggcttgggagtcagractcctggggtttgcaccctggctggctgaacggtagcctgtgatcttgggcaagtggggacctctctgaggttgttttcccatctgtgaaatgggaataacccctccctcaaggctgtagcaagggttaaatggggtcacttgggactgggcctggcctgtggctggacactttaggtgtgccctgaacaggagcttctctgtatttccctgtgtccccctccagctctgtgaggacctcttctctcgcgttagtgagaaccagagtgctcagctatcctactctgtggaggtaagccc

SEQ ID NO: 143886 - DNA, 601 bp, Human
gtgcccatttaccatggctgcagtaggagggctccttgcctggtaggaggctgaccagcagtcttctgtagtccttacagactggtcctctgtgaagctcttggtctcctggatgtctctcatcagctccttctttccttagcctcattctttttcctctttctccctcccaggcctgaagacggaagaagggagtgtcagaggcgccctgccagctgtgtcatctcccccagctccagtttcaccctcatcacccaccacacataatggggagctggagccgtcattctcccccaacacrgagtcccagattgggcctgaggaagccatggagaggctgcaggtgggaagctggagctggcaagggctgggggtctgggcattcctgggagtttacttctccaaagtcaagcttgagaaagaaggaattctaggagtagcatggccccagggtaggttgtccctaccctgggtctgcttgtcccagaccatcctgaaacctacccaccttacgcccccaggagacagagaagattatagctgagctgaacgagacatgggaggagaagctacgcaagacagaagccctgaggatggagag

SEQ ID NO: 143887 - DNA, 601 bp, Human
gcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgctggaggaggaggaaagagaaaggaggctaggatccaggtgtcacaattccaccccctgccagctgttcagcagctgtccagccctgggggytgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatgccacctccaggttctaacaaaagaactcaaacgatgaactcgatgattcaggaccccaacaatctacctatactcctagaaaacagtttctaatccgagc

SEQ ID NO: 143888 - DNA, 601 bp, Human
cccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcargactagcgctggaggaggaggaaagagaaaggaggctaggatccaggtgtcacaattccaccccctgccagctgttcagcagctgtccagccctgggggctgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatg

SEQ ID NO: 143889 - DNA, 601 bp, Human
ctccaggcttgttttcctctggacctgggaaccactggcttactttcactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtgagaaggctggcaggggagcccgggccagctggctgggtgccacctaaggggttctgaacaggagggagagggagagaggaataagaatggttgcttgggagaggatggcaatggcttcgtgggggctagcagccctctggagtcagtcctggaggagccccagggtcccaagctgaatgtctgtggggcacagaaaggacgagagcctcactgctctaaagagctcccctaccgggtagggagcatgtcctgcctgtcctccctgtccccactgttgagcagatgctgggaaaacctcactacaatggtcgaggcagaaggagcagctggttgtcagagacgt

SEQ ID NO: 143890 - DNA, 601 bp, Human
gcagctggttgtcagagacgtcatcggggcaggataataacaggcatgagggtggggcgcagtgaaattacccagagccagggactgccctcacggatcagtcaccctcgcttgcctccacgtccattcactctcaccccacatttctggaagcccaatctgtgcggactgctaaggataaactcagaacttaggtcagtatggcagggaggatgccctcaagtcgtcttccgggagatgagaatctatttgccaggggcggaggtgggggttggtttttgtgtttgttttttgttttttkttttttttgagacagggtctctctctgttgcccaggctggagtgtggtggtgcgaacatggctcactgtagccccaacctcctgggcccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcc

SEQ ID NO: 143891 - DNA, 601 bp, Human
ccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggcyaggctggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccac

SEQ ID NO: 143892 - DNA, 601 bp, Human
cccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcraactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaa

SEQ ID NO: 143893 - DNA, 601 bp, Human
ggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcgaactcctgacctcaggtgatccgcccccctcrgcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatctt

SEQ ID NO: 143894 - DNA, 601 bp, Human
ggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattyagggaaactttgggatggtcaacctcgtttaatatcttcatgcgataaagacaaaagatctacccagcacagttccccacttctcaggacagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctc

SEQ ID NO: 143895 - DNA, 601 bp, Human
ttttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatcttcatgcgataaagacaaaagatctacccagcacagttccccacttctcaggwcagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctctttgagagtcacactcctctcaggctgacacacttagccattgtcacggggtgctccctctgcaacctgaaccacccctgtctccccac

SEQ ID NO: 143896 - DNA, 601 bp, Human
gtactctactctatcgctctaaactcaactctctttgagagtcacactcctctcaggctgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcrggccaatcacctgaggtcaggagttcaagaccagcctggccaacatggtgaaaccccgtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagct

SEQ ID NO: 143897 - DNA, 601 bp, Human
tgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcgggccaatcacctgaggtcaggagttcaagaccagcctggccaacatggtgaaaccccrtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgag

SEQ ID NO: 143898 - DNA, 601 bp, Human
gtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgaragcaagcactgcctgctttgttggccactatgtacccagtgctagaccagcaccttgcactaaacagacacccaattaatagtcatggaatggcagcgtgtgcctgtagtcctagtttgggcccagaaatgaaagattgcagtgagctatgaccacgcgccactgcactccagcctgggcaacagagcaagaccttgtctcaagaaaataaaaaataaaaaagtcattgaatgaagtatagaactaggcaaggcaatttcagatagaagtaggtaccatcggccgggcgcagtggctcat

SEQ ID NO: 143899 - DNA, 601 bp, Human
gtcccagctactcaggaagctgaggcaggagaattgcttgaacccgagaggcggaggttgcagtgaaccaagattgcaccattgtactccagcctgggcaacaagagtgaaactctgtctcaaaagtaaaaaataaaaataaaatgaaatggtgctggcatgaagagctcctaggcaaagcagatgccactttttataggattttcagggacaggctctatgaggtgatgtctgaactgagacccaaatgacaagaagaaggtgtgagtgttgcagacactaggggctggtagtacaaagcctaaggtgggaacaagctctacacttctgaggatcagacaggtggccggtgaggtgagatgtaatgagatgaggtctgaggagggcagaggctaggcctggaacaccctgaaaagccacagtggagtcatttgaatttttattattataagtacaacagaaaactattgaaggacttttttttttttttgagacggaatctcactgtgtcgcccgggctgcagtgcagtggtgcgatctcggttcactacaagctccacctcttgggttcacgccattctcctgcctcagcctcccgagt

SEQ ID NO: 143900 - DNA, 601 bp, Human
atacagaaaaagaccaaactgagctgggcgtggggcctcaagcctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcacggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactt

SEQ ID NO: 143901 - DNA, 601 bp, Human
cctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcayggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactttgggaggtggaggcaggagaatcgcttgagtcccagcattca

SEQ ID NO: 143902 - DNA, 601 bp, Human
caaaaggcaattctaggtgtgtttggatccacaagcctccagtaagtgacctaaccagggaggtaaagtaaggtgtcagcatgggtcctggccctgccatgagacaggaagaagagagagcaggtgtttctctgaggttgctggggatgatataatagaactgaaactctcagccctttccctggagaagcacaaaatgctgccttggatggtatgtgccagataagacacatgaggagccaggcacagtggctcatgcctgtaatcccagcaatttgggaggctgaagcaggaggattgsttgagcccaggagttcgagatcagctaggcaacatggtaagacatgaactctccaaaaaaattagccaggcatgttgttccgcacctttagtcccagctactcgggaggccgaggtgagaagatcatttgagcccaggaggttgaggatgcagtgagccatgattgcaccactgcattccagcctggatgacagagtgagatcctgtctcaaaaagcaaacacacacacacacgaaagcaagaagcaagacagctgtggaattccagagataggagacaggcaaagaacctgacctggtg

SEQ ID NO: 143903 - DNA, 601 bp, Human
cagcctcccaagtagctgggattacaggcgcctgccaccacacccagctaatttttatatttttagtagagacggggtttcactgttggccagagtggtctgaaactcctggcctcaggcgatctgccccccttggcctcccaaagtgctgggattacaggtgtgagatatcgtgcccagcctcgagtcaggtttaaaataaatttcccttcaaaccccgggcttgcagttaggctaacctgaaagccagcggccgccgagattcactggggttgtagttcccccctctccccttcacccrcctacccctcaggatcattgagatctgagatttgtgggtgccagggaagggtggggtggggcctgggagtccgcagaggagcttgtgtagctaggaattccatagagagtgctgtggttctgcaaggacaggtgcagaaacagagtccgaatttctaatttttttttttttttttctttttgagacggggtctggctctgtcgcccaggctggagtgcagtggtgcgatctcggctcattgcaacctccgcctcccatgttcaagctattctcctgcctcagcctcgggcatgtgccacc

SEQ ID NO: 143904 - DNA, 601 bp, Human
ggaattccatagagagtgctgtggttctgcaaggacaggtgcagaaacagagtccgaatttctaatttttttttttttttttctttttgagacggggtctggctctgtcgcccaggctggagtgcagtggtgcgatctcggctcattgcaacctccgcctcccatgttcaagctattctcctgcctcagcctcgggcatgtgccaccacacccggctaatttttgtattttcagtaaagacaaggtttctccatgttggccaggctggtcttgaactctcgacctcaggagatccacccgmctcagcctcccaaagtgctgagattacaggggtgagccaccgcgcccggcattaaaaaatacattttaacaacccgactggagcagatttcgataatgcgtgggggctggcgctgagcgtcgtcacccacaggtggggagattgggccttacctccccttccacaccacatccagatgctgcgctcggtcttctcctcggcgttcggggtgcttggtgccatctactgcctctcggtgtctggagctgggctccgaaatggacccagatgcttaatgaacggcgagtggggctaccactt

SEQ ID NO: 143905 - DNA, 601 bp, Human
ctgccttctcccacgtggcctcacccctcccacaggggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggtgaaatggcttgcggtggagttgtagagggaacctgcctggtcctggctgcgttctcaccttctcttttccgcaggacacmcctcactgaggctccactgaccgccgggttacacctgctccttcctggacgcctacctgctcgctcactcccttgctcgctagaataaactgctttgcgctctcttctctgtctgagattgtgccttctgtaaggaggagtgtgcgagaggctacggatacacctggcctttggggcccctgcaccccacttgtactttcttaacgaatagatactgagctatttggttgcgctggaaataaggacggtaaacaagacagacaagttttattctctcaaagaacttggcattccaagagt

SEQ ID NO: 143906 - DNA, 601 bp, Human
gctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggtgaaatggcttgcggtggagttgtagagggaacctgcctggtcctggctgcgttctcaccttctcttttccgcaggacacacctcactgaggctccactgaccgccgggttacacctgctccttcctggacgcctacctgctcgctcactcccttgctcgctagaataaactgctttgcgctctcttctctgtctgagattgtgccttctgtaaggaggagtgtgcgagaggctacggatacacctggcctttggggcccctgcaccccacttgtactttcttaacgaatagatactgagctatttggttgcgctggaaataaggacggtaaacaagacagacaagttttattctctcaaagaacttggcattccaagagtggaagataggcaatttttaaaagaagcaaaaaattatttcaataggt

SEQ ID NO: 143907 - DNA, 601 bp, Human
ggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggtctcaggtgctagttattgcttatatgactttgggcaagttaatctctctgagccttagtttgttttactgtaaaatgggatattagaagttttcctagggttattgtgaagatcaaagtagatacgcaattttggtagtayttcatcccaaagactgccacatagcaagaactcagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactcc

SEQ ID NO: 143908 - DNA, 601 bp, Human
agaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctraatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccaatcctttaggtggggtggggccaa

SEQ ID NO: 143909 - DNA, 601 bp, Human
gcaactttgacctcaaggttgctgaatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccartcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaaggggtaggacatgtgcctccttcccattcttccttcagcaagcagttccatgccaacctggagcccaggcctcctcattacccgaaccattcagcctcctgtccttccttcc

SEQ ID NO: 143910 - DNA, 601 bp, Human
gaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggacagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccact

SEQ ID NO: 143911 - DNA, 601 bp, Human
gaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgyttttatgcataaatacaacgaagacgggagaggagatggaaagcaaagatgattaagtgaaataattgtgggaaacaatagagggacagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttccctt

SEQ ID NO: 143912 - DNA, 601 bp, Human
tgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggayagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttcccttcttacctctgcttctctttgcttgtcccttctagccctaaattcttccatgttctgccctgaccttatcctgcctacctgtcttatc

SEQ ID NO: 143913 - DNA, 601 bp, Human
gagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggrgctggggcaagcagagggactgggtcttcacttcttgggctaataaaattgtttctttgtggactaaggaagggtaagatcattctcacacaggtgaacttaaccctttggtggaatcacccctttagccataaggagcaagggaatgctgagagacactaacctatagtcatggggacagccccagccggcatttgctatgactcagaagggggagccccacccacaaggatgactcaactagccctgccttgcctgcaggcctgcacccattctctggtccagatggctctattccat

SEQ ID NO: 143914 - DNA, 601 bp, Human
agaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaartacatacttcttcattcggagagacaaaacaagaactagagttttaatgataataaaagcaataataataaaagcaataacaataaaaacaagatcagactctcactggggtaggcaagggactgaggaggtgaaaccaacccgtatggtgtcccagcacggcacctgctaaggagggagggtgggaaagcccaggccttcgttgcgggtacaggaggatgcaggagagggctgaggtgggggaggaacaactggtgtactgggagagagatttgggacgagggggaaccatcagcaaaa

SEQ ID NO: 143915 - DNA, 601 bp, Human
aggcctgagggggatcagaaaaaccggtgtcggggttctcgcagggatgtggggccagactactgggctctcccgtgcaggctgcgatgcagggatggaggaaggaggagcaggtggctggccccgaggggtcgtgtacggggaggctggatgccgggacgggggggatccactccagactcgcgccaagccaatggaaagcctcctatccaatatcccccaggtagtcgcgctgcccacacctgtcccgagggccgggtggctcctcacccaaacttctaccttcccttgggttgccagragcaacagcttcatcttgggggagccgagtgcgtggcgaccctccctgaaactagatcgtatccctctctctgggggtgggggaggcagtattcaccctgggcgcgcgtccactccccggatgttttctgtgcaatcgaggctctttccttccactgataccccgagttctcttttttggtctctagcaaaatccacttcctgttgtgactcaacacccccaaggggcaaggggtggatgcctgagtcgcaggggagcgggagcaaaagacgaaaaggttggggctgtaggcctcaactc

SEQ ID NO: 143916 - DNA, 601 bp, Human
actactgggctctcccgtgcaggctgcgatgcagggatggaggaaggaggagcaggtggctggccccgaggggtcgtgtacggggaggctggatgccgggacgggggggatccactccagactcgcgccaagccaatggaaagcctcctatccaatatcccccaggtagtcgcgctgcccacacctgtcccgagggccgggtggctcctcacccaaacttctaccttcccttgggttgccaggagcaacagcttcatcttgggggagccgagtgcgtggcgaccctccctgaaactagatygtatccctctctctgggggtgggggaggcagtattcaccctgggcgcgcgtccactccccggatgttttctgtgcaatcgaggctctttccttccactgataccccgagttctcttttttggtctctagcaaaatccacttcctgttgtgactcaacacccccaaggggcaaggggtggatgcctgagtcgcaggggagcgggagcaaaagacgaaaaggttggggctgtaggcctcaactcagagggtatcaggaatagggaattggtcctgagctctggcttgctctgcaaaacatca

SEQ ID NO: 143917 - DNA, 601 bp, Human
ttccttaccctcccagcaatgggtggagtccaggcttaaattgtttcagcaactggaaagcaaataaccttcaattcaacaaactatttatgccaactgcagagacagatagtgtaatattgatcgagaggatggactcggagccagactgccttggtttctattaattcccaccatttactccctctgtgaccttgaaacacttgacctctctctgcctcagtttcctcacctgtaaaacagagatattaggagctccatcactgggtggttttatttaatttaattaattaattaattwatttattttttgagacaaagtcttgctctgtcacccaggctggagtgcagtggctcaatctcagctcactgcaacctaaggccgggcacggtggctcacgcctgtaatcccagcactttgggaggctgaggcgggtggatcacctgaggtcagaagttggagatcagcctggctaacatggggaaacctcgtctctactaaaaaaatacaaaatacaggccagacacagtgactcaagcctgtaatcccagccttctgggaggctgaggcgggcggatcactagaggtcaggagtttgag

SEQ ID NO: 143918 - DNA, 601 bp, Human
ggtggcagctgctctctagctggctggttgggctgagttctccccgaggatccaaacacacacacacacagacacacacacacacacacacacacacacacctggctggttgggctgagtcctccctgaggatgcaaacacacacacacggacacacacacacacacacggacacacacaaacacacctcgctggttgggctgagtcctccctgaggacacacacagacacacatgcacatacatgttcacacacacacctgactggttggctgaggacacacacacacacacacacacacacacacacacaacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatc

SEQ ID NO: 143919 - DNA, 601 bp, Human
tggcagctgctctctagctggctggttgggctgagttctccccgaggatccaaacacacacacacacagacacacacacacacacacacacacacacacctggctggttgggctgagtcctccctgaggatgcaaacacacacacacggacacacacacacacacacggacacacacaaacacacctcgctggttgggctgagtcctccctgaggacacacacagacacacatgcacatacatgttcacacacacacctgactggttggctgaggacacacacacacacacacacacacacacacacacaacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcac

SEQ ID NO: 143920 - DNA, 601 bp, Human
ctgctctctagctggctggttgggctgagttctccccgaggatccaaacacacacacacacagacacacacacacacacacacacacacacacctggctggttgggctgagtcctccctgaggatgcaaacacacacacacggacacacacacacacacacggacacacacaaacacacctcgctggttgggctgagtcctccctgaggacacacacagacacacatgcacatacatgttcacacacacacctgactggttggctgaggacacacacacacacacacacacacacacacacacaacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggac

SEQ ID NO: 143921 - DNA, 601 bp, Human
gctctctagctggctggttgggctgagttctccccgaggatccaaacacacacacacacagacacacacacacacacacacacacacacacctggctggttgggctgagtcctccctgaggatgcaaacacacacacacggacacacacacacacacacggacacacacaaacacacctcgctggttgggctgagtcctccctgaggacacacacagacacacatgcacatacatgttcacacacacacctgactggttggctgaggacacacacacacacacacacacacacacacacacaacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggacaa

SEQ ID NO: 143922 - DNA, 601 bp, Human
tttatgcttaggcttgctgtgaagaatggacagctgtatagacgtatgattggattggccgggcgcggtggttcacgcctgtaatcccagcactttgggaggctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcttgaacccaggaggtggaggttgcagtgagccaagattgcacaactgcaytccagcctgggcaacaagagcgaaactccatctcaaaaaaaaaaaagtatgattggacaaaaaggatatgatctaatggcaataaatggggggtgggggaccagcaaggcctgtccagattcttcttggcctccaagtatagggcaggacccctctgaaatgagagcctatgacctacttccacgtgaagttagagaattcctttatggccagctctcacagaaaaacagaaagagcagagtgagctacttacttctgctgttttcttaattaccaaggtgccatgttttggagtgtcat

SEQ ID NO: 143923 - DNA, 601 bp, Human
tacatgacataggaaccttcagaaacaaagacccgaggaaaagtgcatttttatgcttaggcttgctgtgaagaatggacagctgtatagacgtatgattggattggccgggcgcggtggttcacgcctgtaatcccagcactttgggaggctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcytgaacccaggaggtggaggttgcagtgagccaagattgcacaactgcactccagcctgggcaacaagagcgaaactccatctcaaaaaaaaaaaagtatgattggacaaaaaggatatgatctaatggcaataaatggggggtgggggaccagcaaggcctgtccagattcttcttggcctccaagtatagggcaggacccctctgaaatgagagcctatgacctacttccacgtgaagttagagaattcctttatggccagctctcacagaaaaacagaaagagcagagtgagctactt

SEQ ID NO: 143924 - DNA, 601 bp, Human
tataaccgtttttaaatgaggggcctaagagagggcagtggctggttagtcctatgttagatattaacaaatacgtgtaggctggatgtggtaggtgacgcctataatcctcgcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaarcttccattcttggctcaggtattagagtcaggtgccacaggtatataatgaaccggcagatctggaaaggataaagaaattgagagatgagctctgagatcaaggacagtgtttgggggatgagagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtg

SEQ ID NO: 143925 - DNA, 601 bp, Human
ggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcrcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaaacttccattcttggctcaggtattagagtcaggtgccacaggtatataatgaaccggcagatctggaaaggataaagaaattgagagatgagctctgagatcaaggacagtgt

SEQ ID NO: 143926 - DNA, 601 bp, Human
caggtcaggagttcgagaccagcctggtcaacatggtgaaaccccgtctctactaaaaatacaaaaaattagccgggtgtggtggtgagcacctgtagtcccagctactcaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcgcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaaac

SEQ ID NO: 143927 - DNA, 601 bp, Human
ggggaaccatcagcaaaaaatgaagccaggaatcacagtaagggcgcaagggctgaggccagttgtttccataaagaagactcaatcattacaaaaataatttttagtagttaaaaaacacacatagggccaggcatggtggctcacacctttaatcccagcactttgggaggcctgggtgggcagatcaccaggtcaggagttcgagaccagcctggtcaacatggtgaaaccccgtctctactaaaaatacaaaaaattagccgggtgtggtggtgagcacctgtagtcccagctactyaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcct

SEQ ID NO: 143928 - DNA, 601 bp, Human
tgatggggaatcagaaatgtaaatttaattatgttattttattttgtatttttaggtaagttattatgtagagcaataatttccagcagaaaactggaagtattcttgtagaacaggaatccttgtctttttcctaactaggagtcatgttgttttttttcaagtcttaagattatttaagggtgtgaacccccaatatctgtgttggaaacaagtgcttgatgtagccaaaagaaacccgcacttagacagaaattttctcagcaaggcacttttacttctgcagaagggtgctgcttgyacctattacaaatgcaagagcacaccgaacaaaggaaggaaggggtttttaaccctaacacagttcctgtttctgtatcttttccctattggctagggttggattgcacaatctaagctgatcccaactagccaaggcttaaacttttccaaacagggtaaatgtgagatttgtgaaggggcggggtgggtaaagaagaaatggttagacttaacagaagcgggggtaggattgtttacaacttatgaccaggaagttgagtctttgaagaggaactcaagtcgtcccaacaatttcccc

SEQ ID NO: 143929 - DNA, 601 bp, Human
ccagtctacgtttttgtttatagtggaccaccagaataagatagactcgaacctggcggctatttggttttgagctttgaattcatttggtaccctccgcaggaccctgatgctgtctatgtaaacttgagggtcaaaggacccatttattggggcttctttttttcttctggttacctgcttcctgatgaaatgccatggtgaaagccatggccagttgaatcagagcacaagtgccactccagttgcttggcagtgtaccaaatattggtcccccacaataccaccatacatcctctcrgggatggactagggctgactgattggttatctcttgaaaaggtttaggcccactacatcccatcaggtttccaaggaatgtcaaattttccccttgttgtgaaagacacaaggtaaaattggcatcgagagctggaagttgaatggcccttgggggctgtcccataggggtcctgacctttggggaaaatagtgagtgagtggcacatgacatgtttccccaggctgtggggtgctggaagagagctaccatacagtctttgcctgatggattggcccatccgagtgggaggggaacagt

SEQ ID NO: 143930 - DNA, 601 bp, Human
caaatatatatatttttagaaactgatcttttgtttcaaatgtgggaaggtcagtagtggaatttagataaggcagcccatagagcatttcaggccaagatcttttgtgtgtgtgtgtgtgtgtgtgtgtgtgtgtgtgtgtgtgtgtgtgtgtgtgtgtgtggcagagtcttactctgtcgcccgggctggagtgcagtgatcttggctcactgcaacctgcacctcccaggttcaagcaattctcctgccttggcctcctgagtagctgggactacaggcaccagccaccacgcccggmtaatttttgtatttttagtagagacggggtttcaccatattggccaggctggtctcgaactcctgaccttgtgatccaccctccttggcctcccaaagtgctgggattacaggtgtgagccaccacaccctgccaggccaagatctttttgaggggcagtttggattcttagtaaggcaatgggaaggcattttgtccatggtaactggatttccaagattaatttggttaggtgattttttagagtttgattaattctttctaccctccctgatgaaggtggatgccagggagtatgat

SEQ ID NO: 143931 - DNA, 601 bp, Human
tcaagcgatctcacaccttggcctcccaaagtgctaaactctttaaaataattagttttgtctagaatttttttatttagagtaggaaggaatgtttaccacccatcagctcagtgtgcccttttttcttttaagaaatcttaagcctgcagaaaaatggaaagactagaacaattaagacccatatatccttcagctagagttatcagtttttaccattttgtcccttttgcacacctttcttcccttcccacacatatactctcacatcatttaaaagttagttgcagacaacacaacrcttcttccctaaacacttcagcaggcatctcctaagagaacaagtaagggcattcccctacaaaatcagaatgccattatcacatctaagaaaatgataattaattcaatgtgtcacccaatgtatcgtccatatccaaatttcttctgagattgttctcaaaatgttaatttatgctgtgtgtgtgtatatgtgtgttttcttgatccagaatcaagtcagtgcctgacacttggttatttaatattttgtctgttctagttgagaataatcttttttcctttttttttttttaaagac

SEQ ID NO: 143932 - DNA, 601 bp, Human
aagggtgagggggaaggcaaaaaggaaaaaactcagcaaagcgagaggggttcctgttaacaggctcccatctcacagattgaatcccatgttaccacacaggaacaggagaggcaaacggagtgaacttcccaaggccccaccccgtcctcccagtgtgcagtgcgcaggtgggcatccagaaagaatcagtcaaacagggaggtgaacaacacacaccagggcctgttgcgggggtggggatcgtacttagaggatgagtcagtaggtgcagcagaccaccacagcacacatatacctrtgtaatctgcatgttctgcacatgtatcctggaacttaaaaaaaaaaaaaaaaagaatcagttggaaaagggcaggcttcatccaggatgggcaatttggtttttcagccctcatgctgttttaaacttgaaggtggggttttgctggggtacccttggctgcctcctgtctctatctgtccccttataaggggagccatcaccttttctgggggttcacataacacttgcctttgaaagtgatatttgagcaaagagatcaaatgaagaatgatgaacttaaataacctcttgaacttc

SEQ ID NO: 143933 - DNA, 601 bp, Human; identical to SEQ ID NO: 31264

SEQ ID NO: 143934 - DNA, 601 bp, Human
cagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacrctcagaaatcgggcatgcacattttgtaatgctgaattaaatagtaataaaggcaatgtaaggtgaatatatgtctggttgagttgacctaaatagcatttttgaaaacccagttctagtaaatttctatataaaaaatgatgtcactgattcttagatagtatttgtaattttttttgttgccacgatttatgctgaatcagtttttatgaagagatgagaattgaggaagtgtaaactttgtggtttctgtattgatagctacttggttaatgtaatagtttgaaataaggaagttat

SEQ ID NO: 143935 - DNA, 601 bp, Human
atttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacactcagaaatcgggcatgcacattttgtaatgctgaattaaatagtaataaaggcaatgtaaggtgaatatatgtctggttgagttgacctaaatagcatttttgaaaacccagttctagtaaatttctatataaaaaatgaygtcactgattcttagatagtatttgtaattttttttgttgccacgatttatgctgaatcagtttttatgaagagatgagaattgaggaagtgtaaactttgtggtttctgtattgatagctacttggttaatgtaatagtttgaaataaggaagttattctttcagtttaggaaatatttgtcattaacttattgcattatttattgaaaaatgcatttaaatacaaaaaataaaaataaaaattacatttaattgttgaaaaatattacacatagaatccatcctacttttttctgtga

SEQ ID NO: 143936 - DNA, 601 bp, Human
gatctcagttcactgcaacctctgcctcctgggctcaggcaattctcctgcctcagcctcctgagtagctgggaccacaggcatgcgccaacgggcctggctagtttttgtatttttagtagaggcggggtttcaccatgttggccaggctggcctggaactcctgaccttaagtgatccacttgccttggcctcccaaagtgctgggattacagacatgagccactgcgcctggccaatctactgactttctaattatgatttcatttatgtcttatctaagtttattatttgtttttgyaattcagttccaagcttgatgagggtaaggattttttctgccttgattgctgctgtatcctcagccctagaacatacgggtgctcagtagatatttgttagatgaattaaacaataagtgaatactgtttcttaatgcagcagtactttttttttttttaaatccagtgccttcaatctttagatgatggtatcaaatttagatataacgggtgtaagaactttggaaaatattttaaattagtcatgtgtattgttcctacttaagaacagattcaaaccaaaatgtttctttccctag

SEQ ID NO: 143937 - DNA, 601 bp, Human
ggctggcctggaactcctgaccttaagtgatccacttgccttggcctcccaaagtgctgggattacagacatgagccactgcgcctggccaatctactgactttctaattatgatttcatttatgtcttatctaagtttattatttgtttttgtaattcagttccaagcttgatgagggtaaggattttttctgccttgattgctgctgtatcctcagccctagaacatacgggtgctcagtagatatttgttagatgaattaaacaataagtgaatactgtttcttaatgcagcagtactttttttttttttaaatccagtgccttcaatctttagatgatggtatcaaatttagatataacgggtgtaagaactttggaaaatattttaaattagtcatgtgtattgttcctacttaagaacagattcaaaccaaaatgtttctttccctagtttcttatgtactgatgggaatgaatagatatgagagtagtaagtagctgctttagaatattacatggcaattcacagtttccctcatactttgcatgaaaatctgtcttgccttgtaattgatattgtgattttagccatctggca

SEQ ID NO: 143938 - DNA, 601 bp, Human
tgtaggacccgtctgtgctactacctgtctacctatttccatgtatttgttcttttttaaaacaatttaaaaaaacttttagctggatgcagtggctcatgcctgtaatctcagcactttgggaggctgaggcaagtggatagcttgagatcatgagttcgagaccagcctggccaatatggtgaaacctcatctctgctaaaaatacaaaaattagctgggcgtggtggcaggggcctgtaatgccagctactcaggaggctgaggcacgagaattatttgaacccaggaggcagaggtwgcagtgagccgagatcgagatcacgccactgcactccagcctgggtgacagagagagactctgtctcaaaaaaaaaaaaaattatgacatattatttgttctttcattcagtgagcatttacttattgcttggtattctgttttttactaaagagaagcaaaaagaaaaaaaaaaaggaaaagaatgggcctcctggtaaaacataccactcatgttactgtagatgacttaaagatataaaatgagaaatgaacagttacaaagctgcagatgctctgcagtgggaagcagatagattg

SEQ ID NO: 143939 - DNA, 601 bp, Human
gtacctttgtgtctacacatttcatccatgtcgtagcatgtattagtcagaaggacagaaccaataggatgtggagatatatagatatatatatatgactttaataggtaggatatatgtatatatacgagagtttattagggagaatcaactcacatggttagaaggtgaattcccacaataatctattggcaacctcgggaaagagaagctagtggtagggctcagcccaagtttgaaagcctcaaaagcaggaaaaccaacagtgcagccctcaatctgaggcctaaggcctgagagmcccccagaaggctgctagtgcaagtcttagaatccagagcccaaagaacctggagtctgatgtacatgggcaggaggagaggatataagcatctggcaaggaaaaagagaaagcaagcaggaagactcagcaagcaggcttatctttgcttcttctgcctgctttgttttagtgcactggcagctgattgtatggtgcccacccccattgagagtgggtcttcttctcccagtccactgactcaaatgtcagtctcctctggcagtaccctcacagagacacccagaaacaataccagcc

SEQ ID NO: 143940 - DNA, 601 bp, Human
tgggcttttttctattccattggtctttatgtctgtctttaatgtcagtaccacatggttttgattaccatagcttcatagtaagttttgaaaacatggaatgtgagtcctctggggttgtagtttgtcaggattattttggctattctggatcccttgagattcaatttgaatttgagaatggatttttctgtttctgcagaaaacatggttagggttttgatagagattgcgttgaatctgtagatcactatgggcattgttgacatcttaataataagccttctagtccatgaacatrgaatgtttttccatttatttgtatgttctttaatttcttttagcaatcttttgtcttttgtagttttcactgtacagtattttacctccttggttaagttaatttctaggtattttattctttttgatgctattgtaaatggaattgtttccttgatttcatttttggataattcattattagtatgtagaaatgcaatggacttttttgttgatttttgtatcctgaaactttgccgcatttattagctctaacagtttttgtgtgtttgcggggaatctttaaggttttctaaatgta

SEQ ID NO: 143941 - DNA, 601 bp, Human
ggtgtcattctgtcacccaggcttgagtgcactgccatgatctcagctcaccgcatcctcaacctcctgggctcaaggtatcctcccacctcagcctcccaagtagctgggactaacaggcgtgcactaccacacctggctaatttttttttatttttagtagacatgaggtctactgtgttgcccaggctggttctgaatgtctaggcacaagcgatctgcctgtcttggcctcccaaagtgctaggattacaagtgtgagtcaccatgcttggccagttttcagtcgtttttgttgtttttgttgttgttgttgttgtttgtttgtttgttttttgtttttcttttttgagatggagtctcgctctgtcacccaggctggagtgcagtggcgcgatcttggctcactgcaacctctgcctctcgggttcaagcaattcttcttcttcagcctcctgagtagttgggattacaggcacatgccaccatgcctggctaatttttgtatttttagtagagacagggtttcaccatgttggccaggctagctttcggtcttttaccagtgcatatgatgttggctctgggtttttaatatatg

SEQ ID NO: 143942 - DNA, 601 bp, Human
atatgagacaaattaaaatatacacactggtagaagagagcgccattggtaaatttcctagatgtacaactatagatttcatgatgtattgttcaataaggtgactttaaaatgatatggaagtcattaaacgtatctttgttttatcctgtctttaaatagtatatcagttacctttattgaaaaaaacatcagttatttgcaactttatatatatttaaaaatattttattgtaattttgataaatttgggtcatattatctttaacatgtaataaagctcacatattttacattactaaaaaaaaaaaaaaaaagccatatgtgtggctgggcgtggtggctcacacctgtaaatcctagcactctgggaggccgaggcaggcagatcgcttgagcccaggagttcaagagcagtgtgggcaacatggcaagacctcatctctgccaaacaaaaggggacgtatgttccaattttttgagctaatgattccttttttgagtaaataattcttaaaacaagtgcagtaaacaaaaagatgtgtattttagtgttactaaatagcaaatacatttaaagtaatttgtgtccaaaattgga

SEQ ID NO: 143943 - DNA, 601 bp, Human
acagatatgtctgaaggaaacatatttttaaaaagtaattttagagccaggcacggtgggtcatgcctgtaatcccagcactatgggaggctgaggcgggcggatcaccagaggtcgggagttcaagaccagcctgaccgacctatggagaaaccctgactctactaaaaatacaaaattagccgggcatggtggcacatgcctgtagtcccggctactcagggggctgaggcaggagaatcgcttgaacctgggaggcggcggttgcggtgagccgagatcgcaccattgcactccagcytgggcaacaagagcaaaaccatctcaaaaaaaaaaaaaaaaaagtaattttaggctggatgcagtggctcatgcctgtaatcccagcactttgggaggccgaggcaggtgaatcacctgaggtcaggagttcaagactagcttgggcaacgtggcaaaactccatctttattaaaaatactaaaattagctgggtattgcggcgcgtacctgtagtctcagttacttgggaggtcgcagtgagccgagattgcatcactgcactctagtctgggtaacagagagagactctgactcaaaa

SEQ ID NO: 143944 - DNA, 601 bp, Human
tttttgagacagttttgctcttgtcgctcaggctggagtgcagtggcacaacctcagctcactgcaacctctgcttcccttcccaggtttaagcaattttccttgcctcagcctctcaagtagctgggattacaggcatgtgccaccacgctcagcagatttgtatatttttagtagagatggggtttcaccatgttggctgggctggtacagcctcagttggatataatattgaaagtctgaattagagatctcttttaaccctttctgtaatggacacttaaaatgactctgataattattattgttttctattaataacagtgaagtttaaacaggtgtttagacagaggcaagggtctggatttgtttgaactgctttagatcttatgatactgatttttgctatgtgctaataagtggagggataaagtactcctgcatttgacaatttttataagttgttactttcactggtctttgtgaacagctggacactggtcagttctatgcactctcctctcctgtttttattattctcacatcacagttatttttgtcataattatagggctttttgaagacctgggacatcattttt

SEQ ID NO: 143945 - DNA, 601 bp, Human
atacatttatttatgcaataactttacttttcaaggaagcaataagcaaatatttactgagtactatgtttcagacacaatattgaagataccagtattaaaaataatttagctcattattccatggagtttacattctagtgtggggaaatggagaataagttcaatcagtgcagtagattgtgttgtgataaagatatatggcatatggtaagatatttcagcagtataatttaagttcaggtgtgcaaatatgtaattttcttaatttttagaactgactttacttttttactctaarcctgtagcttagagaactggggaaggtacttagatggtatatggaatatagtggggtatttttagttgtcagaatgactgaggttgctactggcatttagcaacctgtgcataccaagactgctaaacatcttgctatgcccaggacagtactgtcctatgaagaactggcccacctaaaatgccaagagtgcccctgttgagaagcactgactaacctggctcatggtagacaatttcatcttgatctttttaggcaaaattgactattatccagtaatttcaaattcaggattattta

SEQ ID NO: 143946 - DNA, 601 bp, Human
tatgtatacctgtgtccatatttgcctcttttataagggtatcagtcatgttggattaggagactaccctaatcacttcattttgattacctctgtagagaccctatcttcaaataaggtcacattctaaggtgttaggagttaagacttcagcttaagtatttgtgggggatacagttcaacccataaaagcaactaatttttttaaatttttttctaatttaaaaagtacagaaaaaactaatcaaaataaaataaaaatatcccaatacaacatttaaaaaattatataaagtaaaargagagaaaagatagccagctgtggtggctcatgcctgtaatcccagcactttgggaggcccaggcgggcagatcacttgaggtcagaagttcgagaccagcctggccaacatggcgaaaccctgtctctactaaaaaaaaaaaaaaaaaaaaaaatcgctgggcatggtggtgcacacctgtaatcccagctgttcaggaggctgaagcaccagaatcgcttgaacctgggaggaagaggttgcagtgagctgaaatggtgccactgcactccagcctgggcgacacagcaagactgtgt

SEQ ID NO: 143947 - DNA, 601 bp, Human
ccactgcactccagcctgggccacagagtcaaattgtgtctcaaaaaaaaaaaaaaaaaaagaaaagaaatcttaacaggaacaaaggagattgttgttgcctggtgtagaggggagaaggaagtgagattaccaggaaccaagcccagaaggtggaaattggcatggcagattttgattgcctgctgtgatttcctgtagctaaagcagtgcgtttgtttatgattgagttgtatatattgacccttggccttcatagcaaaaacagtgaaaacagctggtatagttattattccacatrtaaggatagtaacaaacagaagttaaaacacagaaattccaatctttgtttatttcatcctgctataattcctttccaaacggaaatagcacatgtaactatctttcaacacccatgttaggtgattgtgtgcatagaaatcttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaact

SEQ ID NO: 143948 - DNA, 601 bp, Human
agcccagaaggtggaaattggcatggcagattttgattgcctgctgtgatttcctgtagctaaagcagtgcgtttgtttatgattgagttgtatatattgacccttggccttcatagcaaaaacagtgaaaacagctggtatagttattattccacatataaggatagtaacaaacagaagttaaaacacagaaattccaatctttgtttatttcatcctgctataattcctttccaaacggaaatagcacatgtaactatctttcaacacccatgttaggtgattgtgtgcatagaaatsttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaactacattttctttgaaactttagtattgtagtttaataaggttcactgacaatcagtgtttgtcaatattggttcactctctttgcatggcaatcccaagtaaattttgtgtgttcttccccccccccccccacaggttttctg

SEQ ID NO: 143949 - DNA, 601 bp, Human
tgattgtgtgcatagaaatcttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaactacattttctttgaaactttagtattgtagtttaataaggttcactgacaatcagtgtttgtcaatattggttcactctctttgcatggcaatcccaagtaaattttgtgtgttcttccccccgcccccccacaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttcagaattcctgtgcct

SEQ ID NO: 143950 - DNA, 601 bp, Human; identical to SEQ ID NO: 31265

SEQ ID NO: 143951 - DNA, 601 bp, Human; identical to SEQ ID NO: 31266

SEQ ID NO: 143952 - DNA, 601 bp, Human; identical to SEQ ID NO: 31267

SEQ ID NO: 143953 - DNA, 601 bp, Human; identical to SEQ ID NO: 31268

SEQ ID NO: 143954 - DNA, 601 bp, Human
ctttggacttaagcatggcaggggactttgatattagtggcaagttgaagctttccatggtttgaagaaattataaattttagtattgtacctggtatagtttttattttacagaggctggaatcaaagctgtaagagaatctggtgacctaaatgtaagaatattttctttttagtggcctggggtcaggatattggtacctggtagaaggaagcatatttgtaacttacttcttgtttctttggttaacaatatttatttaatcatagtgtaaatgctaatgaatattcaaatttcaamaacaattagcatacatgactatggcttcaaaataaattgtaaatattaactgtaacaacttaaaagtaaaagcatagaggttagaagctgggaaagactaaggatattaacataaaaagaaactaagattgagagaaaagaaacacattatttgacattatagttatttattatgacattgtgttatttgacattacaaagtcagcctccctttgatttaacaaatgaggtagaaaaacggtgtaattgaactattctcgtttattgtaacaggaagtcagtacataatatctgtatttg

SEQ ID NO: 143955 - DNA, 601 bp, Human
ctgggtgacagagcgagactctgtctcaaaaaaaaaaaaaaaaaaaaggaaaaagaaatattagtatttcttgaaatgaatgaaccatttgcttggaaatggttccacttgagttgatgtgaggattaataaatatactttgaaacaaaaggaagctattgacacatagatatttaagttatatttgaattgaatttaaagatggctggctacttataagcatttgaaaaacagtttaaattccaaattaaagatggaaaattgtaaattactgtatctgtatattttttgaaaggctgcrtgacatacaaagactaggagattgaaagatctgctttctgctttctaggttttactttgccacttatttacctcgtcttttcagagttacttcacctctacctctaagcttcagtttcttcatttgtcaaataaaaccccaaatttcagggaaatggtaccgttctgcttacctactagcactgatctgatgattacctcattaatgttatgtaaaattactttataaaccattgatataaagcatttaacacctttgacaggtcacttagaagcaagatttggtatctattttggttat

SEQ ID NO: 143956 - DNA, 601 bp, Human; identical to SEQ ID NO: 31269

SEQ ID NO: 143957 - DNA, 601 bp, Human; identical to SEQ ID NO: 31270

SEQ ID NO: 143958 - DNA, 601 bp, Human
atcaagggattcccccacttcatcccctgaagaagctgggactacaggtgtgcaccactgtgcgcagctaatttttaaattttttgtagagatgaggtcttactgcgttgcccaggttggtcttgaactcttgagctcaagcagttcttctgccttggcctcctcaaagtgctgagattacaagcatgagccaccatgtctggcaatgactgttatttaatatgtttgtttaagatcagaaaaatgatgagccatagtgaaagaagaagagatgttagaatcaaatagaccttggattgatttttttttttttttttttgagatggagtttcactcttgtcacccaggctggagtgtggtggcacgatcttggctcactgcaaccttcacctcctaggttcaagcgattctcctgcttcagcctcctgagtagctgggattacaagcgtgcaccaccacgcccagctaatttttgtatttttggtagagacagggtttcaccatgttggccaggctggtctcaaactcctgaccttaggtgttctgtccgcctcagcctcccaaagtgctgggattataggcgtgagccaccactcccagc

SEQ ID NO: 143959 - DNA, 601 bp, Human
ttctgccttggcctcctcaaagtgctgagattacaagcatgagccaccatgtctggcaatgactgttatttaatatgtttgtttaagatcagaaaaatgatgagccatagtgaaagaagaagagatgttagaatcaaatagaccttggattgatttttttttttttttttttgagatggagtttcactcttgtcacccaggctggagtgtggtggcacgatcttggctcactgcaaccttcacctcctaggttcaagcgattctcctgcttcagcctcctgagtagctgggattacaagcrtgcaccaccacgcccagctaatttttgtatttttggtagagacagggtttcaccatgttggccaggctggtctcaaactcctgaccttaggtgttctgtccgcctcagcctcccaaagtgctgggattataggcgtgagccaccactcccagctggattgatgtttaattactagctgtattaccttagtgggttaatctctcttctggaatatgggtatgctcatattgtgaagttttgtgacatttcaatcacgtgtcaaataactagtgttgtgtattagcctggtatactataatt

SEQ ID NO: 143960 - DNA, 601 bp, Human
gtgtcaggcgtttgttacctttgacagtctttgcaacaacccatgtagcatctaacgtagctaattgggagcatctttttgggccttcctccagccccagataactgctcaaatgacaagattcacatcaggcaggtgtaggagctgtcctggcttagaagtcttattcctgacagcaaccaatatctcttggaaaaacttcataggcatagattccagggtgtctctaggggacttgctctgctacaagagtgactattgaagtaagaccaaagttatggctatctatcaggggtgtactgttctccctgttcaaatataatttattatctttcacttttgcccatgttggaatagtaaggattgattgtatggattgaattgtgtccctctaaagttcatatattgaagttgtaacctcccagtacctcagaatatgactttatttggagagagggtctttacaaaggtaatcaagtttaaatgaagtcattagagcaggtcgaaatccaatatgactggtgtccttataagaaggggaaatatggaaacagacacacatatagggaagatgatgtgaagagacatagggagaagatgg

SEQ ID NO: 143961 - DNA, 601 bp, Human
aaaaaaagaaaagaaaccacagccgggtgcagtggctgatgcctgtaatcccaacactttggaaggccaaggcgggtgcatcacctgaggtcaggcgtgtgagaccagcctggccaacatggtgaaaccccgtctctagtaaacacaaaaattagctgggctttggtggtgggtgcctgtaatcccagctactcgggaggctgaggcaggagaattgcttgaatctgggaggtggaggttgcactgagccgagatcacgccactgcactccagcctgggcgacagagtgagactggtctcaaaaaaaaaaaaaaaaactaaatgggtagaaaagatagcatagtaatattaattaaagctgaaatggctatattaatatctaggttatttcagaacatatattacaaccagggataaagaaatacataccatatttataaagggatcaatttatcaaaatgatacaacaatttcaaaacatgtatctaaataacagagcttcaaaatgcacagtgagagaactggtaaaacaaaaggttaaatggagaaacccacaataatatttggagatttcaataaccctgtgtcactaattgaagga

SEQ ID NO: 143962 - DNA, 601 bp, Human
cttttttataaataaaaattggctgggcacagtggctcacacctgtaatcctaacactttgggagcccgatgtgggcggatcacatgaggtcaggagtttgagaccagcctgaccaacatggtgaaaccccatctctactaaaaatacaaaattagctgggcgtgatggcgcatacctataatcccagctactcaggaggttgaggcaggagaatcacttgaacacgggaggtggaggttacagtgagccgagatcgcaccattgtactccagcctgggtaacgagcaaaactccatctcaaaaaaaaaaataaaataaaaacaaataaaaattgaggtactgatcctgaaatttatatggggataaaaagaacctagaagagccaaaacaactttgaaaaagaacataatagccaggcgcagtggctcaggcctgtaatcccagcacttggggaggccaaggtgggcagatcacgaggtcaggagatcgagaccatcctggccaacatggtgaaatcccatctctactaaaaatacaaaaataagctgggcgtggtaatgtgtgcctgtaatctcagctacttgggaggctgaggcagga

SEQ ID NO: 143963 - DNA, 601 bp, Human
caccatgcccagcctggtcctttcaaaactaagtcatatcatatcactcctctgcttaaaaccttccacagatttttcatcccaatcagaatgacacaagtcctctacaccatttgtatttctcgactcattatctctgtgatctctttttttcttttttggagacagagtctcgctctatcgcccaggctggagtgcagtggcgcgatctcagctcactgcaaactctgcctcccaggttcacgccattctcctgcctcagcctcctgagtagctgggactataggcgcctgccaccgcrcccagctaattttttgtatttttagtagagacagggtttcaccgtgttagccaggatggtcttgatctcctgacctcgtgatccgcccatcttggcctcccaaagtgctgggactacaggtgtgagccaccacgcccggccctctgtgacctcattttttataactattccttttctgtcactcagctctggccacactgtcctcagtgttccttgaaattccagggcatgctaccttactgccctccagggccttgcacgtatccccatgcagtgggataaaagcctttggcttttccc

SEQ ID NO: 143964 - DNA, 601 bp, Human
gagacctcagctctacaaaataaaagtaggccagagggccaggcactttgcctcatgcctgtaatcccagcacattgggaggccaaggagggagggtcacttcaggtcaggtgtttgagagcagcctggctatcatggtgaaacccatctctaccaaaaaataacaaaaattaggcgggcatggcagcacatgcctataatcccagctattcgggaggctgaggcaggagaatcactcctgaggtccggagttcacaaccaccctgactaacgtggtgaaaccccgtctctactaaatacaaaaaaaaaaaaaaaaaagccaggcgtgatggcgcatgcctgtaatttgagctacttgagaggctgagacaggagaattgcttgtacctggttggcggagattgcagtgaactgagattgtgccattgcactccagcctgggcaacaagagcaagactcagtctcaaaaaaaaaaaataaccacaaaaaaacaaatgaaaataaagatagctgggcatagtggtacatagctatagtctgtgtacctgggaggctgaggtgggaggctcacttgagcccaagagttggagactgcagtaag

SEQ ID NO: 143965 - DNA, 601 bp, Human
gtgaatcctgtcctctgaattgtgagcctcttgagggcagagagtaagtctttcatgcttccctgtatccttgtagttgttcacttttcatagatttttcacacctttgtactggatcttcctgtctaaagcctttgttaatcacttgataatgtttgtagaactgaatcactaaaacttattttatttggccgggtacagtggctcacgcctgtcgttccagcactttgggaggctgaggagggaggatcactttagccccaagatttgaaaccagccttggcaacatagtaagaaagaycccatccatacaaaattaaaaataaaagaattaggctgggcgtggtggctcacgcctgtaatcccaacactttgggaggctgaggcgggcggatcatgaggtcaggagatcaagaccatcctggctaacatggtgaaaccctatctctactaaaaatacaaaaaattagctggatgtggtggtgggcccctgtagtcccagctactcgggaggctgaggcaggagaatggtgtgaacccgggaggcagagcttgcagtgaggctgaggcaggagaatggtgtgaacgtgggaggcagagc

SEQ ID NO: 143966 - DNA, 601 bp, Human
tcagtgtaagaggagtattcaattatagtttggatacctctggtgctttggaagagttataataaagtaaagccaagagatgatgatgatgccttagagttgtatggatacaatacctaggagtaaatttaaccaaggaagtaaaagacttgtaccctgagaactacaaaacgttgctgaaagtaattaaagacctgtgtaaatggaaagatgttccatggattagaagacttaatattgttaagatgtcaatattaaaagtgatctacaaatgattcattgcaagccgtatcaaaatttyaatggcctttttgcagcaatggaaaagccaatattcaaatcatctgtaattgcaaggggcccttaatagcccttcgtggatgttcttgaaaaaagaagaacaaaattggtggatttatacttctcaattttaaaacttacccttacctcacattatatataaaaactgactcaaaacaatcaaccaacaaactaaatataagagctaaaaccataaagctattagacgaaaacagtaatctttcgtgaccttggatttggcattggattcttagatatgaccccaaaagcacaagcaaca

SEQ ID NO: 143967 - DNA, 601 bp, Human; identical to SEQ ID NO: 31271

SEQ ID NO: 143968 - DNA, 601 bp, Human; identical to SEQ ID NO: 31272

SEQ ID NO: 143969 - DNA, 601 bp, Human; identical to SEQ ID NO: 31273

SEQ ID NO: 143970 - DNA, 601 bp, Human; identical to SEQ ID NO: 143928

SEQ ID NO: 143971 - DNA, 601 bp, Human; identical to SEQ ID NO: 143929

SEQ ID NO: 143972 - DNA, 601 bp, Human; identical to SEQ ID NO: 143930

SEQ ID NO: 143973 - DNA, 601 bp, Human; identical to SEQ ID NO: 143931

SEQ ID NO: 143974 - DNA, 601 bp, Human; identical to SEQ ID NO: 143932

SEQ ID NO: 143975 - DNA, 601 bp, Human; identical to SEQ ID NO: 31264

SEQ ID NO: 143976 - DNA, 601 bp, Human; identical to SEQ ID NO: 143934

SEQ ID NO: 143977 - DNA, 601 bp, Human; identical to SEQ ID NO: 143935

SEQ ID NO: 143978 - DNA, 601 bp, Human; identical to SEQ ID NO: 143936

SEQ ID NO: 143979 - DNA, 601 bp, Human; identical to SEQ ID NO: 143937

SEQ ID NO: 143980 - DNA, 601 bp, Human; identical to SEQ ID NO: 143938

SEQ ID NO: 143981 - DNA, 601 bp, Human; identical to SEQ ID NO: 143939

SEQ ID NO: 143982 - DNA, 601 bp, Human; identical to SEQ ID NO: 143940

SEQ ID NO: 143983 - DNA, 601 bp, Human; identical to SEQ ID NO: 143941

SEQ ID NO: 143984 - DNA, 601 bp, Human; identical to SEQ ID NO: 143942

SEQ ID NO: 143985 - DNA, 601 bp, Human; identical to SEQ ID NO: 143943

SEQ ID NO: 143986 - DNA, 601 bp, Human; identical to SEQ ID NO: 143944

SEQ ID NO: 143987 - DNA, 601 bp, Human; identical to SEQ ID NO: 143945

SEQ ID NO: 143988 - DNA, 601 bp, Human; identical to SEQ ID NO: 143946

SEQ ID NO: 143989 - DNA, 601 bp, Human; identical to SEQ ID NO: 143947

SEQ ID NO: 143990 - DNA, 601 bp, Human; identical to SEQ ID NO: 143948

SEQ ID NO: 143991 - DNA, 601 bp, Human; identical to SEQ ID NO: 143949

SEQ ID NO: 143992 - DNA, 601 bp, Human; identical to SEQ ID NO: 31265

SEQ ID NO: 143993 - DNA, 601 bp, Human; identical to SEQ ID NO: 31266

SEQ ID NO: 143994 - DNA, 601 bp, Human; identical to SEQ ID NO: 31267

SEQ ID NO: 143995 - DNA, 601 bp, Human; identical to SEQ ID NO: 31268

SEQ ID NO: 143996 - DNA, 601 bp, Human; identical to SEQ ID NO: 143954

SEQ ID NO: 143997 - DNA, 601 bp, Human; identical to SEQ ID NO: 143955

SEQ ID NO: 143998 - DNA, 601 bp, Human; identical to SEQ ID NO: 31269

SEQ ID NO: 143999 - DNA, 601 bp, Human; identical to SEQ ID NO: 31270

SEQ ID NO: 144000 - DNA, 601 bp, Human; identical to SEQ ID NO: 143958

SEQ ID NO: 144001 - DNA, 601 bp, Human; identical to SEQ ID NO: 143959

SEQ ID NO: 144002 - DNA, 601 bp, Human; identical to SEQ ID NO: 143960

SEQ ID NO: 144003 - DNA, 601 bp, Human; identical to SEQ ID NO: 143961

SEQ ID NO: 144004 - DNA, 601 bp, Human; identical to SEQ ID NO: 143962

SEQ ID NO: 144005 - DNA, 601 bp, Human; identical to SEQ ID NO: 143963

SEQ ID NO: 144006 - DNA, 601 bp, Human; identical to SEQ ID NO: 143964

SEQ ID NO: 144007 - DNA, 601 bp, Human; identical to SEQ ID NO: 143965

SEQ ID NO: 144008 - DNA, 601 bp, Human; identical to SEQ ID NO: 143966

SEQ ID NO: 144009 - DNA, 601 bp, Human; identical to SEQ ID NO: 31271

SEQ ID NO: 144010 - DNA, 601 bp, Human; identical to SEQ ID NO: 31272

SEQ ID NO: 144011 - DNA, 601 bp, Human; identical to SEQ ID NO: 31273

SEQ ID NO: 144012 - DNA, 601 bp, Human; identical to SEQ ID NO: 143928

SEQ ID NO: 144013 - DNA, 601 bp, Human; identical to SEQ ID NO: 143929

SEQ ID NO: 144014 - DNA, 601 bp, Human; identical to SEQ ID NO: 143930

SEQ ID NO: 144015 - DNA, 601 bp, Human; identical to SEQ ID NO: 143931

SEQ ID NO: 144016 - DNA, 601 bp, Human; identical to SEQ ID NO: 143932

SEQ ID NO: 144017 - DNA, 601 bp, Human; identical to SEQ ID NO: 31264

SEQ ID NO: 144018 - DNA, 601 bp, Human; identical to SEQ ID NO: 143934

SEQ ID NO: 144019 - DNA, 601 bp, Human; identical to SEQ ID NO: 143935

SEQ ID NO: 144020 - DNA, 601 bp, Human; identical to SEQ ID NO: 143936

SEQ ID NO: 144021 - DNA, 601 bp, Human; identical to SEQ ID NO: 143937

SEQ ID NO: 144022 - DNA, 601 bp, Human; identical to SEQ ID NO: 143938

SEQ ID NO: 144023 - DNA, 601 bp, Human; identical to SEQ ID NO: 143939

SEQ ID NO: 144024 - DNA, 601 bp, Human; identical to SEQ ID NO: 143940

SEQ ID NO: 144025 - DNA, 601 bp, Human; identical to SEQ ID NO: 143941

SEQ ID NO: 144026 - DNA, 601 bp, Human; identical to SEQ ID NO: 143942

SEQ ID NO: 144027 - DNA, 601 bp, Human; identical to SEQ ID NO: 143943

SEQ ID NO: 144028 - DNA, 601 bp, Human; identical to SEQ ID NO: 143944

SEQ ID NO: 144029 - DNA, 601 bp, Human; identical to SEQ ID NO: 143945

SEQ ID NO: 144030 - DNA, 601 bp, Human; identical to SEQ ID NO: 143946

SEQ ID NO: 144031 - DNA, 601 bp, Human; identical to SEQ ID NO: 143947

SEQ ID NO: 144032 - DNA, 601 bp, Human; identical to SEQ ID NO: 143948

SEQ ID NO: 144033 - DNA, 601 bp, Human; identical to SEQ ID NO: 143949

SEQ ID NO: 144034 - DNA, 601 bp, Human; identical to SEQ ID NO: 31265

SEQ ID NO: 144035 - DNA, 601 bp, Human; identical to SEQ ID NO: 31266

SEQ ID NO: 144036 - DNA, 601 bp, Human; identical to SEQ ID NO: 31267

SEQ ID NO: 144037 - DNA, 601 bp, Human; identical to SEQ ID NO: 31268

SEQ ID NO: 144038 - DNA, 601 bp, Human; identical to SEQ ID NO: 143954

SEQ ID NO: 144039 - DNA, 601 bp, Human; identical to SEQ ID NO: 143955

SEQ ID NO: 144040 - DNA, 601 bp, Human; identical to SEQ ID NO: 31269

SEQ ID NO: 144041 - DNA, 601 bp, Human; identical to SEQ ID NO: 31270

SEQ ID NO: 144042 - DNA, 601 bp, Human; identical to SEQ ID NO: 143958

SEQ ID NO: 144043 - DNA, 601 bp, Human; identical to SEQ ID NO: 143959

SEQ ID NO: 144044 - DNA, 601 bp, Human; identical to SEQ ID NO: 143960

SEQ ID NO: 144045 - DNA, 601 bp, Human; identical to SEQ ID NO: 143961

SEQ ID NO: 144046 - DNA, 601 bp, Human; identical to SEQ ID NO: 143962

SEQ ID NO: 144047 - DNA, 601 bp, Human; identical to SEQ ID NO: 143963

SEQ ID NO: 144048 - DNA, 601 bp, Human; identical to SEQ ID NO: 143964

SEQ ID NO: 144049 - DNA, 601 bp, Human; identical to SEQ ID NO: 143965

SEQ ID NO: 144050 - DNA, 601 bp, Human; identical to SEQ ID NO: 143966

SEQ ID NO: 144051 - DNA, 601 bp, Human; identical to SEQ ID NO: 31271

SEQ ID NO: 144052 - DNA, 601 bp, Human; identical to SEQ ID NO: 31272

SEQ ID NO: 144053 - DNA, 601 bp, Human; identical to SEQ ID NO: 31273

SEQ ID NO: 144054 - DNA, 601 bp, Human
tgactctatcaacgcccaaaacgtcggacgtacatctagcccgactctctttaaaataacagctccagcattttaatcgagatcaaaaaggacccagctgaccctgcgcgcagggggccttatacaaagtcggagaagtagctgggtcgctggccggccagggactcaagccgcctcaggtgagcgctccttggcgctacttccggtctcaggtgaggccgccggaagcgggcgcttggccctaagacccgctacagtgcgtcctcgctgacaggctcaatcaccacggcgaggccaaggmgcggggccgcggccgcccgagaagcctgagctgggccccgacaccccctgcccgacattcggccgggacccccgaacactcacccagggccgcgcgagcgcccacaaggaaacagagacgctaccgccgccagccgccttggaacccagctcgacgggccgtggcgcctgcgccctcagctcaaccatagacaccgcccccaacagcgactccgacttctgctggtgcggggaggcccgtggcgcatgcgcctggctcagcgtttgtttttaagcacgggcaagaccacgtggtttggag

SEQ ID NO: 144055 - DNA, 601 bp, Human
cgctgcgtggaagtcacgtaacagcagcatttacaggcggcctgcctcatccgcccacactcttatcaatttgactctatcaacgcccaaaacgtcggacgtacatctagcccgactctctttaaaataacagctccagcattttaatcgagatcaaaaaggacccagctgaccctgcgcgcagggggccttatacaaagtcggagaagtagctgggtcgctggccggccagggactcaagccgcctcaggtgagcgctccttggcgctacttccggtctcaggtgaggccgccggaagcsggcgcttggccctaagacccgctacagtgcgtcctcgctgacaggctcaatcaccacggcgaggccaaggcgcggggccgcggccgcccgagaagcctgagctgggccccgacaccccctgcccgacattcggccgggacccccgaacactcacccagggccgcgcgagcgcccacaaggaaacagagacgctaccgccgccagccgccttggaacccagctcgacgggccgtggcgcctgcgccctcagctcaaccatagacaccgcccccaacagcgactccgacttctgctggtgcg

SEQ ID NO: 144056 - DNA, 601 bp, Human
ataatatacattacataaaaattccatacattactattactagagagccctatgtgagcaactaccacttttctaggagtaaaggggccgtgaatattcccagcagacaggcatgcctgcacccccatgctctcctgaggacggcagactgccttctatgtgcccgagcccttaaatacatgggcactgacctgaaaggtggacttgttctacttggtttcccccttacacactgggcaaatccctaaactactctgtatttctgattcagaaccaatgggctatggaagtcaacaggccrtaagataagaaataaaaacacaaatgttcaattgaaaaagttagtctcctttgataacctactatatttatgactgtccttttagtattctacctaatcaaaaagctttaagaaaaaaatatatcttgccatgcctctccaccctggccacgccagactcctctttgtcttgttcccttccacatcaccagaactcagatatgtgcccttgggcttcactggggaggcccaatgaactgggcttgtggtacctggttcatctttccaaggtcaagaatgtttcaacttcaaatacgagtg

SEQ ID NO: 144057 - DNA, 601 bp, Human
ggctgaggcaggagaatagcttgaacccgggaggcagaggttgcagtgagctgagatggtgccattgcactccaaacttgggcaacaagaacgaaactctgtttcaaaaatatacatatttttttctattgcttcaattaattcttcataacaattctcatcttactgaataaacttctaaagctagtagaaaatagttgcttagagaatttaatgctaagcagctttaatctgtatttcaaatagtcaatgcctatgcagccaccaacaatttgtacacacacacacacatacacacacrcaatgactgcaaagataatttagttccagagcttacgaattttcccaaaaagttttccaaaagacaaccatccaagacagtaatgtaaatgaaatactgcccagagtacctgaatgaagatgtcttttcttaaactgatgcttggaaagcctgccaaatacgctctttaaagacacgtgagagccattctacaaatgcgattaatgatgttgggcttccaacatgtaatttaatcatgatgctagttgtctttatcaaattaacaaaataagaatgtttaagatttccagtgtattaaat

SEQ ID NO: 144058 - DNA, 601 bp, Human
caaacatctgttatcaatgagaaacatagtacacagcagttaaaagcactggtcataggcctaatgaattctgagaggctgaactttaaaaccacgtacttttgggctgggtgcagtggctcacacctgtaatcccagtactttgggaggccaaggtgagcagatcacctgacgtcaggagttcgagaccagcttggctaacatggtgaaaccctgtttctactaaaaatacaaaaaattagctgggcatggtggtatgcgcctgtaatccagctacttgggaggctgaggcaggagaatmgcttgaacccgggaggcagaggttgcagtgagctgagatggtgccattgcactccaaacttgggcaacaagaacgaaactctgtttcaaaaatatacatatttttttctattgcttcaattaattcttcataacaattctcatcttactgaataaacttctaaagctagtagaaaatagttgcttagagaatttaatgctaagcagctttaatctgtatttcaaatagtcaatgcctatgcagccaccaacaatttgtacacacacacacacatacacacacacaatgactgcaaagata

SEQ ID NO: 144059 - DNA, 601 bp, Human
agacggccagacaggaacaaacatctgttatcaatgagaaacatagtacacagcagttaaaagcactggtcataggcctaatgaattctgagaggctgaactttaaaaccacgtacttttgggctgggtgcagtggctcacacctgtaatcccagtactttgggaggccaaggtgagcagatcacctgacgtcaggagttcgagaccagcttggctaacatggtgaaaccctgtttctactaaaaatacaaaaaattagctgggcatggtggtatgcgcctgtaatccagctacttgggargctgaggcaggagaatagcttgaacccgggaggcagaggttgcagtgagctgagatggtgccattgcactccaaacttgggcaacaagaacgaaactctgtttcaaaaatatacatatttttttctattgcttcaattaattcttcataacaattctcatcttactgaataaacttctaaagctagtagaaaatagttgcttagagaatttaatgctaagcagctttaatctgtatttcaaatagtcaatgcctatgcagccaccaacaatttgtacacacacacacacatacacacaca

SEQ ID NO: 144060 - DNA, 601 bp, Human
taccacataaccaaaataccaaaagacctaaggcttaataggaaggaatccatattctaaaatctacaattcttgcaggccaatgatacccagtttttcattaaacttgcactgaaataaaacatacatctgaaagtgcacaaatcattaagtgtagaactcagtgaatattcagaaaaaatgtactcataaactagcagccatatcaactaacagaattactagcaccaccagatgagcccttcaggctacctcccagcctctacgccccccaagataatgatggacctggactcctaaygtacagacaagttgtgcctgtctctgaacgctacgtaagtggaaatgtttgtgccctgtgtccaccttccttcacccaacattatgcttttgagctgcatccttactgttgaatgtagctgtagtttgttaactctcactgttaatgcacatttgagtggcttccaggttttggctactaggaataatgttgctatgaatattctgatgcacatcttttggttttatttatatttatatatttatatatttatatatttttatatatatatatatatatatatatatatatatatatata

SEQ ID NO: 144061 - DNA, 601 bp, Human
gtctcctggacaggcatgagcatgctgccaagactggatggccccggctctgaaagaacaatagcaatgcgtttcgcactagcatgaaactttccgagggtacaaaagaaatgctcactctttcaagaaatattaggcagctacaaataactcatataaaaaaagaatcatccatgtactaaagcatgttacatatgaaggacagaataaaattatagcatcatgctatatttaatatattcctgttcaaaaagacaacttctcagtaacttttccccaaaatatttcactataaatatamtctctgccatccaaagataggcttattactgtataaatacagttataaatagtcaagtttagctgtgtttccttatcagctgagtagtcgtccatgaggaagcaagctccgaagttctcacgtcattgctaaaaccaacattcagatggacttaaattcaagagacagtaaaaccaaaaacagggatcaccatgtacctaaaaaggaaaaacataaatgtcagctctatgctgcccagcatggcagttaccagtcacctgcagctatttaaatttaaattacattaagttaaaaactcag

SEQ ID NO: 144062 - DNA, 601 bp, Human
atttgtgcccaagtctattaacagactgcaaattttttgccagaaacccttgaagccagtccaaggatgcagacatgcattgttgacatgaaagcaaagataaagctatggaggcttacctcgaatatggcaactgggaagtgaatcaataacatggaggtaacaaggactggggacaagcgacctgatctttatcaccctgaaggggaaaggttcacatgaaatgtttggtcttctgggccacacagggctgtcttggctgcacagcctgtactaggtaagcagcatgtaggtgctcacygggaacccacatcactcaaacactgaaggtgtgttagtcctaatctttatttggcacccggagctcccaggcccacaatgtgcaaagcagtagtatattttaagaaagcactagacctcacaaccaacagccataagcaaatggaaaccgtggtagcacaaagtaaaatgaaaaaataatgtatgttttacaagacctgtataccactgaccatagaaccgacagaacatttacttctaagcagtggctcatccatcctgtatgacatgaaagggtatgaaaaccagggaacccactgag

SEQ ID NO: 144063 - DNA, 601 bp, Human
caataaaaatagggactcatcagaagtgctgaaaggtggcgagggagccttcaaaccatgcagaggaaccaactcaaatccacttcaggctatgcatttagcagcttagcccaatgcaccaggtcatctgaggagactcaggcaccgcctactgaagagtccgtttctgaactccccactatgtttccctgatcggggtgggcatgggtcggggatttatcccagaggcaattatttgctgagtgtgggccatagtaaagaaaaaagcattacattctcaagcctcaacatccttaccaayaatgcttcccaactgcctcaaagctctcctaaatgagaacatagttctttctgagcaaggtcctgtggaccatgaagaatgtcaccaagctcccctcagagtcagcgggagctcagccaaagcacaagtgcagtgcccagctcctcccactctgcacctgctgcctcagactccccacgctgagcccaggcccctaccctctgaaggtgtttcccatgtgattctgacacacacaccccacaagaaccagatgatctatgacatacagcatttagctaaggctccctgccaggccctccc

SEQ ID NO: 144064 - DNA, 601 bp, Human
cctaaatattgcaccttctactcaatcccacaaagggaaggaaacatgtatgtagagggcccagccgacttcaaatctcagctctacttcacagtaaaactgtgggcaagccaactaactggaggggccgtgattataaccatgtaaagatgtgtattcacagaaccaaagactggaatgacatgtagaaaataaaaacataaaagaggtcattttttcatcttaatattgttgtcatacttttacaataaaaatagggactcatcagaagtgctgaaaggtggcgagggagccttcaaaycatgcagaggaaccaactcaaatccacttcaggctatgcatttagcagcttagcccaatgcaccaggtcatctgaggagactcaggcaccgcctactgaagagtccgtttctgaactccccactatgtttccctgatcggggtgggcatgggtcggggatttatcccagaggcaattatttgctgagtgtgggccatagtaaagaaaaaagcattacattctcaagcctcaacatccttaccaacaatgcttcccaactgcctcaaagctctcctaaatgagaacatagttctttctgag

SEQ ID NO: 144065 - DNA, 601 bp, Human
ccagaccatgaagtaaattctgtccccatccacaccatacttgccaggtcttctagactcctgagccatctccctatatcctcatccaaattcccagattacaggcttaggtttttggtttggttttcagtccaatggaggtgggggcagctatgtgttgatttttggcaccaccctgtggtcatacctaaatattgcaccttctactcaatcccacaaagggaaggaaacatgtatgtagagggcccagccgacttcaaatctcagctctacttcacagtaaaactgtgggcaagccaaytaactggaggggccgtgattataaccatgtaaagatgtgtattcacagaaccaaagactggaatgacatgtagaaaataaaaacataaaagaggtcattttttcatcttaatattgttgtcatacttttacaataaaaatagggactcatcagaagtgctgaaaggtggcgagggagccttcaaaccatgcagaggaaccaactcaaatccacttcaggctatgcatttagcagcttagcccaatgcaccaggtcatctgaggagactcaggcaccgcctactgaagagtccgtttctga

SEQ ID NO: 144066 - DNA, 601 bp, Human
tgtgaaaaatcagaccttggcaatgaccttgagcagtagggcatgaataactcccacatgcttagcgttccaataatggaacactaggcataaataggttttaaaagtgtaactttttctttcaacttatagattcctaaaagaaaatgaacacagtcttctttcttttttttttttctctcaggctccagtgatccacccacctcagcctcctgggtagctgggactacaggcgcacatcaccacacccagctaactttttctatttttggggtttcaccatgttgcccaggctggtctygaactcttgagctcaagcaatcctcctgccttggcctcctaaagtgctgggattacaggtatgagccattgtgcccggccaggcttatttcttgagaaaaatgaactctcagagatgttaagaacattcttaaaataattgtatttaggtttctggataaaatctcaaacttttactaaattcagattttgggagagttttgttttttctctttaatttgggctttaaaaaaaaggcacaatcaaatcaacctccacattgtgagttggcctttgccgaagcacagcctaaaattgctaa

SEQ ID NO: 144067 - DNA, 601 bp, Human
tcatcagaaacaggtgctgtagcattttcaggtggttgtatcactatagcacttgcttctatgctgtcatctgtctctaaaaggtcagttatttcatgtaaacttagtgttcgaggcatcttgggactaaaacggaaaaaaggtattattagtcctagtggtagtggttttgcctagtgttccaaaaatggaacatgaaaaatgtcaaacccataactaatgcaataataatactttctgtattttctttttaccgcacaatagcataactagtagagaagttatttcttaaaaattactwgtataggatgtagtgcagtaaagttatatgtacctgtctttggatactcaaaaatgtttctgaaaactcacatcactttttgacaagctcccagcatgccagtatctgtagcagtaactaactctgtgcaccaagtgataacatgtaccctcaggaggcagacatgtgtgaaaaatcagaccttggcaatgaccttgagcagtagggcatgaataactcccacatgcttagcgttccaataatggaacactaggcataaataggttttaaaagtgtaactttttctttcaacttatagat

SEQ ID NO: 144068 - DNA, 601 bp, Human
tgttattctctctctctctcttttttttttaacaattaaagcagacagggagaaagaaaggaagctgtccaagattaccaatgagttaagggaaaagattcaaacccagataatcaagttccagagtctatattcctatctgttacataatactgtcttcaaaaaagtattttccaaactccctagtaccaccccttttctcacagtgccagcgaagggtcctctaactgccacagaacgaaagcaattgcacaagaacaaaccaaattctaaaacttcaatccaaatgttgtcttaaaaraacatcaggactaaggtttaaagaagggaaagattgccttcatttttgtacaataacatgattccttccccaccttaatagtgtgcaaagtaagtcaaaactcactcttcactacacccctgcaaacttttccaagtaacagtaaaatcagtttagcagttctttgaactatacataatataggctgaacaatcatgtaatacacattttatactagacaaatcaatgtacacaactgcccataccaacacacaaaagggacaaaatacacatattaatgggaattatcaaatattagtt

SEQ ID NO: 144069 - DNA, 601 bp, Human
aaaaagatgatgttttcattcagcatggtgcaactgatgctctgaatttcacaaaatggtggaaatggaataaaacaataatacagagaaatgctttcaaactacaataaaaaaaaaactcataggaagcgagtaagagcagcaacacatataaggcatttatctgccactgactatgcaagagtaagagagaatgtccgagggaaggcaagagaaaatgaaagggtaatactacacatgctgcctggccaaaggtatggtgtgttgtccagtatccattacaaaaccacacagagcccartgctagtatgtaggtagctactggtggaccttaaagcacatcctctgataaactcttgccttgttgaaaatttcaactcttcaaggtaacaaaaggaagggctagctgaaatttacttgtgatcaacaagaactggttatctgaaattgcactacacggtagtaaaggacctataaataagatcaatgaagcactgttggtcatttccagagaagaacagcaaatggaagaggcagtatatggccaagtctaaggaaatagctatcatctaacaacagtttaataagtgatactttttat

SEQ ID NO: 144070 - DNA, 601 bp, Human
ctacaccacactgcctccatcctacatgggtccaacaactctttttgcttggggctcatcaacttaactaaagtagggagagtgcggaaaggagcagttgagaaattattaaagaaatggtaaacagcataggatcccaaaaggaacctgagagggggttaagacaactagattctgtgtggcccaggaaaggcagcatacaatgtgctgggtgtttcctcatctacaaatctaatcttcgacggctttcaaacagcatgtgagtgtgtttacaagaagatgaacagcactaagaaaatgrcattaaaaaaaatcttactaggcagcatgtaagtcatatctctagcaggatccccaaaaactagggatagttacaaagatagcaaagagtggctctttctttccacacaatacacgaaggccctcagatggtatttaaaggaaattcacttgcagattaaaagcactagccacacagctggtagatgatatacatagctggtgttgctagatgaggaatataagggcctgagctcaggtttcagctgtgccactaactgactttggttttattgctttaccttcctaataataaacagtg

SEQ ID NO: 144071 - DNA, 601 bp, Human
ggaaatgatctagaccaatagttctcagccaggggtaattcttctccctatgggacatttggcaatgtctaaagacatttttgttacaaccagagaagtgcaatagtagaggccagagaagctgttcaatatctgatactgcacaggacagtccccacagcaacaaattatttagccctaagtgtcaattgtgtcaaggtcgagaaaccctcatttagaacaaaagctggttcatgaactggctacactagaataatctcaacttttgaaaaagacacactgcaaaaagctctccaaaaaactgatgtgcaattagtttccagaatcactacattctagtcagttgacctctttttgctgagatacagaacaactggaccagctcctccagtcggggaacaaaatctcccagtgattattctagtgtattactcctacaccacactgcctccatcctacatgggtccaacaactctttttgcttggggctcatcaacttaactaaagtagggagagtgcggaaaggagcagttgagaaattattaaagaaatggtaaacagcataggatcccaaaaggaacctgagagggggttaagacaa

SEQ ID NO: 144072 - DNA, 601 bp, Human
ccagctacttgggaggctgaggcaggagaatcacttgaacccgggaggcggaggttgcagtgagctgagattgtgccactgcactccagcctgggcgacaagagcgagactctgtctcagaacaaacaaacaaacaaacaaaatacaatttttacaaataactgaagagtaaatcatacaatgcttgaaatattaaaaatcatctactacacaactgaaaaataatttgtagttctatagaaaaacaatgaaattttggtaaagccctaacttaaatgaggcctacccttatactccaacrtaacaaaataacctatgtccactttgaaaccctccctgcctccagctacagtcactgtccctgcccttcaactgggtggaaagggccagactacaagaagccagaggctacaagagactccgacactcttcctacagagtttctaagccatgctcctcaccaaggcagggcctgtccaggtgccccttgagctccccaaggagagtgggactctgcctggccccttccatggcagcaagcctttctaaaaggattaaatgcaccagcttctttctatcctccaaggggaataaaagagtt

SEQ ID NO: 144073 - DNA, 601 bp, Human
tctcaatgcctacctaatagcaagcaattaatgaatgctggctttattaaattaaaacattttttaagattggaagaaaatatatcaacatgctaaaagagattatttcagagttggggaatcataagtgatttttgttttcttactagagctcagaaataaattattcctgaacttaaaacaatttttggccgggtacagtggctcacacctataatcccaacactttgggaggccgaggcgggtggatcacctgaagtcaggagtttgagaccagcctggccaacatggtgaaaccccrtctctacctaaactataaaaattagccgggtatggtggtgagtgtctgtaatcccagctacttgggaggctgaggcaggagaatcacttgaacccgggaggcggaggttgcagtgagctgagattgtgccactgcactccagcctgggcgacaagagcgagactctgtctcagaacaaacaaacaaacaaacaaaatacaatttttacaaataactgaagagtaaatcatacaatgcttgaaatattaaaaatcatctactacacaactgaaaaataatttgtagttctatagaaaaaca

SEQ ID NO: 144074 - DNA, 601 bp, Human
taaaaactgggattgactgagggcatcacagggccacacgcctgcctctcacacacctggagcagagtcactgcactctgcacactgtcattcctctcctccactcccttttcctgccccacaaagatgttgactgtgtgaagcaaaatgcacatacattactccactgtatacactaccccttctatctcactaattcccacaatttcaattctagatgctggtaatgccaaatctaagtctccagcccagatcactcttcggaactccaaaccaccacacactagaaatctcactgccratatccccaaagcaccacacgccatcctcccctacctggctgtcccctgtccccgtgcttccaaaccaatggaaagaattttgtcccactgtccaggtgcccaaatcagaaacctaggcctcatccttgagcagacctgcttgctctccaccacgagcaacctacactgagttcacatcatttttacctcctgaatcctttcagtcgccatgtctctccgtctacactgttgctatgccaggtccagccactctcctctctcatctgggttactgcatctccgaggatgattatttcaaa

SEQ ID NO: 144075 - DNA, 601 bp, Human
gagggcattaaaacaaaacaaaaaggtactgaaatattatgttacctttttgtgggtataggaaccggtttcatgtagaattgccactctgaacggaggccaccacgtgtgaaattccttcacccactgatgcatcactgttgttggacagacaattacagttggacccaacccctcaaacctgcatccaaacgtccaagaagaaaacaaccatgaaagagcatatacagtcatcaactgctcaaaagatcccccaaaacaacaaacaaaaaacttagttcaaaaaaacaatgctaactayggaaatttattgatattttctttaagaaaaagttactgatgttaaaacccagtaagtaaaatctccataatctcattcatcaattagtggatgtaggtgttaagagaaaacacttaataatatattaagagatataacatctatagtaacataaaagataatcaaatattatttaacaaaaatactcttttcccttctactacagattagtgaagtttttatacagtgtatcttaacctaagtgaacataatagaatcttaaatttgtctgaagttttatagtctaccaagagttttcaa

SEQ ID NO: 144076 - DNA, 601 bp, Human
ttttataactcacagcatttaccctaatttattaattatcttatccagtttattttccatttatcacttaaaattctgggcaaagtcagttggttttaacaataacagtgtaagcaaaattccatctcgccttatttgtgctaccaaaccatagatttttctgagtcacttctatcaaaagtttgcttttccatgaacacaaacacaacaggaatcctggagtttcgtggtccccgtgcatctgactccgtgaggcaaacactccatagcccttgcagccggcactgctttcctgggcccygagaacgaactcaagagctcagaagactcaggaaagaaagaactagctcctaagagactgctgcttctccccaataatgtaacctgcaaattcacagtgaaactgcgtgattattatttattcagcaaatgcttatgggtcacccgggatataaaaatgaatcagacacagtccctactcaacagagctcacagtctggatggttagacagatgagaagaaaaaaggaagaatacaacgtatctatgctacccacaggagcacagataaagctcttttttgatactgtgatattaccaaa

SEQ ID NO: 144077 - DNA, 601 bp, Human
caagtgtctgtgaaggtaaaacaacctcagaaggtaaagccactgcaaccaaaagtgaaatatctcttcttagaagtttgccctccaaagtcaaggagacaaatttcaccaaatttactgtcaattctatttccataatgagtccatgtatgtggtttacacgaaggcagttcttcaaactatggtgacaaaggaactggaggcaagccatgatccaggtgaaggtgtccaatacacacactttactaccccaaaagaaaatgaaaggaataacatttttttaaattgcctttataagacraacatcagctaatgagtcctgccacaggattttgcagcacaaaacactaagagatgttaacagataacagaaatgaaaaaggaaccacaaatgttttacaagggtagtgacaggatagtttaaggtttgacaaacaatttaaggtttgactagacaacaatctatactgctattatcttcatactgctaaaaatcactttttataactcacagcatttaccctaatttattaattatcttatccagtttattttccatttatcacttaaaattctgggcaaagtcagttggttttaacaa

SEQ ID NO: 144078 - DNA, 601 bp, Human
taaattatgctgccaatcagagactattaacaaagataacataggatcaaagggtgagagaggtgggaagctaaagggcaacttggggaagaagaatgatagatgtgcttaattgagaaattgaccatttgatatttttccaaatgaaaaattttccttttttttttttttttgagacagagtctcgctctgtcgcccaggctagagtgcagtggcacagtccaggctcactgcaacctccgcctctagggttcaagagattctcctgcctcagcctcccgagtagctaggactataggcrtgtgccaccacaaccagctaatttttgtatttttagtacagacagggtttcaccacattggccaggctggtctcaaacccctgacctcgtgatccacccgcctcggcctcccaaagtgctgggattacaggcatgagccaccacgcccggccaattttcaaaatttatgtcataccagctacaacaaagcatttggaaaataaagataatctacttgaacgataaacaaaacaattctggcattattattcttttaaatatttctaaagagaaattctcttctcttccctgttcctaata

SEQ ID NO: 144079 - DNA, 601 bp, Human
ataaattgaaaaaaaaatccttaatcattaaataaactttacaagacagtgctaaagatgtcaccacctactgtgagttatgggataggtatcacaagactgccttctttatctcttcatttactacattttctttccccaaggaaagagttggctttttaaggttagttaaaaacatcctttattttttttgagccctagcaacatcaaacacctgaaatgcagtgtttattgttgttttaacaaataaatattaatcaactcacatgaaagttgctctatattagaaaaaaggatcackaaatataatcagaaaaaggaaatcttgaacttttattaaatgcgatttcaagtgaccattaaaagagattcagaagcctaaaaatttctttatcagatttcatcatttggttgaaactatcagttgtatatttttttgcatggctgctgggtgtacatttgacaattctaaattatgctgccaatcagagactattaacaaagataacataggatcaaagggtgagagaggtgggaagctaaagggcaacttggggaagaagaatgatagatgtgcttaattgagaaattgaccatttga

SEQ ID NO: 144080 - DNA, 601 bp, Human
gaaaggtacacaggcaatagatatttaattcttaactatgtgagaaaaatatgttaaaatacatttgccaaaactttatgctgattactgagtaacagttgctacttccacctaaaaactagaaaatagaatgtagaactatcaaaccattacagaggaaaataatagaaaatagcaaaaatcaggacaatataaaacagaaaacaaaataccaggtttcaaactaaacctagtaacccaccacaagacagtgagttattaacagggagacattccactgggtaaggcaaaaacctagccwtctgtttaaaagagacccaaaccagactggcactgaaagttgtaatatgggaattatcaaagatatatcaaagaaatgccaaccaaaaaagggcaggcttagcaatgtaaatatgaaacaaaaaggagtgaacagaaagagggatattttatattttaatggggatgccacaataagaaaaaagaaccatgaacctttacctaccaaaacgcacagcaataaacacaaaagcagggcccttagagctgtcaaaatgacacatccacagcctacccagagagctgaccacagcctctctga

SEQ ID NO: 144081 - DNA, 601 bp, Human
cgggtacagtggctcacaactgtaatcccagcactttgggaggctgaggtgggtggattgcttgagcccaggagttcgagaccagcctacgcaacatggtgaaagcctatctctaaaaaaaaattttaaaagttagctggatgtggtgccaagcacctgtagtcccatctactcaggaggctgaggtgggaggatcccttgagcccaggaggtcaaggctacagtgagcagtgatggcaccactacactccagcctgggtgacagtcagactctgcctcaaaaaaaaaaaaagaaaaaaaraaaaagaaaatgttagaaaacaatcaccataaatggagccgagatttgaatctacagaacaaaacatctcccagagtgtcaggcagagacactaagaaaaagacgcatctgtagacatatcttactagatgtctgaattccaaaaataaataaaaacagccaggcaaagtggcttatgtctgtaatctcagcactttgggaggctgagggaggagaatcgcttgaggccaggagttcaagactagcctgaacaacaaagcaagaccctgtctctacaaaaaataaaaaaattagcactgc

SEQ ID NO: 144082 - DNA, 601 bp, Human
aaaaaaagccgggtacagtggctcacaactgtaatcccagcactttgggaggctgaggtgggtggattgcttgagcccaggagttcgagaccagcctacgcaacatggtgaaagcctatctctaaaaaaaaattttaaaagttagctggatgtggtgccaagcacctgtagtcccatctactcaggaggctgaggtgggaggatcccttgagcccaggaggtcaaggctacagtgagcagtgatggcaccactacactccagcctgggtgacagtcagactctgcctcaaaaaaaaaaaaagaaaaaaagaaaaagaaaatgttagaaaacaatcaccataaatggagccgagatttgaatctacagaacaaaacatctcccagagtgtcaggcagagacactaagaaaaagacgcatctgtagacatatcttactagatgtctgaattccaaaaataaataaaaacagccaggcaaagtggcttatgtctgtaatctcagcactttgggaggctgagggaggagaatcgcttgaggccaggagttcaagactagcctgaacaacaaagcaagaccctgtctctacaaaaaataaaaaaat

SEQ ID NO: 144083 - DNA, 601 bp, Human
actggggaagcatttgaatatccccccatggtgatggggacggagaactgctccataaacacaggcaacgtgcctaactttcccgggaagatgaagtcaaagagcgaccacagctctcggaggttattttgcatcggtgagccagacagaatgatccgatgaggggtgcgaaactatttgaggaaaggaagcacctttttattaaatttaccttttagcaatcgccattcctaccctaaaacgctcctctgcaaattatttacacatttacttatcattcttgcatcattttggtactctycaaaacatacacattttatgcaattacaaatccttaattacatttagatgaaaaaatgagaaagaattttttcttattgttgaagctgaatactatagattagagttgggtttggttacattctaacaactggcccctacaagagacattaaataacatgaacaatcagaattaaagacatgattaagggcaaaaataaagagttttctgcattaaggaaaatgcacattttaaatttcttgtgcagttggcacaaggaaagattcaataaatgtgttactaaaagcagatagtttattc

SEQ ID NO: 144084 - DNA, 601 bp, Human
agtattatcatcctaatattttacctgtactggggaagcatttgaatatccccccatggtgatggggacggagaactgctccataaacacaggcaacgtgcctaactttcccgggaagatgaagtcaaagagcgaccacagctctcggaggttattttgcatcggtgagccagacagaatgatccgatgaggggtgcgaaactatttgaggaaaggaagcacctttttattaaatttaccttttagcaatcgccattcctaccctaaaacgctcctctgcaaattatttacacatttactyatcattcttgcatcattttggtactctccaaaacatacacattttatgcaattacaaatccttaattacatttagatgaaaaaatgagaaagaattttttcttattgttgaagctgaatactatagattagagttgggtttggttacattctaacaactggcccctacaagagacattaaataacatgaacaatcagaattaaagacatgattaagggcaaaaataaagagttttctgcattaaggaaaatgcacattttaaatttcttgtgcagttggcacaaggaaagattcaataaa

SEQ ID NO: 144085 - DNA, 601 bp, Human
agggcagacgccacagcgggcctagcctgcccacagttccaggatcatacctcaccagactctctcatccgcagaggagaatcagagtgaagggaaagacacacttgtgctttaggaatgcttcgttaactcctggatttacagacctgttcatttttatctggcaaagaaaggctcatcttgacatctgacttcattctccgcagtaggtatggatttatggtatctcgtaagacacatgcacacttgtaagcagttttgacctttaataagagcagagaagggaacattactatatatrtttaaggaacgcatttgttcttacctctcaattgcttccattccttaaaaaaaaaaaaagaataaccaacagctgtataaagtcagtgggaaatgattgcaaaatggtttgaaaaagctagcataagttccatatactccaaggggtggtagctttcataatattatcagttaaaaaaattatctcattaaccaaaatgtacaacaaaagaaaaactgataattttgtgccttatttctcttatacactttcctttaattattactatacagttaaaccctaaagtagagacttactggg

SEQ ID NO: 144086 - DNA, 601 bp, Human
tttaccccaactctaggaatgaatgctatggataaactgctgaagatggttcctgtccatttgactctgaagggtgtcttctttcacgttgaagaacaggagacaatcaaaatgtgaaacgtatgctgaagccaaccagaacatcaaaggacagtcaaaagcgctaaccatgaaactatatttctactaatacattcttttaaaaaaaaaataaaaacaaacctgcgtgtccgtgcttgggttccagtctgggtcatagatgacaactctgtttgcccccgtcaggttgacacctaagccrcccacccgcgtggtcagaagaaacacaaatatggatgtgtcctagaggtaagacacacaacactgagcacacacacttaagaccagttacagttctcagcctctgcctccacatattgtacacatggaattactgggctgttcccaatataaggaatggtaatgtcctagagacctctggtgaatcaaaatctcatttcacagcttttacttttaatatttaatagaaatatttaaaaattgggtttttaggaggaaaatacatgctgtagaaaacgcattctttgtttgaacatacaca

SEQ ID NO: 144087 - DNA, 601 bp, Human
acctgcaaaaattgcacttgtttcagtgctctgggatgcatcaggactagtcagagtaaatagctcatagagatcattggatttgaaaaaccgcctttgttttgggtcttttagcactctatttgtcaaaaactgcttgaagatttgtctaaaaaaataaaagataagctggtataaaacaatgtgtagctctacctaaaaattcaagttataaagcaatataagagagagatgataacagctgctgcatgaatggctaaataatcccccaaactttcagccttggaaaattacaattcargaaatatataatacatcagttaatctcccaggtcttgcagaatttaaattagaaataataccttattatttacaccgaatgagctttttcaacctccaagatctaacacatttcaagaaacaccttttcacatgccatcatgtgactcatagtctctcttagcctccttgacttgaataccaagggtcctgccctgcctagaaccttcctatcatagggctcagcaaactctcttacctgggctttgcaatgtctccactctgacctctctctccctgctcccacctgcaggtccacact

SEQ ID NO: 144088 - DNA, 601 bp, Human
aaggcatctctaatcactgagaaaaacttatttgaaataaatgatgctacaaacgttggggcacaaacgttggggcattttatctttgaaccaagataaaatccacacctcatactccaaatggatcagaaatctgaatgtaaaaagcaaaaccatacaagtagtacaagaaaacatggcgaattatcatatgatctatatgtagaaaaggcttagaactacaattccaattaataaaagactgacaatttttttaaaaaaaaacctgtttcataggaaaaaaatcataataaaggacaaycaatgaggaaatacttgtaacatatatgaaaaatgaaaagctaacatccctaatatataaagaactctttaaaaccaaggggaaaaagggaccaaaaacctgatttagaaaatggacaaaagacatgaacagacaagttcacagaaagaaaaattttttaaatataaatggtcctataaaaagttcaatttcactcaaagaaaataactggaaattaaaacttaagatatcctttctcacctatcagattgggaaaaattaaaagtgtaacaccacactcttgacaagcctctgggcaac

SEQ ID NO: 144089 - DNA, 601 bp, Human
gacactgtgcacgccaactagcaagaaaagaaatagcaaagtgatatttcactctgtatgcaagaaagacacttttctcctctgtataagtacagtactgtagtagacaaaaacaaagtgatagtacacttagaaaaccctagagaatcaatgataaaaaatagtaagataattcaagcaacataaaaaatataaaattcacacacagaaacctataaccttcctatttacaaacaatagccagctaaaaatataatggtgggaaaattctatttacagtaacagaaaagaccaaacactyaggaataaacccaagcaatgtgtaaagcctatatggagaagacatgaaaacactcctgggaagatagactatcagacttaaacaaacagaaagacatcccttgcatttgagtagaatgactcaataaccattttccctgagttaatttatatgtttaatgtaatctcaataaaaatgtcaacctttcttatgaagctagacaaactgacactaaagttcatacagaacaataaaccttcatgaacagatcagaaaacactgaaaaggcaaagtaacaccctattggacaataaaacacgc

SEQ ID NO: 144090 - DNA, 601 bp, Human
ctctgcttaaaggaaagccagggtaaactgaataccctacagctttccacaaatacatgtcttatcatttattaccatactatttcatgctttactaataaaaatactcaccaatttaccagtaccttgaaaagaggatctttccaagaaaattaatataattatcaaacaacaaataacaaacctgacctttgtgggtggcaaatggtaaatataaatgtttaaagtttaagcatcaaaataatgctgttatcagatattgatgaacttattgaacaggtctgactgaatgtaagacctstttttagcaccaataaaaaaaaatattgagatttctgttctgcaaacttctaactgtgctccctgacagcatcttttgggtaaaggaacaaatgtgctccaaggagtaactgttaggtacctgatttacaatataattagattgccaaaaaaaaaaaaatcaatccaagtattttctcctttagctagcattattaaaacttttaactttcagagaagagtttcttcttccttaaagttttaattctgaggtagacatcatgcaaacaaacatcaagtgcagccaacttccattgacaaa

SEQ ID NO: 144091 - DNA, 601 bp, Human
aaatgctaagagcttaacttccaaatcccctggccaggctaggccctatctttccttccagggcctctcttcatcccagcttccacttctgatagctttgagcccagtgattttgccttagggtggggctgaattcctactccaagccctgcaagtcccagctccagctgctatcactagttcagccttggagccttaggcaccatgttctccactggcctgagacaatgccatcctccctgggcaggcatcctccctcccgccccagccagccttcgggtggcagagcaacacacctgayttcaggtggttgcatgtgtttcccctctcccacacttgtctttttgccactcctcttcccccttcccccttcccctttcccccagccctcatttgaaaccctgagcagaattttctggcttctccccaagaagctgttcactccattgccctgaattctgcagctgacaaacatctattgtcacctctggtccactggcatgcttctctacccaccccattgggctgtggcttccttcagagcaggctctgtttctccatcgtctctgagtccagcccaggatctgactcacatgaactg

SEQ ID NO: 144092 - DNA, 601 bp, Human
tggagcattgatctgagactcccaggtccaaagacactccttagcacagggccagtaagtccaggagagtctggggaggatccctggggggttgagatgtctgagctgcgatttcctgctttattcctttttacccactgctgattccctgttagccaggctaagtcacagcgcactgtcagagcctggaagaaggggagcagtgtctggcagaggatctagccagacttgtgggcccttttggccaggtcactaactgggctgggctttctgtaggtgctcacccacccatcacacagascaccccccccaccgcaagagatggaagaacaagatcagctgggttgggggcccagacctggctcactggggttgggcagggcagtctgggatgctgtccagatccatcctcgcatcattccccagggcaggagcagcccgtagttggcactgacaccccactgttgccagagaagtgaaccctagaggcaggatcagacaggcagagggccgtcattcatccatcagcagcaggggcagagaaggaggtgcttttaaggggccccttcactctgcagcctatggggaggaaccctttact

SEQ ID NO: 144093 - DNA, 601 bp, Human
gaacagtttataaattaagactgaccaggagacaacaatatcaataacaggactatttcatcttagatctatcctttatggcttaaaagcactttcacgtacattagctctttaatcctatgaaaggcagggtttgctacccccattttacaggagaagaaactgtacaatttaagcaatattattataagttctgccttcctattgtcactggccaagtgagggacaagaagaggaaacgaatggaaaagggagtgaaagggaagggagagaacgacccaggagaaagaagcagagtggrcatggaagactgattttagctcctagtctgccatcagatttgtatgtgaccttggaccagctgctccactctctgggactcagtttcctcattcataaatgggaagtcacaaaattgaagccacacagaagccttctgtggtgaacgctgctggtgaactgagaggcacagcatgcgtatagaagggtggagttgggggttcttcctagactctagccacactttggggcccccaaagaatatgggtttcctcttgggaattcctctggaagtataagatagcgaggtcataacatttta

SEQ ID NO: 144094 - DNA, 601 bp, Human
agggagagaacgacccaggagaaagaagcagagtggacatggaagactgattttagctcctagtctgccatcagatttgtatgtgaccttggaccagctgctccactctctgggactcagtttcctcattcataaatgggaagtcacaaaattgaagccacacagaagccttctgtggtgaacgctgctggtgaactgagaggcacagcatgcgtatagaagggtggagttgggggttcttcctagactctagccacactttggggcccccaaagaatatgggtttcctcttgggaattcstctggaagtataagatagcgaggtcataacattttagatgtgcctatttgaggccagttgttcccccatttaattctctctgtgttcctctcaggtaggaattgttatttatgtcctatggatgaggagcagaggcttggagagattcggagaggaaggacatccactgcatccccacccctgcccctaacacccacatgaaacaaaattccctgcctgggttttataagtaggagggacttataagaagctcagggcatgaatcatcttctgaggaaccctcttttagaattctagtca

SEQ ID NO: 144095 - DNA, 601 bp, Human
cttccaggggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtaagaggggcagacaaggaacccatagaagaggggcgggaggcagacctggagacagagggatctcggtgagaggcaggtaggggacaaagacagggcagmaggagagatgagggacagggatgggggataggtgtgggaacaggcaggtggcatggattggaggacaggaagggacaaggatgagaaacaaacaagatgaggaatgggaaatacggatagagaaagaggcggacaaatcggggacaggaattgggacagatgaggacagagatcgcattaggaaagaagagagggtgaaaggcaggaagaagacacctgtaaggacaggcagaggacagcgatgtagcaccaagccaccaggatggggactgggacagaagaaaggagacaggagggcac

SEQ ID NO: 144096 - DNA, 601 bp, Human
gtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcaggtaagcaaccccttgtcttggtgagggagggcacagagcatacagtggccatgcgttcacgtccattaccttctccgagggggctcagcctccttccctgagtcacacagggagctggggcaccatgtctccaaagtggrgcccctacttccagtcagtcccatgtctctccaccagttgccttctaagaatgagagccgtcagtttgagaatatcctcactggactctcacttcagcactgatgcactgagggtcatgatcgagacctccacctgtacatctgttcttttccatgcagtcacccaggctctggcctttctggagaccacacacagacagacagtgttacagactgacaaataggacctttcatgtgtcagcctgtgggctcagcacttaacatgcattcatcccacttaatcctcacagtgaccatgca

SEQ ID NO: 144097 - DNA, 601 bp, Human
ccaagtatttcccagctcccacaggccaccgtatccacctcttccagacatgctctgggcccctgcacaagaccaggccatacagacactgctagggggttggaggggaagggaaaacaaggtactcatgtcaatcagctgaaaagtgtatcttgacctgggtctaggaatagacccttcacaaagcccaaggctctagccttcaaagctacaaaatgacaaaaccacagggctgacatacaaagcacatgtaggtatacatgtgaaggtgcacacacatgcacacatgtgtaggtgcacrtgcacgcatggtgtgtgttggttttccattttaatcttcctctgcatatgattgctggcttgctttttttcctccactcaccagtgtgtttaaggcccatcactgtggctctatctgttgctaattcactcttttcaatggctgggtagacatgccctagacatatacaccacatttcacttagccattccccttctggagaacagtgaggctcttgctaccattttgctgttgcaaacaaggccgagaggcacattcctcgtgtcttccggtacacacgggtacgtttctctaagcctc

SEQ ID NO: 144098 - DNA, 601 bp, Human
atgtgtaggtgcacatgcacgcatggtgtgtgttggttttccattttaatcttcctctgcatatgattgctggcttgctttttttcctccactcaccagtgtgtttaaggcccatcactgtggctctatctgttgctaattcactcttttcaatggctgggtagacatgccctagacatatacaccacatttcacttagccattccccttctggagaacagtgaggctcttgctaccattttgctgttgcaaacaaggccgagaggcacattcctcgtgtcttccggtacacacgggtacrtttctctaagcctcaggctaaaatatgcatttataagtgcaattgcttagtcataggtatgcacatttttagttttgatagacactgccctccaacagtagctgtgccaatttatattccattccccacaaacataatggattccgtgaaccatgaaacacattttcttttggctaagtttaatgttgccttctttgattgggggcagcgtggaatccagcacagtcaacagccttggcttggtccctaaactgagactagaaccaccaaacaccttgggaaccttgggcctgagcatcc

SEQ ID NO: 144099 - DNA, 601 bp, Human
ggcagtcagtgagttgaaccagtgagtatggtcgactttttctcagacattttgacactaaaaggagcagaaaaatgagggagttgctaaaagaggatgagggtcaagggaggtgtttttaggaggagagacaaatgtatggaaggaatttagtaaaagaaattgatgaagagataggagatgaatggaggggtggaattcttgcaaaggcaaaaggagatagaactcagaaaataagaggcctttggttggtacagggtgaagtggaaagcttgggcctgaggcagcagaggtaggagcrtgcagaggctcccaactggtacctcctggtctcagatcacaaccttgagataagaggcgggcagttggatgttgaagatgaaatcgactgtgtgaaatagcctcctggaaagtgggaaagaagacttgaaaaacttgataagatttatggactgtgttgagctcatatatgaaggttcaaagtgatacattttaggagaggctaattaacattgttatgtgatcttccccaccaacgctcagctcctcaggttcagccagagttggtgagtgtaactggtagggacggtgaaggtgtggc

SEQ ID NO: 144100 - DNA, 601 bp, Human
ccaccaacgctcagctcctcaggttcagccagagttggtgagtgtaactggtagggacggtgaaggtgtggccaagaacggtcatgctggaatctgagctgagtaaggaagtgtgttcaagtctgctcagcaggttcaagtctgctcaggcagccgtaacaaagtaccacagactgggaggcttcaacaacagacacctgctatcttacagtttagcaggtgggtttctcctgacacctctctccttggcttgtcgatgccaccttctctgtgtgtcttcatgtggtcttgcctctgtgcrtatctgcatcctaatctcttcttataaggtgaccagtcatatgggattaggcttcacccaaatggcctagtgtaacttaattgtctctttaaaggtcccatctccaaatacagttacattctgagcttctgggagttaggacttcaacacaggaattttggaacgacacaatttggcccataagaggaatgaagtgacagacagggtaaatgacagatggtgagagcatagcagggccgaggggtttggccgtctcagtgacatgagatgtgttcagtgggtatcagaggatgtgaacta

SEQ ID NO: 144101 - DNA, 601 bp, Human
cacccacagcagtatcctgattaactccacggaaagggttgagctattttaggggagcatagctcccaaccctctcagctgaagccctaagatcctgcccccacttcctggagcctgggtacagggacagtgctcatgggcacagagtccaggcaagcactcactggcaggaggccttggccaagctgagctcctctcagcctggtggaggtctagaccaaggagcctgcgctcagatgaaacacttccccggattctcatgtggtcaactaaggcctggggcaggggcttttccaccccraccctccattttatcaacctctctccttcaagacactgcccttgagcctccaccctgcccccaaccaggatgactccctcctgtgagccccaggctgcttagcctgaccctctgccacgacactgagggcatgaggcccacagggttccagggactgccagggtggcacagcccacgtgcaggggagcagggctgcctgccgcacccctcagctccagctcagacatgggctcagacacggtgcaggagtgtgtgcactgacatcaacgaaggtggcctgatcatccacaggccactacc

SEQ ID NO: 144102 - DNA, 601 bp, Human
gcgaggtgggattttattcccactgaaccgaggaagaggctatgtctgtctcctttaggggtggccgggggtgaagcaggatctgacactggaagggagcatctgcctagccagcctgagacctgcagtgccagggaggccaggtgggattctgaagacaggcttggggcctcagagggagcctgcacaccctattaggacctccctccccactgcctcgaagctgtggccttcctgaacccaggaggagccaacccgttatcctggtctggaaatttaattagacattcagccccgagtmtgggagactacagcacttgtcaatttgtaggaaaagaatggccagcttggagagccccccagccctctggctttcctgggtgctgccgtgaagagcctgtgaccagacctcagaggcagatgcttttcgtttacacagtcccgtaaatatttatccccgacagtcaattagagctgagccactgcttgcaaggagggaactgacagaaggcggctacagctgcagaaggccatggtcatggtttacaagaaccactcaggatgggggcattttgctatttacgtatcgtcatccagagct

SEQ ID NO: 144103 - DNA, 601 bp, Human
ttcagccccgagtctgggagactacagcacttgtcaatttgtaggaaaagaatggccagcttggagagccccccagccctctggctttcctgggtgctgccgtgaagagcctgtgaccagacctcagaggcagatgcttttcgtttacacagtcccgtaaatatttatccccgacagtcaattagagctgagccactgcttgcaaggagggaactgacagaaggcggctacagctgcagaaggccatggtcatggtttacaagaaccactcaggatgggggcattttgctatttacgtatygtcatccagagctaggcatgtctgctgattttaaaaccaattacacattagcactaacagcctctctgatttaattggcccagaaatacctcccgagctctcaagactgaatgtgattttcttgctctggaaaggggctgggccaatgcctccctccttcagtaggagaatgaaggcctttagggacaagagcatccaggcaggaaaggcaagtggtccagggcaagaggcctgcccttaacctaccacggctgctgtctcctggggcctgggcttcctagtctatatgaagatagcagt

SEQ ID NO: 144104 - DNA, 601 bp, Human
gctaggaggtggttttttttgttttgtttttgtttttgtttttgtatctcctgcctttctcccccaccatcctttcccccagttctggaagcctgacagctctttataccctctgcctttgtgggaagagtggttagaacccagaagaaagaacacttcttggttcttaagttcttttttgaaattaaattgtacttattttgggataactgaagattaacatccagttgtaagaagtaatacagagatctcatatgtacccatcttccaccaatggtagcattttccaaaactatagtayaatatcacaaccaggatactgacattgatacagtcaagatacggaacattccatcaccaccaggatccctcttgctgcccttttataaccacacccacctcacccccttcttaactcctgggcaaccacaaatctgttctctatttcaataattttattgcttcaggaatattatatacatgaaatcatatagcatgtatgatgcagggtctggcttttttcaaacagtataattctccggatggagatttatccaaatcgttgcatgtatcaacagttctttcctttttattgctgagt

SEQ ID NO: 144105 - DNA, 601 bp, Human
tttcccccagttctggaagcctgacagctctttataccctctgcctttgtgggaagagtggttagaacccagaagaaagaacacttcttggttcttaagttcttttttgaaattaaattgtacttattttgggataactgaagattaacatccagttgtaagaagtaatacagagatctcatatgtacccatcttccaccaatggtagcattttccaaaactatagtacaatatcacaaccaggatactgacattgatacagtcaagatacggaacattccatcaccaccaggatccctcwtgctgcccttttataaccacacccacctcacccccttcttaactcctgggcaaccacaaatctgttctctatttcaataattttattgcttcaggaatattatatacatgaaatcatatagcatgtatgatgcagggtctggcttttttcaaacagtataattctccggatggagatttatccaaatcgttgcatgtatcaacagttctttcctttttattgctgagtgatattccatggtgctaggtatcagtttctttcattgtttacccatcaaaggacatccgggttgtttccagt

SEQ ID NO: 144106 - DNA, 601 bp, Human
gtgaacatttgtgtacaggtttttgtgtgaacctatgttttcacttactggaagaaaatgcccaggaatgaaatttctaggtcacaccataatagtatgtttagttttttaagaaactgctaaaatgttttccagagtgactgtaccattttacattcctgtcagcaatatatgtataatccagtttctatgcatctttgccagcatttggtggtgtcacttttttttattttaaccattttgataggtgtgaagacaatgcaatccaccacattaacagactaaagaaaaaaataacatrattatattaatcaatacagtaaaagcatttggcaaaattcaacaaccattcatgataaaatctcttagagaactaggaccagaaaggaacttgctcgacctgatacggaacatctacaaaaagcttatagctaacatcttatttaaaggtgaaagactgaatgctttccccctaagatcagtaataagaggatacctactcttaccactctgtttaacacagtattggagttctggccagtgcattaaggcaagaaaagggaataaaagggatacagatcagaaagaaaaaaattaaatg

SEQ ID NO: 144107 - DNA, 601 bp, Human
tttccagagtgactgtaccattttacattcctgtcagcaatatatgtataatccagtttctatgcatctttgccagcatttggtggtgtcacttttttttattttaaccattttgataggtgtgaagacaatgcaatccaccacattaacagactaaagaaaaaaataacatgattatattaatcaatacagtaaaagcatttggcaaaattcaacaaccattcatgataaaatctcttagagaactaggaccagaaaggaacttgctcgacctgatacggaacatctacaaaaagcttayagctaacatcttatttaaaggtgaaagactgaatgctttccccctaagatcagtaataagaggatacctactcttaccactctgtttaacacagtattggagttctggccagtgcattaaggcaagaaaagggaataaaagggatacagatcagaaagaaaaaaattaaatgatccctacttttatgaaatgattatgtatgtagaaaatagtagcaaatctacaactccaaaaactcctagaatacatgaattcagcaaggttgcaatataaaagattaacgtacaaaactcaattata

SEQ ID NO: 144108 - DNA, 601 bp, Human
cgaacattttttagaattcaattttgatatacctgtaacttttttaaaattatctgtttgtatagctttttctaacagtttctgtaggtattaccttgtatatacataacttatcacagtttattagtgttgaaatgttaccagttctagtgaagtgtagaaagcttaccaccttttattctcctttgtttataatacacttgtcttaaatattatctctatatacatttagaaccacatcaggcaattttatgatttttgcttcaacattgaaacacagtttagaagacttaaaaggagmatgaaaatgaatttatttactcagatatttacctttcctattgttctttctttcttcttgatattccaatgtttctctttttaccatttcttttcttttaaaaaaaactttcttagggaccagctgcagtggctcacgcctgtaatcccagcactttgggaggctgaggagggtggatcgtgaggtcaggagttcaagaccagcctggccaagtagagacaaaccctgtctctactaataatacaaaaattagcctggcgtggtggcaggcgcctgtaatcccagccactcaggaggctg

SEQ ID NO: 144109 - DNA, 601 bp, Human
ctcctttgtttataatacacttgtcttaaatattatctctatatacatttagaaccacatcaggcaattttatgatttttgcttcaacattgaaacacagtttagaagacttaaaaggagaatgaaaatgaatttatttactcagatatttacctttcctattgttctttctttcttcttgatattccaatgtttctctttttaccatttcttttcttttaaaaaaaactttcttagggaccagctgcagtggctcacgcctgtaatcccagcactttgggaggctgaggagggtggatcrtgaggtcaggagttcaagaccagcctggccaagtagagacaaaccctgtctctactaataatacaaaaattagcctggcgtggtggcaggcgcctgtaatcccagccactcaggaggctgaggcagagaattgcttgaacctgggaggcggaagttgcagtgagccgagattgggccactgcactctccagcttgggtgacagagcgagactccatttcaaaacaccaaaaccaaaaacaaacaaacaaaaaaacactttatttagccattctttcaggatatgtctgcttggcataaat

SEQ ID NO: 144110 - DNA, 601 bp, Human
tgtctttatttttcaaaagtttgactatgatatgttttggtgtttgcttctttgaatttatcatgtttggggttaacttaccttcctgaatctttagatgtgtgtcctttgccaaatttggggatgcgttagccattatttatctgagtcgtttctgctctgccctctttctcctctcctgggaatttggtgacataaacatcaccttttgtctcaaaggtgccttagactctgttccttttcccccagtctaatcagtgttattccgtcttcaagttcactgattcttttctctcctccytaggttctgctgttgagtccatccactgcgctttctatattggttattctattattcagtcctaacatttctatttggttcttcttatatattttattttcttgctgagaatttgtttctttgtggagacttcttttctttttcatttgtttcaaatatgttaaaattgcttgttgaggcttttttatgattactgctttttatttattttattttaattttatttatttatttatttgagacggagtctcactctgttgcccaggctggagtacagtggtgtgatgtcggctcaatgca

SEQ ID NO: 144111 - DNA, 601 bp, Human
cactctgttgcccaggctggagtacagtggtgtgatgtcggctcaatgcagcctccgcctcccgtgttcaaactgagattttcctagttcttggtagaatgagtgattttctgttgaaacttggatatattgtgttataagacttgggatcttatttaagcttgttttaactggcttcctctgacactggtccagcaagagaatgggggaggttataacgaggtggaggtggaagcacaggcacttcactgggtctctgttgacaccctgggggaggggactccttattactgcagggttggggggtggaagttcaagctccctacacggtctctattaatgctgtgtggggaaaaggacggagggctggttattgctcaatggagatagaattctcagcttccatctgagactgtgccttctctgataccccagaagctgagatgcctcattactgactggtgatggtagacatctgggctctccacttggcctttgctggcaagggtgctgggggagggagggatgacacggtttttctctgtggtgtttggctgaagtagaacgcttattacctaaaagttttatgtcttgctattct

SEQ ID NO: 144112 - DNA, 601 bp, Human
gaggcttaaacaacagacatttatttctcacagttttggaggctggaagtccaagatgaaggtgtcacagggtaggcaactacaagccaccttctcactgtgtcctcacatggccttctctctgtgcacacatgcttggtatctcctcttcttatgaggacaccagttctattggattaagaccttatttaactttatctctgtaaaggccctccctccaaatagagtcacactgagagctgaagcttcaacgtatgacttttcaggggacacaattcagtccgtaatacccagagaatckgctgctatgatgttccttgggtcctgaggtccctggctggtctgccttcctctcgccatctttcagagtcttcttacttttgttttgaataaaatgtccaagtttttagcgggaggaatggggaaaagtatatgttcctggaatcggaagaccctctatccagagctctttaaaggtgcctgatgtaactcaagtcaaagcagttctgttttgcaagagtgagaaatacttttgtttgaattctcatagtctctgaggactgacagcataaagatcaccccctaggccagagagtcggga

SEQ ID NO: 144113 - DNA, 601 bp, Human
ctttatctctgtaaaggccctccctccaaatagagtcacactgagagctgaagcttcaacgtatgacttttcaggggacacaattcagtccgtaatacccagagaatctgctgctatgatgttccttgggtcctgaggtccctggctggtctgccttcctctcgccatctttcagagtcttcttacttttgttttgaataaaatgtccaagtttttagcgggaggaatggggaaaagtatatgttcctggaatcggaagaccctctatccagagctctttaaaggtgcctgatgtaactcragtcaaagcagttctgttttgcaagagtgagaaatacttttgtttgaattctcatagtctctgaggactgacagcataaagatcaccccctaggccagagagtcgggaagaatatgagatgtgcgatggcagatttacctcccaaaagaaaaaagtactccttcatcaggggaggaaagatgctgagataggattgggaaaggttaagaaggtctaagcccctgagaaagatcccagttcatccatctcctggactgtgagaagggggatgggcatggcatagaaatctgacttgtgcta

SEQ ID NO: 144114 - DNA, 601 bp, Human
aaaggcaagtgtcccaaagagggtggtatatgtccgggggtacttgtgcacagtagtgcacattaaagaacatctcctgagtcttgcagccctgcacagagagagataccaggtgctattttgtctgtgctcatcagagtctcagcctgtaagcttccaacctctaatgccagcctcagggctccccgaggcctcctggcctctggaatttccacactaccaaagctgtcagctccctccttgggcatgggtgtcagagcaggctcctcctattactcaatccccacctctcactattacrccgggctccttgaggaagattgattcgccactttaaaggagcctcgatgtgctcgatgaggatgccacaagacaaatggctcctgccgtgcgccttcagcccgttgtcccatgtttccattacatttgggccacagtcatggtggatgagcttgggtgtagtgctcattttctgccttacatgataaacttgtcagcatttgactgatcagctacttatatgcagggagttcatttgcaaggccacctggctccccgctctgttgtcctgctcccattttaccctgtctaatgagccagg

SEQ ID NO: 144115 - DNA, 601 bp, Human
atgagccaggacctggttcctgttgggcagcgctgggctcctgggccctgcagagcctgcacatgatggcaaggcctcagtgcctcctcacaatctgcctcccctgcctggaggtgacaagggcagtgatgcccagggagccattctttcctgctgccagccttgcattgcccagttaaaaaggagtgtgccaggcctccactctcctgcctcgagcctgcatcaaggcctgctctcagcctcctgactgagcaggcatgctgtgggctgcctcaggagctgcagtctgcccactccacamtggctttggggctgtttttaaggatcgcttagtgaaggcagctactaagccagggctctcagagttcaccctgaggtatggccaacaggaatgaggtgtacagcattcaagctgcctatggccccggcttggctggccttcaggcccatgcctttcccaagctgccaggtatcctagactctgctctgaccacactgagctcttccatgatccttcagcactccctgttgttgctggctgaagtcacatgactgagctgggcattcatagcccttgttgatgaacctgagcactggggtt

SEQ ID NO: 144116 - DNA, 601 bp, Human
cagcgctgggctcctgggccctgcagagcctgcacatgatggcaaggcctcagtgcctcctcacaatctgcctcccctgcctggaggtgacaagggcagtgatgcccagggagccattctttcctgctgccagccttgcattgcccagttaaaaaggagtgtgccaggcctccactctcctgcctcgagcctgcatcaaggcctgctctcagcctcctgactgagcaggcatgctgtgggctgcctcaggagctgcagtctgcccactccacactggctttggggctgtttttaaggatcrcttagtgaaggcagctactaagccagggctctcagagttcaccctgaggtatggccaacaggaatgaggtgtacagcattcaagctgcctatggccccggcttggctggccttcaggcccatgcctttcccaagctgccaggtatcctagactctgctctgaccacactgagctcttccatgatccttcagcactccctgttgttgctggctgaagtcacatgactgagctgggcattcatagcccttgttgatgaacctgagcactggggttggatgcctgagatcaaacccagctccc

SEQ ID NO: 144117 - DNA, 601 bp, Human
aaggaggggagaagggcagagcagggagccttgcaagggggaagaagccctaccttgtcccagcctcaccctacccccactcccccatcaattcatgaagctcaaagcctcaaaagtagttgggttttgcccttcataaggacatggcctttccccttcccattagccagctggacacctccaggccccctgtctgaactgggtccacagatcccagccctactttgcccaggccaagggaagcacactaaagtccattacccagcatggactgtgcttgccttgttcaggaggcccaggmcccaccctcagtgagtgctgatatgggggaggggaccagaccaggggtccaggggctgcaagtgctgactgtccaaagcacggtggtctgggaatggcattggggtcatgtgctgtgcagcaggggctggtggtcagggattggggggcacctctgggctcaggtgctgtgtgaggctggcctgacaagagtgcaattccacatctgcactgagcaagctgtggaggccacgtgctcagggtgttaggagtcctccagggcagggctggtactgccagaggatgagggagctcagggagg

SEQ ID NO: 144118 - DNA, 601 bp, Human
tgtgcttgccttgttcaggaggcccaggccccaccctcagtgagtgctgatatgggggaggggaccagaccaggggtccaggggctgcaagtgctgactgtccaaagcacggtggtctgggaatggcattggggtcatgtgctgtgcagcaggggctggtggtcagggattggggggcacctctgggctcaggtgctgtgtgaggctggcctgacaagagtgcaattccacatctgcactgagcaagctgtggaggccacgtgctcagggtgttaggagtcctccagggcagggctggtaytgccagaggatgagggagctcagggagggctgtcatagacagaggaggagaagggccttgtcctgggcacagcctgcgtgatgatgaggagatgggatgtccacaggatcagggaggggcaggaggttgtctgtgaggtccacgcagggatctagggtgggaaggaggtggccatggagcccacggtgccatgtttagaaatttggattctcccttgtgggcggtagaagctgtttcaagttctaagagggtaatgtggtgactgcacctccttaaggagcttacaggaaggggagtttc

SEQ ID NO: 144119 - DNA, 601 bp, Human
gcattgagaagacctaggggatggtcttaaagatttactaaccaccctgggaaggggagctgtccacatgcccaaggaaggcaaaacgcaggcgagagctcccaccattatatctgtgatccaggcagcaggatggaggaaggtgggaagcaggacaaagagcacatgctagttatctttgaggaggttccccggaagctgtggtgtagttttttgagatcttgctcatagaatttagacacctggttacccctagctgtaagggaggctgggaagtatagctctagtttgttatccatgyaccaagctaaaaaccaggggttctacaagcaaggaaagaaaggacatgtggtgtgcaactaggagtctctaccatgtaatgaacctttccctgcaaatgccatgcacccatcttcccacacacagagcactctcacccctgccctgggtgcctcatcctgtcccagcatccagcccccaaggtcaggctctcctggtgatacgcagccctcaccattgggtcttgaagtgactccttggaattttaaaccaaaatgttaaactttgggtggactttttaacttttggtgaactttaaacc

SEQ ID NO: 144120 - DNA, 601 bp, Human
aggacaaagagcacatgctagttatctttgaggaggttccccggaagctgtggtgtagttttttgagatcttgctcatagaatttagacacctggttacccctagctgtaagggaggctgggaagtatagctctagtttgttatccatgtaccaagctaaaaaccaggggttctacaagcaaggaaagaaaggacatgtggtgtgcaactaggagtctctaccatgtaatgaacctttccctgcaaatgccatgcacccatcttcccacacacagagcactctcacccctgccctgggtgyctcatcctgtcccagcatccagcccccaaggtcaggctctcctggtgatacgcagccctcaccattgggtcttgaagtgactccttggaattttaaaccaaaatgttaaactttgggtggactttttaacttttggtgaactttaaaccaagaggcaggctgtgtacccccacacccagtaccgagcagtggagagaacatcgtcagcacaatagactcctgtttggaagaaatgggaacacgcagcgggagcaggcctggcccccaacaggtcctgccgggtgggcttggtgaacctcc

SEQ ID NO: 144121 - DNA, 601 bp, Human
gttgcctctgtgcccgcaggacgcagagcagcaggaagctgatccgagcagactccgtcagcgagctccccgccccccggaggctgcggtggaaatgctccccggaaattcaaggccacttagcctcctcggcagaaaaacttcaacggtaaggataaccgaagtctcctttgaggggtcccctagggaccaccccgcccttgcctactagctcccaaggctccctggaagtttccaaagaccccagctcctctgcctctccttgggctccacctcgtccccatccctcatgtagtcaaaytaaaggagagatacaactctggggaaataaccttgctgaagtatccatcatttctctaaaatgcaaacgcagggctattttttttttttttttttttttttttttcagtttcacctgactgagcagagtcaaggccgggaaatcatcccctgctttagggggagtaataaacaactggtttgaataggtcatttgaattcaagctatttaaatttgcttgaatgtacagtgcaacttgacaaaggggcctttttccccaaggggagggggccgttcaggccctaacgggacccaggcagg

SEQ ID NO: 144122 - DNA, 601 bp, Human
tcaacggtaaggataaccgaagtctcctttgaggggtcccctagggaccaccccgcccttgcctactagctcccaaggctccctggaagtttccaaagaccccagctcctctgcctctccttgggctccacctcgtccccatccctcatgtagtcaaattaaaggagagatacaactctggggaaataaccttgctgaagtatccatcatttctctaaaatgcaaacgcagggctattttttttttttttttttttttttttttcagtttcacctgactgagcagagtcaaggccgggaartcatcccctgctttagggggagtaataaacaactggtttgaataggtcatttgaattcaagctatttaaatttgcttgaatgtacagtgcaacttgacaaaggggcctttttccccaaggggagggggccgttcaggccctaacgggacccaggcaggagggcctggggcagcagcaagcagtggtggcagccacatcctggcaaccacgtctgcactgtagctgttgattctcccattcagtaagcaagcacgaatgcattcattcactggtttgctcattcattcatcaaacatgtgc

SEQ ID NO: 144123 - DNA, 601 bp, Human
gctcccaaggctccctggaagtttccaaagaccccagctcctctgcctctccttgggctccacctcgtccccatccctcatgtagtcaaattaaaggagagatacaactctggggaaataaccttgctgaagtatccatcatttctctaaaatgcaaacgcagggctattttttttttttttttttttttttttttcagtttcacctgactgagcagagtcaaggccgggaaatcatcccctgctttagggggagtaataaacaactggtttgaataggtcatttgaattcaagctatttmaatttgcttgaatgtacagtgcaacttgacaaaggggcctttttccccaaggggagggggccgttcaggccctaacgggacccaggcaggagggcctggggcagcagcaagcagtggtggcagccacatcctggcaaccacgtctgcactgtagctgttgattctcccattcagtaagcaagcacgaatgcattcattcactggtttgctcattcattcatcaaacatgtgcagagctctggtgtgcacccggcccgtggtaaggctctgagaacacagaaagttaagtaccatgggacc

SEQ ID NO: 144124 - DNA, 601 bp, Human
ctcccaaggctccctggaagtttccaaagaccccagctcctctgcctctccttgggctccacctcgtccccatccctcatgtagtcaaattaaaggagagatacaactctggggaaataaccttgctgaagtatccatcatttctctaaaatgcaaacgcagggctattttttttttttttttttttttttttttcagtttcacctgactgagcagagtcaaggccgggaaatcatcccctgctttagggggagtaataaacaactggtttgaataggtcatttgaattcaagctatttamatttgcttgaatgtacagtgcaacttgacaaaggggcctttttccccaaggggagggggccgttcaggccctaacgggacccaggcaggagggcctggggcagcagcaagcagtggtggcagccacatcctggcaaccacgtctgcactgtagctgttgattctcccattcagtaagcaagcacgaatgcattcattcactggtttgctcattcattcatcaaacatgtgcagagctctggtgtgcacccggcccgtggtaaggctctgagaacacagaaagttaagtaccatgggacct

SEQ ID NO: 144125 - DNA, 601 bp, Human
tttctctaaaatgcaaacgcagggctattttttttttttttttttttttttttttcagtttcacctgactgagcagagtcaaggccgggaaatcatcccctgctttagggggagtaataaacaactggtttgaataggtcatttgaattcaagctatttaaatttgcttgaatgtacagtgcaacttgacaaaggggcctttttccccaaggggagggggccgttcaggccctaacgggacccaggcaggagggcctggggcagcagcaagcagtggtggcagccacatcctggcaaccaygtctgcactgtagctgttgattctcccattcagtaagcaagcacgaatgcattcattcactggtttgctcattcattcatcaaacatgtgcagagctctggtgtgcacccggcccgtggtaaggctctgagaacacagaaagttaagtaccatgggacctgcactccatatttgagtggaataagtagactcccaggccaaaacgtgtgatacagtaagattaatgccaaaagcagaaacagccatgctgacctgaacccacaaaaatatagaagctgaactctgtcaggactgtgaggg

SEQ ID NO: 144126 - DNA, 601 bp, Human
aatttgcttgaatgtacagtgcaacttgacaaaggggcctttttccccaaggggagggggccgttcaggccctaacgggacccaggcaggagggcctggggcagcagcaagcagtggtggcagccacatcctggcaaccacgtctgcactgtagctgttgattctcccattcagtaagcaagcacgaatgcattcattcactggtttgctcattcattcatcaaacatgtgcagagctctggtgtgcacccggcccgtggtaaggctctgagaacacagaaagttaagtaccatgggaccygcactccatatttgagtggaataagtagactcccaggccaaaacgtgtgatacagtaagattaatgccaaaagcagaaacagccatgctgacctgaacccacaaaaatatagaagctgaactctgtcaggactgtgagggagggccttgtagagacgggccttgaaggatggataggagttcatggtgcaagcagatggggaagaggcagaaaggcagcttcttcaagcttgtacaagttcataatgatgaaggctggtttggagaccagcaagtgagagaatggccagagtggggccac

SEQ ID NO: 144127 - DNA, 601 bp, Human
tgggaagctgaagagcgggaaggacccatccactgggagctgctggagagggtgcctggcttcagtgggcatggaggggcctcaggtgttctataaagtggtgctcacatctcagctttgcagggttgttcaggagctaagtcaggggccaaggcagtgagctggtgggctgctgagtcctcagtgggtaaaggagtccactcacttccagggacctgagcagaccccacattccccaaggcccccagctccaccctccagaggctgaggagagccaggaaaggcccatggatggggaagmaggaggcttcttcctgggggtcctgaggggcccatacaagtgggtgaggcccgagtgggcacagcttgggggagagatttccaggtggctgtggtgatagtgagctcagtctgtcccagacgtctgtcaacaggtaggtctaaggagcgagtactcatgggaactgggtctcctccaagtccccctgtgttcctagcacctggccccaccgagagctgagctgctgtgagcaggaggaatacttcaaggagaggcaggcagggagcatggagtcccgacagaaggtgtgcgtgtgggctc

SEQ ID NO: 144128 - DNA, 601 bp, Human
ccaggtggctgtggtgatagtgagctcagtctgtcccagacgtctgtcaacaggtaggtctaaggagcgagtactcatgggaactgggtctcctccaagtccccctgtgttcctagcacctggccccaccgagagctgagctgctgtgagcaggaggaatacttcaaggagaggcaggcagggagcatggagtcccgacagaaggtgtgcgtgtgggctcggggttcccactcaggctatgcgctctccagtggggaggcacatagaccttgccagacactgctccagtgggcagtcagcycagaccccagactcctgatggaggaggagattgttcaatatgagggtcagccagtgctccagagtctcagtgcagacttggaaaatgttcctgttactccgacagtgaattacaaaatcccgggcatgtcacctgtgtcacagttaatccctgactcactaacacagccaggcccacctccccacccactctccagagcagggccgacaccccactcagctgagctcaccttgggtcatagtagtcctggcctggtttgtcttctgacactttcataggtcaaggcatgtctctgacacc

SEQ ID NO: 144129 - DNA, 601 bp, Human
gtgagcaggaggaatacttcaaggagaggcaggcagggagcatggagtcccgacagaaggtgtgcgtgtgggctcggggttcccactcaggctatgcgctctccagtggggaggcacatagaccttgccagacactgctccagtgggcagtcagctcagaccccagactcctgatggaggaggagattgttcaatatgagggtcagccagtgctccagagtctcagtgcagacttggaaaatgttcctgttactccgacagtgaattacaaaatcccgggcatgtcacctgtgtcacagtkaatccctgactcactaacacagccaggcccacctccccacccactctccagagcagggccgacaccccactcagctgagctcaccttgggtcatagtagtcctggcctggtttgtcttctgacactttcataggtcaaggcatgtctctgacacctcagtgcactcctgaagggcagggactacgtccgcaccttccagaacgctaggacacagaccaggctctagaagcccggggaaaccccagatgcatgcatactgttttgcatgcaataaaaacatcttttctttttcttcctcag

SEQ ID NO: 144130 - DNA, 601 bp, Human
gaatagtaaagaaccttgacttcattgtctataagtttgacaactatgggaaaacattcattaagaagcagaaatgcagccctgatgccttcatccaggtggccctccagctggccttctacaggtgagtgaaggtggagtgagtctgtaccctggagggctgacggacacagtgctgtaggatctagggtctagaagcatcctggagggagggacagccttctgtgggcctggaagactggagagggactgaggctgcatgaaggaggagcagactgaactgggttacaaatccaacctsagaacaagaaggatgtgccatcagggaactgcctgggtgatggcacaggggcacggagctccaaaggactggagtgtagagctgagaagagccaggaggggatgaggaccatggttggggttggggggctgctctccatcccaacttcccccacctcacccaagccctattgctgcaacctgttcctccccagtcttcccaatcttgctaaggaaatggaaccagcagctcccccagctgatcaagacaaagattttggactcatccttgattctgccctttctcgtatccccgcacact

SEQ ID NO: 144131 - DNA, 601 bp, Human
taaagaaccttgacttcattgtctataagtttgacaactatgggaaaacattcattaagaagcagaaatgcagccctgatgccttcatccaggtggccctccagctggccttctacaggtgagtgaaggtggagtgagtctgtaccctggagggctgacggacacagtgctgtaggatctagggtctagaagcatcctggagggagggacagccttctgtgggcctggaagactggagagggactgaggctgcatgaaggaggagcagactgaactgggttacaaatccaacctcagaacragaaggatgtgccatcagggaactgcctgggtgatggcacaggggcacggagctccaaaggactggagtgtagagctgagaagagccaggaggggatgaggaccatggttggggttggggggctgctctccatcccaacttcccccacctcacccaagccctattgctgcaacctgttcctccccagtcttcccaatcttgctaaggaaatggaaccagcagctcccccagctgatcaagacaaagattttggactcatccttgattctgccctttctcgtatccccgcacactgccata

SEQ ID NO: 144132 - DNA, 601 bp, Human
aatggaaccagcagctcccccagctgatcaagacaaagattttggactcatccttgattctgccctttctcgtatccccgcacactgccatatccgttctcctccaaatgtctctcacctgccctccacctccactgccattggcccctcccaggccaccatcagctcatgcttagccaacggcagcacttccctagggtcactgcttccagtgttgcccctggtaatcctgtcttcatgaagagtgaactttgaaatatgcaaatcagactagattactttccacatgaaacttcccagygccttcacaccaggcttagaacaaaagacaggcttagaagtgccccctgtggactggccccacctgaggccctcccacacccccagctctctcctgcctcctgacctttgccctggctgtgcctctgccacccacggaaggtgtgcgtgtgggctcagggtcaccaccctccacacgcaccagccctttccagcccagtttccatccctcgaagcctttccccacccccttatctaaagcagccccctgtggcccccttgccacccattctctgtcataccacattgaattttctttttc

SEQ ID NO: 144133 - DNA, 601 bp, Human
cccacacccccagctctctcctgcctcctgacctttgccctggctgtgcctctgccacccacggaaggtgtgcgtgtgggctcagggtcaccaccctccacacgcaccagccctttccagcccagtttccatccctcgaagcctttccccacccccttatctaaagcagccccctgtggcccccttgccacccattctctgtcataccacattgaattttctttttctttcaggcagttgttacttctgtgaattatcttgtttgcaggtttgctggctttgttttctagactatccccgygaccctgacattctgggcatctcgcatgcctctgagtccctagcacccacaccatacctggcacagagtaggtgccagagactgaatcacagacgggaggtttagccagaagtggtccggccaggtctgggatttagacctggtggcccaggtagctgtgtgtcggggaaggggtgaatagtagggaaatcaggagtgaaggcaggggagaggtcaattagccttacaggaggcgaagaaaccaaaatgtgaaatagatcttcctggagatggggccagctcctgacagttccagggctg

SEQ ID NO: 144134 - DNA, 601 bp, Human
tggccaaagaggatctgcttcccatgagcagcattcttcaggctctaagctgtaataatcacaattgtttttatctgcccccagattcagcagaaacctagaggctgcctgaattcgggttggtcaatgactggccagtgatggtgtttgcctccagggaccatagagacaggacaggagctccttgccagagtcttggggaaatatgtcagagtgtacaggaaggtcattcccttgctcaccaagcaagacagtgtcacacaccctgcagacttggacatggccttcccaaacctccagsagcccagccagtgagggagagacatcctgagagggctgagatgtggggccacgacttgctgggtgacattgggctgtcactgcttctctccaagctctgtgtcttttttcctcccccactcccaacatcaaggactttaccaagtggtgagaaagggagtgtgcccaccaggggtgcaagcccagggacgctggcccagttaccatgcataaggacagaggagtcccctggctggtggggaagcagccactgctgctcaggacacagtcatcagggaagagaggcacagccatggtgccc

SEQ ID NO: 144135 - DNA, 601 bp, Human
tttatctgcccccagattcagcagaaacctagaggctgcctgaattcgggttggtcaatgactggccagtgatggtgtttgcctccagggaccatagagacaggacaggagctccttgccagagtcttggggaaatatgtcagagtgtacaggaaggtcattcccttgctcaccaagcaagacagtgtcacacaccctgcagacttggacatggccttcccaaacctccaggagcccagccagtgagggagagacatcctgagagggctgagatgtggggccacgacttgctgggtgacaytgggctgtcactgcttctctccaagctctgtgtcttttttcctcccccactcccaacatcaaggactttaccaagtggtgagaaagggagtgtgcccaccaggggtgcaagcccagggacgctggcccagttaccatgcataaggacagaggagtcccctggctggtggggaagcagccactgctgctcaggacacagtcatcagggaagagaggcacagccatggtgcccatgggtctgtcagaagcccagctgcccctggaagggagggcctggacagccgtttacgcttaccaccac

SEQ ID NO: 144136 - DNA, 601 bp, Human
cacaaggctgctgtgccagtaagtcccgccccaccccacggccacaggaaaccagtgaggctgctgtggttgccctgggttgcagtgggctcggccctctgaccaccagatgctttggctccaagcagccttttaaaccccgcgctgcctctgtgttctgttgacaggcttctgagaagcttctgctcctgaaggatgccatccgtgcccagactgcatacacagtcatggtgagtgacgtcgcaccacctcacaacactgcacttgagctgtgcctggggcctgccagaatgggcaccayggcataagaccctgtgtgagggcccagccacctgttactcggggacttggcaaggccacttcaccactcggtctcttgtttcttcgttttagaacctaagtaacatagcattcctgtttttgacatggattttataagaatacaaaagttaccacttttcaaaccctttgaaacaaccatactgacaataatagcacctaatatgtatagcatcttgcagtttatacaagaggagtcaactgtgaggggaaggggctcaagcctggcaagcgatgggggtcacacaccttccccaatctc

SEQ ID NO: 144137 - DNA, 601 bp, Human
ggctgctgtggttgccctgggttgcagtgggctcggccctctgaccaccagatgctttggctccaagcagccttttaaaccccgcgctgcctctgtgttctgttgacaggcttctgagaagcttctgctcctgaaggatgccatccgtgcccagactgcatacacagtcatggtgagtgacgtcgcaccacctcacaacactgcacttgagctgtgcctggggcctgccagaatgggcaccacggcataagaccctgtgtgagggcccagccacctgttactcggggacttggcaaggccrcttcaccactcggtctcttgtttcttcgttttagaacctaagtaacatagcattcctgtttttgacatggattttataagaatacaaaagttaccacttttcaaaccctttgaaacaaccatactgacaataatagcacctaatatgtatagcatcttgcagtttatacaagaggagtcaactgtgaggggaaggggctcaagcctggcaagcgatgggggtcacacaccttccccaatctcaggcaaaacagtatctgttcccacctagggctgcttttgcctctcattctctgtatat

SEQ ID NO: 144138 - DNA, 601 bp, Human
catactgacaataatagcacctaatatgtatagcatcttgcagtttatacaagaggagtcaactgtgaggggaaggggctcaagcctggcaagcgatgggggtcacacaccttccccaatctcaggcaaaacagtatctgttcccacctagggctgcttttgcctctcattctctgtatattcatttatactacctgtgaataaaaagtctttgctgaaaattaatagggaaatcaaacttgcaagggaaatgtttctctagcttagagaaataattcattttctggcactgcaaagctawtgtttgcaatagcaaaatagagaataagcagtgacttgggcggctcatcaatacctgcattgcaagtcattctaatacagtctttgaaggatcatataatctatgagaaggagctgaacaaatttcactatagatacttgaaaacagaaacaatgcatttctggattttagaactagccaacatagacttctctctaattcagttgctaggtccctaattcatctaaatacttcagtgtttgttctatttggggaaaacatagcacccactcatgtattcagtgggtttttttttttttt

SEQ ID NO: 144139 - DNA, 601 bp, Human
gctaggaaacaaaatatgaagtccataagccctgtccttagggaggttaccatgtagttgggagaagaggcccttcaacgtgaacaccaatcccatgtgaaaagagccctcagaaagtagcaggggacatggaggagccagctgtttcctctgcttgggaaagccaggaagaattcccagggaaagtggtgcttcctgtgagccacaaaggatgaagagaggcttgtcaggcagacacagaagggaaagatggctcaagaagggcaccacgtgcaaagactgagagccttaagagaataaracccattcgaggaaaagcagagcacagcttgcaaaggacagtggggcaggggagatgttggatttccctgttacaaagtgtgttatggtgactgggtggaagaaggactggttggaattgggggtgggaatgtttgctgagaggcagagttgctggttaagaacctttctaatatggaggaagagctggtgtttggactggagtaggacaggggcagggtgaaggggaagtcgtaaactcctcctcttggtggaagaaactcttcgcgcatggtggactgcacacagggttactgtcact

SEQ ID NO: 144140 - DNA, 601 bp, Human
atgaagagaggcttgtcaggcagacacagaagggaaagatggctcaagaagggcaccacgtgcaaagactgagagccttaagagaataagacccattcgaggaaaagcagagcacagcttgcaaaggacagtggggcaggggagatgttggatttccctgttacaaagtgtgttatggtgactgggtggaagaaggactggttggaattgggggtgggaatgtttgctgagaggcagagttgctggttaagaacctttctaatatggaggaagagctggtgtttggactggagtaggacargggcagggtgaaggggaagtcgtaaactcctcctcttggtggaagaaactcttcgcgcatggtggactgcacacagggttactgtcactctctctgaaaccctccaaaaacaacagcaagggatttttgaaagccgtaaatacaccagggcaaagagaacaggaaaggagtggcagcaacatgttagagctggaaagtagaacacatggcgactgactcagcaaacagtgagagaagcttgggagactgggtaatttatgaagaacagataattattttttaaagttctggaggtcggac

SEQ ID NO: 144141 - DNA, 601 bp, Human
tcctcctcttggtggaagaaactcttcgcgcatggtggactgcacacagggttactgtcactctctctgaaaccctccaaaaacaacagcaagggatttttgaaagccgtaaatacaccagggcaaagagaacaggaaaggagtggcagcaacatgttagagctggaaagtagaacacatggcgactgactcagcaaacagtgagagaagcttgggagactgggtaatttatgaagaacagataattattttttaaagttctggaggtcggacgtccaagatcaaggtgccagaaggttcrgtgtctggcaaagcctgctctgtgcttccaagatggtgccatgttgctgcattctcctgaggggacaagtgctgtgtcctcacatagtggaaggtggaaaggccgagggctgaacactgtgtacagcctcttgtataagagccttaaacccgtttatgacctaatcacctcctgaaggtcccaccttctaatactatcataccattaagtttcaacacatgaagtttggacaggacccaaacatccaaaccatagcagttgatgatctatataaaaagcagttagaccctcagttcctct

SEQ ID NO: 144142 - DNA, 601 bp, Human
agtacacctagagagcaatcagtccataaagaagcaagaagtgagaggacaaatgaaattcttgctgcatgtttaggaatcagttagaaacagatacatggggcctggcacagtggctcatgcctgtaatcctagcaccttgggaggccgaggtgggtggatcacctgaggtcaggaattcaagaccagcctggccaacatggcaaaaccccatctctactaaaaatacaaaaaatagccaggtgtggtggcacatacctgtaatcccagctactaaggaggctgaggcaggagaatcacwtgaacccagggggtggaagttgcagtcagccgagatcacgccacttcactccagcctgggtgaaagagcaaaactccatctcaaaagtaaataaataaataaataaaatagatacatggaaagctaaggaagtaaaaaagtaatttatacattgtcaattctagggaaaacaaaaaattcaataagaaaggaaatctaatcatagtacactacatgacccagctgtgaatacttgcttaattatacttatgtatatcgttctgtatacatgattatgctgtatcttgatcaaactacaaa

SEQ ID NO: 144143 - DNA, 601 bp, Human
aaatagctaaaagactgtaaggaattacctttgtggggtaggaatccgtgctggcaaaatgacctaggcttttggtttatttggatttctaaacgatataaatatatgacaataacaactttaaatttattaaaatgtctaggaaaacaccctccaaagcattgccatagggttgtgttaataattttaagttgatgagaacaaccaaatcaaagagatgggtttggggaaaggagagatacaaagatgcttaggatgtgaatctggtgtgtggttggacatggagggtaaggaaaggggraaagaagcaaggaaacctaataactggtaagcatatttgccagtggtcgtggagaaataaagttccaatggcaaggtggtccagagcccccatcacttactctcccacttctatgttttcccttcctcacacttgagtttatgatcatgtttttttgcatggttgatgaaatctgtcccccactacaccataagctccacaaggactgagtctacaactgtcttgttctctgttgtggctacaggacccgcggcaccaggcatatagtaggcactcaattaagattccctaaatgaatga

SEQ ID NO: 144144 - DNA, 601 bp, Human
gtctccatcagcccctagaattgctccaaataaacatgcagtccaaaaaaccagtgtgcatactacatacccagcctcaagtgggggagctgtagaatgagtacccggccccacttccagacacctcaccctccgtgaacccctcctacattgacatcctggagctttctctatatttctatcctttgataaaagtttaaatatcttgtgataaaaagaaaaagaacttttattattcaacaggctctttccccttgaaaatgtcagttgagcctgctaaggggtctagttcctgtctcaraacgatttcttagattatggatccagtttaaatgaattgatcctgagccatgaaatagcagccaagattcagtaacagatctcacaccctctatcctctatctcttgttccctgggctcctactggaggagacagcgctggttgtggtgggagtctgttcaggacagcctgggacgcccttcacaatgcttgcacaggatccggtagtctccaagctctgcacacagccttcttcccaaactctctccctgcccaagcagttggtagttgagaagaccaggccagccccattctttccac

SEQ ID NO: 144145 - DNA, 601 bp, Human
gagacagcgctggttgtggtgggagtctgttcaggacagcctgggacgcccttcacaatgcttgcacaggatccggtagtctccaagctctgcacacagccttcttcccaaactctctccctgcccaagcagttggtagttgagaagaccaggccagccccattctttccacttagagaaccaggcggatatagttgtgtaggggatgctcagactcactaacctttagctcagatgtctcaagctagaacccaacctgctctggactcattcagtgcatgtggaaatgcgcaagggcccrggagcagaggccgcatggtagagcggtcagtcctgagcagccactcatacacattgttggcagcaggcactgggtaagcatgagccgtggctgctggagtcaccagcagtcctgtagactacagagcagggaacaaggaggtgcaggaggcccacttctcatctcctgttctttgtccccaactacacaggccataacagggatggccattgacaaccacctgctggcactgcgggagctggcccgggccatgtgcaaggagctgcccgagatgttcatggatgaaacctacctgatgag

SEQ ID NO: 144146 - DNA, 601 bp, Human
gtgacaacaagcccactagctggaatcaggcaaatcctgcctctgctttttctgaactatgtgatcttcagcaaaatgatctgaatgttcattagaagatggtttactgaccaggcttggtggcttacaactataatcccaacaccttgggaggctgaggcaggaggattgctccagcccaggagtttgagaccagcctgggcaacatggggagacctcatctccctatttttaaaaattagctgggcatggtggtgcgtgcctgaagtcccagctactaaagaggctgaaataagaggaytgcttgagctggggaggtggagattgcagtgagccctgattgcaccactgcattccagcccaggtgacagagtgagaccctgtctcaaaaaaagaaaaaaggaagaagaaggtttcccatctcctaaatgggagtaatcagcagaccctacttagccgaggtggagacagtacaggaacatacccattctggtgccctaaccattacaccttactacctttcaatctattgccgcggtttccacgggctctgatgcccagcaggtctgcagtgaagtcttggcttggccagatacaatta

SEQ ID NO: 144147 - DNA, 601 bp, Human
ctaaagaggctgaaataagaggattgcttgagctggggaggtggagattgcagtgagccctgattgcaccactgcattccagcccaggtgacagagtgagaccctgtctcaaaaaaagaaaaaaggaagaagaaggtttcccatctcctaaatgggagtaatcagcagaccctacttagccgaggtggagacagtacaggaacatacccattctggtgccctaaccattacaccttactacctttcaatctattgccgcggtttccacgggctctgatgcccagcaggtctgcagtgaagwcttggcttggccagatacaattatgtagggagaaagcccagcccagggcctggcatggacagggccctctaaataggtcacagatattattataaagggccacgcaaccaacagcagaacattcgtggccagcccaacatctaaccagtgcctcagcgtgtcctgtatgagagccactgccacaaagacagaatgcaatccattagagagaggtcgtggtttaggaggggaaatgccccacagccatcaatttactaaaatgccacctcatctgcgaaaggctggatgggcagtactgga

SEQ ID NO: 144148 - DNA, 601 bp, Human
tctattttttttcccaaggaccagctaataaaattaatctggggtgtgggagttttgttgttttccaactggaaagcagcatttatggcttgaatgctttcagaaacatactttcttggtttgtgatctggattacaaaatctcagcactctgattcaaaacatactaggtgcataagtaaaactgatggcaatctttgaaacacccaactctgggtaattgtgcatggccaggctgcagggagaaatcagagaagccaggcaatactgacagtaattaaggatctgggggaaatcgacasagaggatgggccagatttcctccagttcataaattcctccctccggaaagcatctaactatggggtgccaccaggggaccatttagtaaattacctgattgcctccgtgcctcaaatggcccccaggtgaagtggagactcagcccaagacctagcaccaggtcactccgggagcttccaactccacaagtagagcagattgcacaccagggagtgggcttggggcccctcatcctctgatatcatgcagttagatgggtctgtttttatgactctggctgtgtccatccatgctaaagc

SEQ ID NO: 144149 - DNA, 601 bp, Human; identical to SEQ ID NO: 144091

SEQ ID NO: 144150 - DNA, 601 bp, Human; identical to SEQ ID NO: 144092

SEQ ID NO: 144151 - DNA, 601 bp, Human; identical to SEQ ID NO: 144093

SEQ ID NO: 144152 - DNA, 601 bp, Human; identical to SEQ ID NO: 144094

SEQ ID NO: 144153 - DNA, 601 bp, Human; identical to SEQ ID NO: 144095

SEQ ID NO: 144154 - DNA, 601 bp, Human; identical to SEQ ID NO: 144096

SEQ ID NO: 144155 - DNA, 601 bp, Human; identical to SEQ ID NO: 144097

SEQ ID NO: 144156 - DNA, 601 bp, Human; identical to SEQ ID NO: 144098

SEQ ID NO: 144157 - DNA, 601 bp, Human; identical to SEQ ID NO: 144099

SEQ ID NO: 144158 - DNA, 601 bp, Human; identical to SEQ ID NO: 144100

SEQ ID NO: 144159 - DNA, 601 bp, Human; identical to SEQ ID NO: 144101

SEQ ID NO: 144160 - DNA, 601 bp, Human; identical to SEQ ID NO: 144102

SEQ ID NO: 144161 - DNA, 601 bp, Human; identical to SEQ ID NO: 144103

SEQ ID NO: 144162 - DNA, 601 bp, Human; identical to SEQ ID NO: 144104

SEQ ID NO: 144163 - DNA, 601 bp, Human; identical to SEQ ID NO: 144105

SEQ ID NO: 144164 - DNA, 601 bp, Human; identical to SEQ ID NO: 144106

SEQ ID NO: 144165 - DNA, 601 bp, Human; identical to SEQ ID NO: 144107

SEQ ID NO: 144166 - DNA, 601 bp, Human; identical to SEQ ID NO: 144108

SEQ ID NO: 144167 - DNA, 601 bp, Human; identical to SEQ ID NO: 144109

SEQ ID NO: 144168 - DNA, 601 bp, Human; identical to SEQ ID NO: 144110

SEQ ID NO: 144169 - DNA, 601 bp, Human; identical to SEQ ID NO: 144111

SEQ ID NO: 144170 - DNA, 601 bp, Human; identical to SEQ ID NO: 144112

SEQ ID NO: 144171 - DNA, 601 bp, Human; identical to SEQ ID NO: 144113

SEQ ID NO: 144172 - DNA, 601 bp, Human; identical to SEQ ID NO: 144114

SEQ ID NO: 144173 - DNA, 601 bp, Human; identical to SEQ ID NO: 144115

SEQ ID NO: 144174 - DNA, 601 bp, Human; identical to SEQ ID NO: 144116

SEQ ID NO: 144175 - DNA, 601 bp, Human; identical to SEQ ID NO: 144117

SEQ ID NO: 144176 - DNA, 601 bp, Human; identical to SEQ ID NO: 144118

SEQ ID NO: 144177 - DNA, 601 bp, Human; identical to SEQ ID NO: 144119

SEQ ID NO: 144178 - DNA, 601 bp, Human; identical to SEQ ID NO: 144120

SEQ ID NO: 144179 - DNA, 601 bp, Human; identical to SEQ ID NO: 144121

SEQ ID NO: 144180 - DNA, 601 bp, Human; identical to SEQ ID NO: 144122

SEQ ID NO: 144181 - DNA, 601 bp, Human; identical to SEQ ID NO: 144123

SEQ ID NO: 144182 - DNA, 601 bp, Human; identical to SEQ ID NO: 144124

SEQ ID NO: 144183 - DNA, 601 bp, Human; identical to SEQ ID NO: 144125

SEQ ID NO: 144184 - DNA, 601 bp, Human; identical to SEQ ID NO: 144126

SEQ ID NO: 144185 - DNA, 601 bp, Human; identical to SEQ ID NO: 144127

SEQ ID NO: 144186 - DNA, 601 bp, Human; identical to SEQ ID NO: 144128

SEQ ID NO: 144187 - DNA, 601 bp, Human; identical to SEQ ID NO: 144129

SEQ ID NO: 144188 - DNA, 601 bp, Human; identical to SEQ ID NO: 144130

SEQ ID NO: 144189 - DNA, 601 bp, Human; identical to SEQ ID NO: 144131

SEQ ID NO: 144190 - DNA, 601 bp, Human; identical to SEQ ID NO: 144132

SEQ ID NO: 144191 - DNA, 601 bp, Human; identical to SEQ ID NO: 144133

SEQ ID NO: 144192 - DNA, 601 bp, Human; identical to SEQ ID NO: 144134

SEQ ID NO: 144193 - DNA, 601 bp, Human; identical to SEQ ID NO: 144135

SEQ ID NO: 144194 - DNA, 601 bp, Human; identical to SEQ ID NO: 144136

SEQ ID NO: 144195 - DNA, 601 bp, Human; identical to SEQ ID NO: 144137

SEQ ID NO: 144196 - DNA, 601 bp, Human; identical to SEQ ID NO: 144138

SEQ ID NO: 144197 - DNA, 601 bp, Human; identical to SEQ ID NO: 144139

SEQ ID NO: 144198 - DNA, 601 bp, Human; identical to SEQ ID NO: 144140

SEQ ID NO: 144199 - DNA, 601 bp, Human; identical to SEQ ID NO: 144141

SEQ ID NO: 144200 - DNA, 601 bp, Human; identical to SEQ ID NO: 144142

SEQ ID NO: 144201 - DNA, 601 bp, Human; identical to SEQ ID NO: 144143

SEQ ID NO: 144202 - DNA, 601 bp, Human; identical to SEQ ID NO: 144144

SEQ ID NO: 144203 - DNA, 601 bp, Human; identical to SEQ ID NO: 144145

SEQ ID NO: 144204 - DNA, 601 bp, Human; identical to SEQ ID NO: 144146

SEQ ID NO: 144205 - DNA, 601 bp, Human; identical to SEQ ID NO: 144147

SEQ ID NO: 144206 - DNA, 601 bp, Human; identical to SEQ ID NO: 144148

SEQ ID NO: 144207 - DNA, 601 bp, Human; identical to SEQ ID NO: 144091

SEQ ID NO: 144208 - DNA, 601 bp, Human; identical to SEQ ID NO: 144092

SEQ ID NO: 144209 - DNA, 601 bp, Human; identical to SEQ ID NO: 144093

SEQ ID NO: 144210 - DNA, 601 bp, Human; identical to SEQ ID NO: 144094

SEQ ID NO: 144211 - DNA, 601 bp, Human; identical to SEQ ID NO: 144095

SEQ ID NO: 144212 - DNA, 601 bp, Human; identical to SEQ ID NO: 144096

SEQ ID NO: 144213 - DNA, 601 bp, Human; identical to SEQ ID NO: 144097

SEQ ID NO: 144214 - DNA, 601 bp, Human; identical to SEQ ID NO: 144098

SEQ ID NO: 144215 - DNA, 601 bp, Human; identical to SEQ ID NO: 144099

SEQ ID NO: 144216 - DNA, 601 bp, Human; identical to SEQ ID NO: 144100

SEQ ID NO: 144217 - DNA, 601 bp, Human; identical to SEQ ID NO: 144101

SEQ ID NO: 144218 - DNA, 601 bp, Human; identical to SEQ ID NO: 144102

SEQ ID NO: 144219 - DNA, 601 bp, Human; identical to SEQ ID NO: 144103

SEQ ID NO: 144220 - DNA, 601 bp, Human; identical to SEQ ID NO: 144104

SEQ ID NO: 144221 - DNA, 601 bp, Human; identical to SEQ ID NO: 144105

SEQ ID NO: 144222 - DNA, 601 bp, Human; identical to SEQ ID NO: 144106

SEQ ID NO: 144223 - DNA, 601 bp, Human; identical to SEQ ID NO: 144107

SEQ ID NO: 144224 - DNA, 601 bp, Human; identical to SEQ ID NO: 144108

SEQ ID NO: 144225 - DNA, 601 bp, Human; identical to SEQ ID NO: 144109

SEQ ID NO: 144226 - DNA, 601 bp, Human; identical to SEQ ID NO: 144110

SEQ ID NO: 144227 - DNA, 601 bp, Human; identical to SEQ ID NO: 144111

SEQ ID NO: 144228 - DNA, 601 bp, Human; identical to SEQ ID NO: 144112

SEQ ID NO: 144229 - DNA, 601 bp, Human; identical to SEQ ID NO: 144113

SEQ ID NO: 144230 - DNA, 601 bp, Human; identical to SEQ ID NO: 144114

SEQ ID NO: 144231 - DNA, 601 bp, Human; identical to SEQ ID NO: 144115

SEQ ID NO: 144232 - DNA, 601 bp, Human; identical to SEQ ID NO: 144116

SEQ ID NO: 144233 - DNA, 601 bp, Human; identical to SEQ ID NO: 144117

SEQ ID NO: 144234 - DNA, 601 bp, Human; identical to SEQ ID NO: 144118

SEQ ID NO: 144235 - DNA, 601 bp, Human; identical to SEQ ID NO: 144119

SEQ ID NO: 144236 - DNA, 601 bp, Human; identical to SEQ ID NO: 144120

SEQ ID NO: 144237 - DNA, 601 bp, Human; identical to SEQ ID NO: 144121

SEQ ID NO: 144238 - DNA, 601 bp, Human; identical to SEQ ID NO: 144122

SEQ ID NO: 144239 - DNA, 601 bp, Human; identical to SEQ ID NO: 144123

SEQ ID NO: 144240 - DNA, 601 bp, Human; identical to SEQ ID NO: 144124

SEQ ID NO: 144241 - DNA, 601 bp, Human; identical to SEQ ID NO: 144125

SEQ ID NO: 144242 - DNA, 601 bp, Human; identical to SEQ ID NO: 144126

SEQ ID NO: 144243 - DNA, 601 bp, Human; identical to SEQ ID NO: 144127

SEQ ID NO: 144244 - DNA, 601 bp, Human; identical to SEQ ID NO: 144128

SEQ ID NO: 144245 - DNA, 601 bp, Human; identical to SEQ ID NO: 144129

SEQ ID NO: 144246 - DNA, 601 bp, Human; identical to SEQ ID NO: 144130

SEQ ID NO: 144247 - DNA, 601 bp, Human; identical to SEQ ID NO: 144131

SEQ ID NO: 144248 - DNA, 601 bp, Human; identical to SEQ ID NO: 144132

SEQ ID NO: 144249 - DNA, 601 bp, Human; identical to SEQ ID NO: 144133

SEQ ID NO: 144250 - DNA, 601 bp, Human; identical to SEQ ID NO: 144134

SEQ ID NO: 144251 - DNA, 601 bp, Human; identical to SEQ ID NO: 144135

SEQ ID NO: 144252 - DNA, 601 bp, Human; identical to SEQ ID NO: 144136

SEQ ID NO: 144253 - DNA, 601 bp, Human; identical to SEQ ID NO: 144137

SEQ ID NO: 144254 - DNA, 601 bp, Human; identical to SEQ ID NO: 144138

SEQ ID NO: 144255 - DNA, 601 bp, Human; identical to SEQ ID NO: 144139

SEQ ID NO: 144256 - DNA, 601 bp, Human; identical to SEQ ID NO: 144140

SEQ ID NO: 144257 - DNA, 601 bp, Human; identical to SEQ ID NO: 144141

SEQ ID NO: 144258 - DNA, 601 bp, Human; identical to SEQ ID NO: 144142

SEQ ID NO: 144259 - DNA, 601 bp, Human; identical to SEQ ID NO: 144143

SEQ ID NO: 144260 - DNA, 601 bp, Human; identical to SEQ ID NO: 144144

SEQ ID NO: 144261 - DNA, 601 bp, Human; identical to SEQ ID NO: 144145

SEQ ID NO: 144262 - DNA, 601 bp, Human; identical to SEQ ID NO: 144146

SEQ ID NO: 144263 - DNA, 601 bp, Human; identical to SEQ ID NO: 144147

SEQ ID NO: 144264 - DNA, 601 bp, Human; identical to SEQ ID NO: 144148

SEQ ID NO: 144265 - DNA, 601 bp, Human; identical to SEQ ID NO: 144091

SEQ ID NO: 144266 - DNA, 601 bp, Human; identical to SEQ ID NO: 144092

SEQ ID NO: 144267 - DNA, 601 bp, Human; identical to SEQ ID NO: 144093

SEQ ID NO: 144268 - DNA, 601 bp, Human; identical to SEQ ID NO: 144094

SEQ ID NO: 144269 - DNA, 601 bp, Human; identical to SEQ ID NO: 144095

SEQ ID NO: 144270 - DNA, 601 bp, Human; identical to SEQ ID NO: 144096

SEQ ID NO: 144271 - DNA, 601 bp, Human; identical to SEQ ID NO: 144097

SEQ ID NO: 144272 - DNA, 601 bp, Human; identical to SEQ ID NO: 144098

SEQ ID NO: 144273 - DNA, 601 bp, Human; identical to SEQ ID NO: 144099

SEQ ID NO: 144274 - DNA, 601 bp, Human; identical to SEQ ID NO: 144100

SEQ ID NO: 144275 - DNA, 601 bp, Human; identical to SEQ ID NO: 144101

SEQ ID NO: 144276 - DNA, 601 bp, Human; identical to SEQ ID NO: 144102

SEQ ID NO: 144277 - DNA, 601 bp, Human; identical to SEQ ID NO: 144103

SEQ ID NO: 144278 - DNA, 601 bp, Human; identical to SEQ ID NO: 144104

SEQ ID NO: 144279 - DNA, 601 bp, Human; identical to SEQ ID NO: 144105

SEQ ID NO: 144280 - DNA, 601 bp, Human; identical to SEQ ID NO: 144106

SEQ ID NO: 144281 - DNA, 601 bp, Human; identical to SEQ ID NO: 144107

SEQ ID NO: 144282 - DNA, 601 bp, Human; identical to SEQ ID NO: 144108

SEQ ID NO: 144283 - DNA, 601 bp, Human; identical to SEQ ID NO: 144109

SEQ ID NO: 144284 - DNA, 601 bp, Human; identical to SEQ ID NO: 144110

SEQ ID NO: 144285 - DNA, 601 bp, Human; identical to SEQ ID NO: 144111

SEQ ID NO: 144286 - DNA, 601 bp, Human; identical to SEQ ID NO: 144112

SEQ ID NO: 144287 - DNA, 601 bp, Human; identical to SEQ ID NO: 144113

SEQ ID NO: 144288 - DNA, 601 bp, Human; identical to SEQ ID NO: 144114

SEQ ID NO: 144289 - DNA, 601 bp, Human; identical to SEQ ID NO: 144115

SEQ ID NO: 144290 - DNA, 601 bp, Human; identical to SEQ ID NO: 144116

SEQ ID NO: 144291 - DNA, 601 bp, Human; identical to SEQ ID NO: 144117

SEQ ID NO: 144292 - DNA, 601 bp, Human; identical to SEQ ID NO: 144118

SEQ ID NO: 144293 - DNA, 601 bp, Human; identical to SEQ ID NO: 144119

SEQ ID NO: 144294 - DNA, 601 bp, Human; identical to SEQ ID NO: 144120

SEQ ID NO: 144295 - DNA, 601 bp, Human; identical to SEQ ID NO: 144121

SEQ ID NO: 144296 - DNA, 601 bp, Human; identical to SEQ ID NO: 144122

SEQ ID NO: 144297 - DNA, 601 bp, Human; identical to SEQ ID NO: 144123

SEQ ID NO: 144298 - DNA, 601 bp, Human; identical to SEQ ID NO: 144124

SEQ ID NO: 144299 - DNA, 601 bp, Human; identical to SEQ ID NO: 144125

SEQ ID NO: 144300 - DNA, 601 bp, Human; identical to SEQ ID NO: 144126

SEQ ID NO: 144301 - DNA, 601 bp, Human; identical to SEQ ID NO: 144127

SEQ ID NO: 144302 - DNA, 601 bp, Human; identical to SEQ ID NO: 144128

SEQ ID NO: 144303 - DNA, 601 bp, Human; identical to SEQ ID NO: 144129

SEQ ID NO: 144304 - DNA, 601 bp, Human; identical to SEQ ID NO: 144130

SEQ ID NO: 144305 - DNA, 601 bp, Human; identical to SEQ ID NO: 144131

SEQ ID NO: 144306 - DNA, 601 bp, Human; identical to SEQ ID NO: 144132

SEQ ID NO: 144307 - DNA, 601 bp, Human; identical to SEQ ID NO: 144133

SEQ ID NO: 144308 - DNA, 601 bp, Human; identical to SEQ ID NO: 144134

SEQ ID NO: 144309 - DNA, 601 bp, Human; identical to SEQ ID NO: 144135

SEQ ID NO: 144310 - DNA, 601 bp, Human; identical to SEQ ID NO: 144136

SEQ ID NO: 144311 - DNA, 601 bp, Human; identical to SEQ ID NO: 144137

SEQ ID NO: 144312 - DNA, 601 bp, Human; identical to SEQ ID NO: 144138

SEQ ID NO: 144313 - DNA, 601 bp, Human; identical to SEQ ID NO: 144139

SEQ ID NO: 144314 - DNA, 601 bp, Human; identical to SEQ ID NO: 144140

SEQ ID NO: 144315 - DNA, 601 bp, Human; identical to SEQ ID NO: 144141

SEQ ID NO: 144316 - DNA, 601 bp, Human; identical to SEQ ID NO: 144142

SEQ ID NO: 144317 - DNA, 601 bp, Human; identical to SEQ ID NO: 144143

SEQ ID NO: 144318 - DNA, 601 bp, Human; identical to SEQ ID NO: 144144

SEQ ID NO: 144319 - DNA, 601 bp, Human; identical to SEQ ID NO: 144145

SEQ ID NO: 144320 - DNA, 601 bp, Human; identical to SEQ ID NO: 144146

SEQ ID NO: 144321 - DNA, 601 bp, Human; identical to SEQ ID NO: 144147

SEQ ID NO: 144322 - DNA, 601 bp, Human; identical to SEQ ID NO: 144148

SEQ ID NO: 144323 - DNA, 601 bp, Human
cgaacacagtggctcacgcctgtaatcctaccactctgggaggccaaggcgggcagatcatctgaggtcaggagttcgagaccagcctggccaacatgggaaaaccccatctctactaaaaataccaaaaaaattagctgagcgtgatggcacacacctgtagtcctagctgctcgggaagctgaggcaggataatcgcttgaacctgggaggcgaaggttgcagtgaactgagatcgcaccactgcaaccagcgtgggcgacaaagcaacacgctgtctcaaaaaaaaaaaaaaaaaaagaaacataccaaaatgttaataaaatgatctctagttgtgagattatgaataccttttgcttgctattttttctacttttcagtgttttccaagtttcttgcacatgtagcatggaatactttcctaatcataaaaaaagattagtttaaaaaattacaggttaggtgaaattggctgtgtacaataattttctgttctcctcccctccaacagagataatcaagagctaacaaaagtacacaatggtcttactgagtaagaaagggagaatataaagtgttctaagaaaaactctaaggt

SEQ ID NO: 144324 - DNA, 601 bp, Human
cagccaagctttgtaagaggactggcttttaacaaggtgaaccaggcatgttaacaacgtgggcaaagatacagacatgggacagcacgaatatatccagagaatggcaagttgtctattttggttggaaggcagaatatgcaaagagaattaacatagtacatggagaggctggggttaatctgcaggggcttttaaataccaaaccaagaaatctctacttatagacaatgggaacaggtgagtaacatgaataagattgtacttgaactagaacgcctagaggtagggctacaagttwggaattgattgcaatcagctaagtcagagatgtaatgaagatataaattagtggaaggaatagaacaggactcatgcaagctacatcacaaaggtagaccctgctggactttgaatcatccatcaagcagtggataagagcagaggctttggaatctcattgcttgggttcaaatccttgcttctcccctcgctggctgagtgatctttgcaaatttaacctttcaatgtcctcatctataaaatgtataaaatgagggaaaacacaggctgggcaacacagtgagacctcatctttact

SEQ ID NO: 144325 - DNA, 601 bp, Human
tcatatagtatcccaaacagggtattccaaaaatgctataataagtagaactaattagacctaaaataggtgatcaattcatgttaacaatggagttacttgtcagtatattttctgcactgttatcagattatcttaattttctagaatgcagaagttcagatcaaagtccagggtgttccattcaattttcttcagattttggctcttataattagttctgaacagtagcttctttcatctaatgaatgaagcaaggctttgaaagtcttcactttgagaaatgatttcatattatctyctgctataactgacagcagacaccagccatgctgtgccttctcagcagagacgctctaattaaagactatgttgagggctcccaagataaggctcaaaatgagtttctcagctgtgaccagaaagaaaaagggcttcctaataaagaaagtaaccgacattcctcttaggaagaaaagggaagtaatttcattattactaaaaggtttttcaaatcaaagtaaaagtacctatgtgtcatgactgtccctactgccaatttctgaaatactccatctctgctagaaatgatatagtctat

SEQ ID NO: 144326 - DNA, 601 bp, Human
aaatcagcatttgtgtgtatattttccccggtacactattactgaattaaataaaggcccgaaaaacattgaaaaaaatcaataattggcaaaatcatatagtatcccaaacagggtattccaaaaatgctataataagtagaactaattagacctaaaataggtgatcaattcatgttaacaatggagttacttgtcagtatattttctgcactgttatcagattatcttaattttctagaatgcagaagttcagatcaaagtccagggtgttccattcaattttcttcagattttggckcttataattagttctgaacagtagcttctttcatctaatgaatgaagcaaggctttgaaagtcttcactttgagaaatgatttcatattatcttctgctataactgacagcagacaccagccatgctgtgccttctcagcagagacgctctaattaaagactatgttgagggctcccaagataaggctcaaaatgagtttctcagctgtgaccagaaagaaaaagggcttcctaataaagaaagtaaccgacattcctcttaggaagaaaagggaagtaatttcattattactaaaaggt

SEQ ID NO: 144327 - DNA, 601 bp, Human
gaaaagaaaaatcaaatcctaaaatgaaataaaaacagaaataaatgaaccaaaatatttatcataataacataaccacacagaaaaaaattatttcagatgatctctgagcatagtgctcacactatgcattcttttttttttgaaacagagtctcactctgtcgcccaggctggaatacaatggcatgatctcagctcactgcaacctccgcctcatgggctcaagcaattctcctgcctcagcctcctgagtagctgggactacaggcatgcgccaccacacctggctaattttttcrtatttttagtagagacagggtttcaccatgttggccaggctggtcttgaactcctgacctcaaatgatcccgtctgctttggcctcccaaagtgctgggattacaggcgtgagccaccacacccagcctgactatacattcttggtagaatatattctaaggggaaaaatcttaaacattactcagtagtttactgttagtaatgtcgatattataattttgaaactattttatatatagtatataataaaccaaataaacatattaaagtgattatgaaacaagattttttatattaac

SEQ ID NO: 144328 - DNA, 601 bp, Human
cttgaggtcgggaattcaagaacagcctgaccaacatggggaaaccccgtttctactaaaaatacaaaattagctgggcatggtggtgcatgcctgtaatcccagctattccagaggctgaggcaggagaatcgcttgaacccagcaggtggaggttgtagcgagctgagatcacaccattgcactccagcctgggcaacaagagcaaacctctgtctcaaaaaaaaaaaaaaaaaaaaaaagaatgagtattaggacaggaaaactgctgggggcgcggtggctcaggctataaacccakcactttgggaggccaaggtgggtggatcacttgaggccaggagttcgagactagcctggccaacatggtgaaactccttctctattaaaaacacagaaaaattagccaggcatggtggtacacacctgtaatcccagctactcaggaggctgaggcaggagaatcacttgaacccaggaagcagaggctgcagagattccaccactgcactccagtctgggcaacagagtgagaatctgtctcgaaaaaaaaaaaaaaaaaaaaacaggaaaacaaagtacatttaaatctctaaggcca

SEQ ID NO: 144329 - DNA, 601 bp, Human
gacaggcagatcacttgaggtcgggaattcaagaacagcctgaccaacatggggaaaccccgtttctactaaaaatacaaaattagctgggcatggtggtgcatgcctgtaatcccagctattccagaggctgaggcaggagaatcgcttgaacccagcaggtggaggttgtagcgagctgagatcacaccattgcactccagcctgggcaacaagagcaaacctctgtctcaaaaaaaaaaaaaaaaaaaaaaagaatgagtattaggacaggaaaactgctgggggcgcggtggctcakgctataaacccagcactttgggaggccaaggtgggtggatcacttgaggccaggagttcgagactagcctggccaacatggtgaaactccttctctattaaaaacacagaaaaattagccaggcatggtggtacacacctgtaatcccagctactcaggaggctgaggcaggagaatcacttgaacccaggaagcagaggctgcagagattccaccactgcactccagtctgggcaacagagtgagaatctgtctcgaaaaaaaaaaaaaaaaaaaaacaggaaaacaaagtacatttaa

SEQ ID NO: 144330 - DNA, 601 bp, Human
aaaagaaggagtattagaggctgggtgtggtggctcacgcctctaatctcagcactttgggaggccaagacaggcagatcacttgaggtcgggaattcaagaacagcctgaccaacatggggaaaccccgtttctactaaaaatacaaaattagctgggcatggtggtgcatgcctgtaatcccagctattccagaggctgaggcaggagaatcgcttgaacccagcaggtggaggttgtagcgagctgagatcacaccattgcactccagcctgggcaacaagagcaaacctctgtctcaaaaaaaaaaaaaaaaaaaaaaagaatgagtattaggacaggaaaactgctgggggcgcggtggctcaggctataaacccagcactttgggaggccaaggtgggtggatcacttgaggccaggagttcgagactagcctggccaacatggtgaaactccttctctattaaaaacacagaaaaattagccaggcatggtggtacacacctgtaatcccagctactcaggaggctgaggcaggagaatcacttgaacccaggaagcagaggctgcagagattccaccactgcactccagtctg

SEQ ID NO: 144331 - DNA, 601 bp, Human
ggatagttgctaaagttcttcactattttacctaggctatccttataaataaataccatgaatttttaaaaccacacaggtcacttaaagtctctctttcttggaggtacctaggctgtaaaatgaattttgtgagttatctagagtaagtaatcccttccagtgtagtctgtctttatcttcttgagttggtaatacacattgatttaacctttaattagaaacaaaattaatttaattttgaatggtcctttaatattgtattctttgtgtagtgtaatcaactttaggaaacgcaatrtatgaaaaacaggaggattatctgctttacaaagtcacactttaaagatgaattcatggtagtattttaaaatagctcagttaatgcatcatgtaagatttgattgacagaacttattttgcagagcttgtgaggaatttcttactgcatttaactagaaacttgtaatttagggagcatttctgattgtttaaatagataattgcgctcactcaccagcccctgtccccagtcatctagtggccatcactccccataggttatcatttttttttttcattttcttgcctatccttccat

SEQ ID NO: 144332 - DNA, 601 bp, Human
ataaagaggttataaactcagtgtactctcagtgcttttattatgcatcatagccctgtttagactatggaagtttgcttatgcccttttgttgtacttttaatgttttatcttttaacaccttcattcatagcagccatactacttttgtggtcacctaatcctagttctatcctaggtaaatggttcatttcagagacactttgagttttttaggtattctagttatttggctaagagacactattcatttaaaaataggccttgcattataattgcaattcactgtgtccatatggtsaaaattatgagtcttgtatatttatatgggtgaatatgtagtgaattagccttttgtggacaattagcagattttactagtagaaggcagatatttactactagaaggaagttccagatgaaagaccttatttaactagactgcatctatcttgtcattgaatttaggctttaaactgggaaggttttgtgaataattcttccatatcaaatccgttttccttaaaccaggcatatagcagatctcagttgttgatcttacctagtggttgcagtcatcaacatgtgatggtattcctct

SEQ ID NO: 144333 - DNA, 601 bp, Human
cctgggaggctgaggcaggagaatcaattgaacccaggagatggagtttgcagtgagcccagatcgcgccatttcactcctgcctgggcaacaagagcgaaagtccatctcaaaaaaaaaaaaaagaaaaaaaaaatacacagtgtcgttttacagtaacaatatcaaaaacatctttttttgtttttcctaaaaactaaatgtatttggggtttttactccgtatacattttggaataaattaatacatttattctacatttatgtagcatcttactctccagagtcataaaatttagcracaaataaataagcttgataaaaggaggaattttaaagtgctataatagaagtgtaattaagattatatgggaactcataataatgttgaattcattgtgattatgtagctttgagagattaccataggaattacttttgagctgatctctaaattaagatagggacatcaggaatgatgccttactcaccattgtattcctggcgcctaacatagtgcctagcacagtgtagacactctgtgttttgattaaagaagacttcagtagataattaagaggtacagaatccacacagaaca

SEQ ID NO: 144334 - DNA, 601 bp, Human
gcctagcacagtgtagacactctgtgttttgattaaagaagacttcagtagataattaagaggtacagaatccacacagaacaatatgaaccccaaaaaaggtttgaaagtattgggaaatagtggtcgaggtaaaacatgcagttctttgaagacgtcttagtagagttagactggaaggtagattggagccatcttatggagggctgagagaatgatggtgccatttacttagatacgagataaggaactgaaaataagtttaatggggacaataatgaattagatacgttgaatatgmggtacctacagaatattcatatgacagcttttggtagctaattgatggttacagtgtggagctgagcaaaattgagtctggggatgtagataatatgttagcctttaggagtatatgagatcgcaagcagagagaatagagcaagaagtaaagaaggtgagtgttacatatattaaaggaatggatagaagaaaagccagcaaaagaaggttaagaatgctaggaaggtaggaaataagatcagagagttaatcatgaagaaatccttgggctaacaatcttactgtaatgactattatc

SEQ ID NO: 144335 - DNA, 601 bp, Human
ggagatgaaatagtgatatctggctgggtgcagtggctcatgcctgtaatcccagcactttgggaggctgaggcatgtggatcacaaggtcaggagttaaagaccagcctggccaagatggtgaaaccctatctctcctaaaaactacaaaaaaattagccaggcgcagtcgcagttgcctgtaatcccagctactcaggaggctgagtcaggggaatcactgggacctggggcggcagaggttaacagtgagccgagattgcaccaccgcactccagcctggataacaaagtaagactcmgtctcaaaaaaaaaaaaaaaaaaaaaagtactgatatctatccaaaaactgcattcagggcaaatattagttggtttgccgtcagttgccattcacatgttcctgtccatttggaaggaattgttcctggctttcaaaggtgagacatccactgcttgaaagttggttctttattagcaaaaaccaagcttcctggccatgattagtactaccacccctaatacccaggtgtattagtcagttcttgcattgctataaagaaatacttctgaaactaggtaatttatcaagaaaagaggt

SEQ ID NO: 144336 - DNA, 601 bp, Human
aatagaattaataactaaataacatgactttaaaatgtgttgagcagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggtaggtttttaaattttactcttcacatcaaattttttttttttttttttttttttttttgagatggagtcttgttctgtccccaggctggagtacagtggcactgtcttggctcactgtaacctccaccttccgggttcaagcaattctcctgcctcagcctcccgagtagctgggactacaggtgtgtgccaccaaacccggctaattttttttattgttagtagagacagggttttaccatgttaataaccaggatggtcttgatctcctgacctcgtgatctacttgcctcggcgtcccaaagtgctgggattacaggcgtgcgtcaccacgcccagctgacatcaatttttgaaa

SEQ ID NO: 144337 - DNA, 601 bp, Human
aaaaaaaaaaaaaaaaaaatcagaaaacaacagatactggcaaggatgcagagaaagggaaacacttatacacttactgagaatgtatgttggtataacctttatagaaaacatttctcagagaactaaaagcagaactgttattcaatccagcagtcccacttctgagtatctacccaaaggaaaagaaatcattaaacagaaaagatacttgcactcatatatttgtagcagcattgttcacaatagcaaaaagtaaatcaacctaagtgtccgtcaacggaggattggataaaaaaaatgcggtatatatacacacgcacacacaccatggaatactactcagccataaaaaatgaaatgatagcttttgcagctatgtgaatggaactggaggccattaacctaagtgaaataactcaaagtcaaatactacatgttctcacttataagtgggagctaaacagtgggcacacatggacatacagaatggactaatagacagtggagaccataaaaggtgggagggtgggagggaggtgagttgaacatgtgtctattgggtttgttcactgttcaggttataggtacactaaaagcc

SEQ ID NO: 144338 - DNA, 601 bp, Human; identical to SEQ ID NO: 37338

SEQ ID NO: 144339 - DNA, 601 bp, Human; identical to SEQ ID NO: 37339

SEQ ID NO: 144340 - DNA, 601 bp, Human; identical to SEQ ID NO: 37340

SEQ ID NO: 144341 - DNA, 601 bp, Human; identical to SEQ ID NO: 37341

SEQ ID NO: 144342 - DNA, 601 bp, Human; identical to SEQ ID NO: 37342

SEQ ID NO: 144343 - DNA, 601 bp, Human; identical to SEQ ID NO: 37343

SEQ ID NO: 144344 - DNA, 601 bp, Human; identical to SEQ ID NO: 37344

SEQ ID NO: 144345 - DNA, 601 bp, Human; identical to SEQ ID NO: 37345

SEQ ID NO: 144346 - DNA, 601 bp, Human; identical to SEQ ID NO: 37346

SEQ ID NO: 144347 - DNA, 601 bp, Human; identical to SEQ ID NO: 37347

SEQ ID NO: 144348 - DNA, 601 bp, Human; identical to SEQ ID NO: 37348

SEQ ID NO: 144349 - DNA, 601 bp, Human; identical to SEQ ID NO: 37349

SEQ ID NO: 144350 - DNA, 601 bp, Human; identical to SEQ ID NO: 37350

SEQ ID NO: 144351 - DNA, 601 bp, Human; identical to SEQ ID NO: 37351

SEQ ID NO: 144352 - DNA, 601 bp, Human; identical to SEQ ID NO: 37352

SEQ ID NO: 144353 - DNA, 601 bp, Human; identical to SEQ ID NO: 37353

SEQ ID NO: 144354 - DNA, 601 bp, Human; identical to SEQ ID NO: 37354

SEQ ID NO: 144355 - DNA, 601 bp, Human; identical to SEQ ID NO: 37355

SEQ ID NO: 144356 - DNA, 601 bp, Human; identical to SEQ ID NO: 37356

SEQ ID NO: 144357 - DNA, 601 bp, Human; identical to SEQ ID NO: 37357

SEQ ID NO: 144358 - DNA, 601 bp, Human; identical to SEQ ID NO: 37358

SEQ ID NO: 144359 - DNA, 601 bp, Human; identical to SEQ ID NO: 37359

SEQ ID NO: 144360 - DNA, 601 bp, Human; identical to SEQ ID NO: 37360

SEQ ID NO: 144361 - DNA, 601 bp, Human; identical to SEQ ID NO: 37361

SEQ ID NO: 144362 - DNA, 601 bp, Human; identical to SEQ ID NO: 37362

SEQ ID NO: 144363 - DNA, 601 bp, Human
ccgctgcaacagcaaagtttgaggcgaagcctagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcarggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctg

SEQ ID NO: 144364 - DNA, 601 bp, Human
tcacccagacggggacaagaaaggagccagaacacaagatttaaaaagtcagccctccaaaccgatagttgcaaaaaaaaagaaaaataaggaagcgttcccataccgggagtcgaacccgggccacctgggtgaaaaccaggaatcctaaccgctagaccatatgggaagtgctatgagaaactgccgtgacccacctgacaagcataagtgcctctgcctccttcgccgcacctctcgccaccgccgcctctgcgctactgaagctgctgctgccgccgccgccgccgccgccgccgcygctgctgcccacacgctcccgagctagggaacaagccccatccgagcgcgtgggcgtcgtaggggagaggaggggcggggccgctccgctgcaacagcaaagtttgaggcgaagcctagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgag

SEQ ID NO: 144365 - DNA, 601 bp, Human
cagtaatgcttattttctacaaactcacccagacggggacaagaaaggagccagaacacaagatttaaaaagtcagccctccaaaccgatagttgcaaaaaaaaagaaaaataaggaagcgttcccataccgggagtcgaacccgggccacctgggtgaaaaccaggaatcctaaccgctagaccatatgggaagtgctatgagaaactgccgtgacccacctgacaagcataagtgcctctgcctccttcgccgcacctctcgccaccgccgcctctgcgctactgaagctgctgctgcygccgccgccgccgccgccgccgctgctgctgcccacacgctcccgagctagggaacaagccccatccgagcgcgtgggcgtcgtaggggagaggaggggcggggccgctccgctgcaacagcaaagtttgaggcgaagcctagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgt

SEQ ID NO: 144366 - DNA, 601 bp, Human
accatattctacgtaatgcacaactacacgaaagataaatctgtgttttatacagagatgatgcaactacttcctttgtgttcacccccaggtatatagtacaactatttgcaattactgagtgcacagttgaaaataacatccattttagcaccatttggtacaatgttgtaaactcattacaaaatacaaggtcaaggcctggcgtggtggctcatgcctgtaatcctagcactttgggaggccgaggtgggtggatcacctgaggtcaggggttcgagaccagcctggccaacatggkgaaacattgtctttactcaaaatacaaaaattggccacgcgtggtggcgggtgtctgtagtcccagctacttgggaggctgaggcacgagaatagcttgaatccgggaggcggaggttgcagtgagctgagatcgcgccaatgccctccagcctgggttaacagagcgagactccgtctcaacaaaaaaaagaagaaaaagtcaaaagttaagccctctctggggacaattaaggcagagttatccgagttatctttccttctttccaaattttcaactactgtaattctttagtaactg

SEQ ID NO: 144367 - DNA, 601 bp, Human
caaaggaaaaaggcaagaaacaaaactccgagacaaggataagtttggcatggcaaaaaggaagcctacgtagccaagatacagtgaagtggtagataaggtaggacctgaggttagatgggtaaagtccagataatgttggacctatgagaccatgataaggtcttcggattttagctgaaatgcagtaattgctttaaaatcccttctacttctttaaataccagcgttcatctctgcaaacatttactgaactttcacgtctttttttttttttttttaagagataaggtcttagggwcttgctctgtcacctggagtgtagcggcaacatcacagctcactgcagccttgaactcctgggctcaatggatcctcccaccttaggcttgcaagtagctaggactacaggcatgtggcatcacacctggctaatttttttttaattttatttttgtagagacaggctcttgttatgttgtccaggctctctcactttttctcttttttttccccccaccccgagatggagtctctctctgtctccaaggctggagtgcagtggcacgatcctgagatcctggcttactgcaatctctgc

SEQ ID NO: 144368 - DNA, 601 bp, Human
ttattgtaacgctgctaagaacatacaaatatctctgagaccttgctttcaattattttgagtatatatcaagaagcagaattgctggattatgataattctctttcaaaaaaaattttttttgagatggagtctcgctctgtcgcccagtctggagtgcagtggcacaatctcggatcgctgcaacctcccaggttcaagggattcttctgcttcagcctcccaagtagctgggactacaggcacctgccaccacgcccagctaatttttgtatttttagtagagacaggatttcaccayatttgccaggctggtctcgaactccttacctcgtgatccacttgcctaagcctcccaaagtgctgggactacaggcatgagccaccacacccggcctctttcagattttttagaaagtgccatcctgttttccattgtggccagaacattttacatccccaccaacacaggaattcttgtacaagagtttcagtttcttcacatccttgccaatacctgttatattctgctttgttttgttttaataggacccatcctaatgagtatcaggttgtgactgctttcatataaactttatgt

SEQ ID NO: 144369 - DNA, 601 bp, Human
ccataatccctcatttaaaacccatcaatatctgcccactctgctgaagataaaattcaaaatatctaacatggcctagaatgtcttatatgatttgataccttgcagcctcatctcccattgcatctcactttctacatgacagcccaccaggcctttcatttcccaaaatacactctttcctccttgcagaccatttgcaaaatgctactccctcaatctactctctcttcccttttctccctttctcttacataaggcttagtcatcctttggatctctacagaaacgtcatgtcctwagggaagccttctcaatccagcccttccctacactatgttaggggtctccctgccatgcgtgtacacttaagcacactttttacttgttcaatccatgtccgtctctcccactaaactgcaagcttcatgaggatcttgtcagcttttatcattgttttatcccagcatctaacactcacatattggtgaaataagaaactgcatcattacagatgctgtttacattcataaataatgtgcatagagtatccacatacaaactgaaatttgctttttaaaattatttaattggggtaaag

SEQ ID NO: 144370 - DNA, 601 bp, Human
aaaaaaaaaagaacctgaattggcaccctgtcacacaccgcaaccccaactacaactactattcattctcactccctgcttttcacagccaaacttcctcaaaagatgtgtatatactgtcctcacctactcatttcttcatctcccgctcattcttcaaccagcctaatctaacttaattctgcccctattatgccactaaatctaactaaagttaatgacctcccagggctaaatccaatgaacactttcagaacttgttgtgttagacctatcactttaaacacttctttggcttctktgataacactctcctgattttgccccaattctggactactctttctcagttttctctgccccacctcctcaccacttaccactagaggtcctaaaagctcaaagtcttcttcttactccagactctcccaagtcaagtatcaatttctagggcttcaaactaccaaatcacagtatcaaggtgaaaatcacttatcctcaattacccttgacaattctcttaagttcaccctttaagtacactttaccatatgaacagctcacaatggtggccaatatacaatcccctccaacattcaag

SEQ ID NO: 144371 - DNA, 601 bp, Human
tgtgggcatgaggccctccaagccaggtacaggatataatctcctggtgtgccatttgctaagaccgttggaaaagcacagtattagggtgggagtgacccgattttctaggtgccttctgtcacagcttctcttggctaggaaagggaattccctgaccccttgcgcttccaggtgaggcgatgcctcgccctgcttcggctcacgctcggtggcctgcacccactgtcttgcacacactgtccgacaagccccagtgagatgaacccggtacctcagttggaaatgcagaaatcacccrtcttctgcgtcactcacgctgagagctgtagactggagctgttcttatttggccatcttggaactgcctacagtcttttctttgagacaaggtctccatctgtcactcaggctggagtgcagtggtacaaacacagcttactgcagccttgacctccagggctcgagtgatctcacctcagcctcccgagtagctgggattatgggcacaccaccaagcccagctaattttttaatattttatagtgacaggataccagtatgttaccccagctagtctaaaattctaggctcaagcaat

SEQ ID NO: 144372 - DNA, 601 bp, Human
ttatttacttatgtatttatattttttcagacagtcttgttctgtcacacaggctggagtgcagtggcacgatctaagctcactgcaacctctgcctcccaggttcaagggatcctcctacctgagcctcctgagtacctaggattacagctgcatgccaccacacccggctaatttttgtatttttagtaaaggcaaagtttcactttgcacagttttaactcctgacctcaagtaattcgcctgcctgggcctcccaaagtgctggggttacagctttttctttttctttttttttttwttattattatactttaagttcaagcatacatgtgcacaacgtgcaggtttgtcacatatgtatacatgtgccatgttggtatgctgcatccattaactcgtcatttatatttggcatatgtcctaatgctatccctccccactcccccgaccccacaataggccccagtgtgtgatgtttcccttcctgtgtccgagtgttctcattgttcaattcctacctatgagtgagaacatgcggtgtttggttttttgtccttgcgatagtttgctgagaatgatggtttccagcttcatccat

SEQ ID NO: 144373 - DNA, 601 bp, Human
acaaacaacacagaaagattagccgggtgtggtgacgcgcacctgtagtcccacctacttcagaggttaagaagaaaggatcacttgagctaaggaggcagagggtgcagtgagccattattgcgccactgcactccagcctgagcaacagagtgagaccctttttccagggggaaaaaaaaagggcatccagaagacttcaaaaagccagtccatagatcagatgcaccagaatcatctaaagatgcacacactcctgagtcctacacctaaagattcaactgtaagtcttaggtggacycaagattctctattttttactttccagatgatcagaagttagtatagtaacatacagaccttcacatctcaatacctgtgtgtacacaatcccggaataccatatttagactaagtcagtgggaaggtcatatttgtattcagtagatcctgtttaagcaaagtgtatatttttcaaatatttcctaaactctataggagatattatttatttacttatgtatttatattttttcagacagtcttgttctgtcacacaggctggagtgcagtggcacgatctaagctcactgcaacctct

SEQ ID NO: 144374 - DNA, 601 bp, Human
gaaaacctattttagatagagtgattggggatggcctttctgaaaaggtgaccgtggatatgaaacctgaatgttaagcagccagtcatgtaaagaggctgaggaagcataccatcaggagagaaaattataggcacaaacaaaggcagtggggtaggaggaagcatcatggctagaatgcagagaggagagggaagaagtacaaaaagcagctagagaagaacctatacagagcatgaagcacttttacagtaagaaaaaaaggatcaagctggtttcatcaaaaaaaaaaaaaaaaaaacctattacaccatccgaactgtataagcagacgacattttcaaagtctttctttgctaagtccttgacatacacatctcatttaatcctcaagacagaactattaaaaatcatccagagccaggtgcagtggttcatgactgtaaccccagcactttgggaggctgaggcaggaaaatcactggagctgaggagaccagcctgggcaacatggagaaaccttgtctctacaaacaacacagaaagattagccgggtgtggtgacgcgcacctgtagtcccacctacttcagaggttaaga

SEQ ID NO: 144375 - DNA, 601 bp, Human
ggctcacacctgtaatctcagcattttgggaggcggaggcagtggatcacttgtggtcaggagttcaaaaccagcctggccaacatggtgaaaccctgtctctactaaaaatgcaaaaataagccagacgtggtggtagacacctgtaatcccagctacttgggaggctgaggcagaatcgcctgaacctaggaggtggaggttgcagtgaacccagattgcaccactgcactccagtctgggtgacagagactttgtcaaaaaaaaaaaaaaaaaaaagactttctatgtatgacaaaarggcaggaaaaaaaagtaaaggaaaaggatgacattttagtacataaaaatgtaaatgcactataacctaggccaggtacagtggctcacatctgtaatcccagcactttggaaggccgaggtaggtggatcgcttgagcccaagagattgagaccagcctgggtaacacggcaataccccatcttaaaaaataaataagtaagtaaataaataatttttaaaattaccataaccaaagctaaggctaggaacaaactagggaaaaatatgacaaaaagtcctttttttaaaaaaaaaaaa

SEQ ID NO: 144376 - DNA, 601 bp, Human
gagactccgtctcaaaaaaaaaaagaaaaaaaagaaaaaagaaattagtttgaacatcctcaacagacatttcccaaatttaaggatacaaaaatatgcatgtataatgtgctacacagactaagaattcaattacaagttattgaggtaaatctccagagtttaccaacctctctactttcactcttgctactgtctccccactatattttttctccccatccctcaaggatctgctaaagttcacccaaagaaagactatgttagcaaagtgaagaaaccttaaaaaaaaaaaaaaaaaggaatagtgaggaggaatatgccacaaattacctcaagcagctaagtacaggaataaataggacaggatgtaaaataaaaagatctgatattacatataaacttagataataaaaatggaatcaggccaggtgaggtggctcatgtctgtaatcccagcactttgggcagtgatgataataaaaatggtatcaggccaccaaggtggacagacaacatgagcccaggagttagagaccaacctggaaatatgttgaaaccccatctctacaaaaaatacaaaaattaaccatgcatggtg

SEQ ID NO: 144377 - DNA, 601 bp, Human
aatacagtctgtaataattccataaagtaaaaataaatctctttcaaaaacaaactgatgacatcatgcatattttgattaaaatggttttatctgtactaagattatatgttatctgaaagggataaaacagattccaccatatattatacgacttattagccataatcattgccaacatatatgcttataatttttacaattctatcatttgatttcccaattcaagaataatttatttttaaaggaatgtctcaaattctaccccttaatattcctattaaaaaaaaaaaaaaaaaaaccttcactggcctatcagcacccacagaataaattccaatacaaaacatttatccatcttgacttctgtctaccttatcatgccttacctcggcattctacgcccccagcatatactctacatctgaacttgttagttcagagcattgtcatgctttttcactctaccttttcaggccttctccacctactgaatctcccaagagcctttctctcctcactgtgtcattaaaaggaagaattggtcacttcctcctttgtgctctcacagtattttgtaaatgatctaatcacattgttt

SEQ ID NO: 144378 - DNA, 601 bp, Human
ctacttaggagaccaaagcagaagattctcctgagcccaggagtttgaggtcacagtgagctacagttgtaccactgcactcaccctgggtgacagagcaagaccttgtttctaaaaaaaaaaaaaaacaaaccaaagaaaaaacttagtactatggttacaatgctcataaacagaaccactcaatgttaaatgttaagtcataatgtcctacggactgatgactgacttggcttaaccttttgctttaggcctgaatcacagaactcttagcccccaaaatgattttttaaaaaattayccctgctattattatttttgctctttgataaaagagaaaagaaagggaattttaggacacgttaaagaaatgtgaactttaacttctcttagttacacttctggtcaaaacagagaaatgaggaaaccaacattagcaactagctgtgtagcctcatgattaagaacatggggtttggagtgggtgacccaggctgagtcctaactctactattgactagtttttaacttaaagctacttaaactctctaagcctctgttttcacatctgtgaaagggacagttataatccttatttcac

SEQ ID NO: 144379 - DNA, 601 bp, Human
gaccagcctgggcaacacagtgagaccctgtctctacaaaaaataaaacaattagcctggtatggtggtgcaagcctgtagtcccagctacttaggagaccaaagcagaagattctcctgagcccaggagtttgaggtcacagtgagctacagttgtaccactgcactcaccctgggtgacagagcaagaccttgtttctaaaaaaaaaaaaaaacaaaccaaagaaaaaacttagtactatggttacaatgctcataaacagaaccactcaatgttaaatgttaagtcataatgtcctayggactgatgactgacttggcttaaccttttgctttaggcctgaatcacagaactcttagcccccaaaatgattttttaaaaaattacccctgctattattatttttgctctttgataaaagagaaaagaaagggaattttaggacacgttaaagaaatgtgaactttaacttctcttagttacacttctggtcaaaacagagaaatgaggaaaccaacattagcaactagctgtgtagcctcatgattaagaacatggggtttggagtgggtgacccaggctgagtcctaactctactat

SEQ ID NO: 144380 - DNA, 601 bp, Human
gaagtttaagaccagcctgggcaacacagtgagaacctgtctctacaaaaaataaaaataaataaaaattagccagacttggtggtgtgtgcctgtggtcccagctactggggaggctgaggtgggaagactgcttgagcccaggagattgaggctgcagtgaaccgtgatcatgccactttactccagcctgggtaggagtgagattctgtctcacacacataaaaagaaagtaattttgttgtgaaagggtcaagagaaagcttttttgatttgggttgttttttttggggggtggggsgtgcagtggggaggtgacgagactgtttaagaaaagttgtatctggccaggcatggtggctcacgcctataatcctagcacttcagggaactgaagcaggtgaatcacttgagcctaggagttcaacagtagcctgggcaacatgatgaaaccccatttctacaaaaaaataaaagaaatgagccaggcatggtggtgcgtgcctggggtcccagctactcaagtggctaaggtgggaggattgaagccaagaggttgaggctgcagtaagccataatggcatcattgctctacagcctg

SEQ ID NO: 144381 - DNA, 601 bp, Human
ccagtcagccattttccccagccacctgtcattgcccagggggctcatcctggacatggtggcagggatggaggttattcacgggcttagcaacatggatttccactcactacagctcacctgggtatggccactgctgagtgcccaatctgctagcagcagagaccagcaatgagcccccagtatggcaccattccctggggtgatccgccagctacctggtggctgcttccatcacagaaggggcagcagtttgttcttactgcaatagacactctagatacaaatttgcctttcctgyacacaatgcttctcccaaaactaccatccatgaactcacagaatgccttatctaccatcatggcattctacacagcattgcttctgaccatggaacttatctcagtcacaaaagtggggtaatgggctcaagctcatggaattcattggtcttaccatgttccctgccatcctgaagcagctagcttgacaggatggtgaaatggcccttagaagattcagttacagtgccagctaggtgataataccttgcaggtctagcactaggttctccagaaggctgtacacattctgagttagc

SEQ ID NO: 144382 - DNA, 601 bp, Human
ctcttctagggtaaaggataaattgttgcatctggctcctcctactaccaagaaaaaggcacaacacttaactcctttatttagattttggaggcaacacattcctcatttgagtgttactccggcccaattaccaagtgaccagaaaagctgctagttttgaggggggcccagaatagaaggctctgtaacaaatctgtaacaaatctgctctgcaagctgctctgccacttgggccatatgacccagcagatccaatggtacttgaggtatcagcagttggcaggcctctctctatagstaaatcacagcacaggcctgtaggattttggagcaagaccttgccatcaactgcagataatacttcccttttgagagacagctcttgacctgctactggaccttagtagaaactgaacattcaccacgggccaccaagttatcatgcaatctacttggaagtgggtgttacctgacccactccaagccacaaagctgggcgtgcatagcaccattaaaatcatcaagtggaggtaacatatatgtgattgggcctgcgtaggtcctaaaggcacaagttacatgaaatggcccaaatgcc

SEQ ID NO: 144383 - DNA, 601 bp, Human
ctgtaggacagcttaaaacacgaatccaatccagtctcattttaaaaatagagataagaggtctgtacaaagtgacttcccaatgtcaagttagtgactgatttgagggactctttgtcattcatttaacaaatatttactcagcacttactatgtgccaggtactgttctagccccttgctagacagcaaacaaaagagacatactgctgataaataaaccctattcggcctgtgcagaagacagatgaatctaggagaatcacggtggattatcataagcttaaccaagtggtgactcygattgcagctgctgtaccagatgtgagctcattctttaccctcaacagatctcctggtatctgttacatacagctatcaatctggcaaatgcctttttcccccatacctgtccatgaggcccaccagaagcagtttcctttcaaatggcaaggccaaaaataccttcactgtcctaactcagggatatatcaaccccctagacctatgttcacagggatcttgatcacctttcccctcaaggtaacatattagtccattatatcaatgacattatgcttattggacctaatgagcaacga

SEQ ID NO: 144384 - DNA, 601 bp, Human
gctttcatggctgctcatggaattgtcaacatgtatatttgaactattagctgagagagattgagtcaactgaatgaatttaaatgccaactaaatttcagatactatttatttcctccaccaaaacagaatttataaaaagaatttattgtgctagggctcatttttcctttttactgttacctcttccctttgaactcaaatctcaaaacttctagtacaaaaatacagaatactctaatttccatatctaggaaacttaggctaaaaaaagctttgtttgaatccgccccataggtcrggagctaacatgctatgactatcagagatggaaaaagaaaagatcacaccattaaaatggcaaatgaccaaaatcaatgttccccactatttaaatagaaaaataaaattcagaagactgagattgagtgttatgaatctttcaatcatgcagaatttattttgttgatgttaatgcctctcaaaaatataatcccaggttccaagaattgtgtagaatttctacatgtgagcttaaacgtaaaacacagttaattttctatgctctatcactagctttgttaaaccaaatcctctttcc

SEQ ID NO: 144385 - DNA, 601 bp, Human
tcatatttagcttactttagttcacttacacaaaatgactattcagagcccatgcaccaagaaacaaggtccgctgagcagtcacgggagattcacttgttccctggaaagttccccccaggtaattttccatatctgaaatttattttagataacatgaatgtaaacctaacaatttgattatcttcttttggctaattagaaataaaaactgtaacaggtaaaagagggcaacagtattataaaaggatgtcagaaaaagtgaaatagctgataatgacattaaaaaaacccaccttayaaaactaaaaataaacataactttaaaagtattcagatatgaagccattatataaggtcagtaagttgtaatattccctaagtatattaccatacactaagtgtctccaagtcagcattagtttaagacaggccttcgaaagccaaagtgtgtaacatcaagtgtgtgagatgttttatgtagaacaggtatctaaaaggataagcttctgctattgagaaaatccatttatataatgcacctcattacttaataatggcaaatattccaaacataatttaaaggaagtactctggccac

SEQ ID NO: 144386 - DNA, 601 bp, Human
agtggtgtctgtgcttcagcttatgagtcatacatgaaaccaagtgtttctaagggaggcacgcccatgttgctgtggacccaattattctgctaggtcaaacatgcaaatctgcaggtaaaaacggtataggaaagtggggatgaagaggcaaggagcaagatctaccttgattagaccattactaagctcatattaattgccataatttaaaactaacaataaaatagagtaagaacctacaagggagcaaaattaaaaactatatattgttttaaaatataaaaatctcaatttttaraagttgctttactatatcaaataaaactgtgaaaggaaaaaagtatgaaaggggatggaagggagatagcaaactctgtggctcttaatgtaacaatggactggtgagtgtaatctggctactcattaaccctcatatgaaagagatatattgctatgtagtctggaaaggctagcaaactacaaagccagatgcagatctgtaagttcactaaacagataaaatccactagaaaattcaaagttcagtggaaaaataagtgtgaattaaactggtttacagaatttttaaaaacccaca

SEQ ID NO: 144387 - DNA, 601 bp, Human
caaagcatcacttgtgactggcacaagcagttccagactgcgaagccctgccattaggtactgcatgacctcaagcaaatcacaggacctctgtgggccactgtttcttcatctataaaagtgaggcagttggacaatcttcagtcactttcagcactaaagttctataaatcactaattctaaatttaattctgatgggtcagttcaaacttacattcaatcttatggaaggaaaaacgtggagagggaaatacttaataaattgttctggtcttttcttggttctcttctttttacccscccttctcccttctccttgaaactccacttcagtctctatcacgtaagaaaatacataaacaatatctatactactttaactgtaccagcttcttaaatttaagaaaccaaattcctctacttctctttaataaataagatcttaattatgccgcttatttgtgtgcctcttgatttttctcttatggatcaccaccttaaaaaagttaaaaaaaaaaatagaaaagtcttcattagatttttcacacagaccagactagaagtaaatacagcttttgcttactcaaaggctgactaaac

SEQ ID NO: 144388 - DNA, 601 bp, Human
ttcatctatctaccacctagctttatattttaccatagtttgtttgtttttgtttttctgttttgtttttaagaaaaaaaggtcatctacagttaaagcttcctctaatatccctctccagtctcattttattccttctttgactattctaagtttgatttttttttcttttcttttctttttttttttttttaagagacagattcttgttttgtcactcaggctgaagtgcagtggtgcaatcatatttcactgtagcattaactcctgggctcaagcaatcctcctgcctcagcttctygagtagctggagctacaggagtgtgacaccacacctggctaacttaaaaaaaaattttttttttctacttgtagagacagggtcttgctatgttgcccaggctggtctcgaatttctggcctcaagtgatcctcccacttaggctttccaaagtgctcaaattataggcataagctacagtgcccacttgtcaactattctaaaattggtatcttctctgttatatatttttataactttactacatatacatcaagatagtaggattgcttttatatgcataattgggaacatgtattt

SEQ ID NO: 144389 - DNA, 601 bp, Human
taaaataaaaaagaaagaaagaaaggaaaaaaaaaaaaaacacagaaaagaaatttgcacgtcatagtggtatgcacttgtaattctacatgggaggctgaggtggaggattgcttgagcccaggagtttgaggctgcagcaagctatgattgtaccactgtactctagcctaggcgagagggctacacccctatctcccccccacccccccaaaaaaatacatataggtatgaggtgtatgtgtgtgtgtgtgtgtgcacactttccttgccttagatcacatgtagcacatcgaaaacyaatctagtttatctatgtttctctaatctttatataattataatacattttaaatggaggttaattagtaaaatatatgcatataatttatgaatagtttttattttttgttcattgctatatcccaacatcaagaataatatgtaacaggcaataattgctgaatgaatcaataataatatagatcaaaaggtatataataaaaatttaagagacctctaattacatgactttataggaaccctcagacaatgaaatcttatgacttctatttccatttgttctttgtccatgccactg

SEQ ID NO: 144390 - DNA, 601 bp, Human
ctggacaacatagccagaccgcatacccaccaataaaaaaataaaataaaaaagaaagaaagaaaggaaaaaaaaaaaaaacacagaaaagaaatttgcacgtcatagtggtatgcacttgtaattctacatgggaggctgaggtggaggattgcttgagcccaggagtttgaggctgcagcaagctatgattgtaccactgtactctagcctaggcgagagggctacacccctatctcccccccacccccccaaaaaaatacatataggtatgaggtgtatgtgtgtgtgtgtgtgtgcrcactttccttgccttagatcacatgtagcacatcgaaaactaatctagtttatctatgtttctctaatctttatataattataatacattttaaatggaggttaattagtaaaatatatgcatataatttatgaatagtttttattttttgttcattgctatatcccaacatcaagaataatatgtaacaggcaataattgctgaatgaatcaataataatatagatcaaaaggtatataataaaaatttaagagacctctaattacatgactttataggaaccctcagacaatgaaatc

SEQ ID NO: 144391 - DNA, 601 bp, Human
cctggacaacatagccagaccgcatacccaccaataaaaaaataaaataaaaaagaaagaaagaaaggaaaaaaaaaaaaaacacagaaaagaaatttgcacgtcatagtggtatgcacttgtaattctacatgggaggctgaggtggaggattgcttgagcccaggagtttgaggctgcagcaagctatgattgtaccactgtactctagcctaggcgagagggctacacccctatctcccccccacccccccaaaaaaatacatataggtatgaggtgtatgtgtgtgtgtgtgtgtgyacactttccttgccttagatcacatgtagcacatcgaaaactaatctagtttatctatgtttctctaatctttatataattataatacattttaaatggaggttaattagtaaaatatatgcatataatttatgaatagtttttattttttgttcattgctatatcccaacatcaagaataatatgtaacaggcaataattgctgaatgaatcaataataatatagatcaaaaggtatataataaaaatttaagagacctctaattacatgactttataggaaccctcagacaatgaaat

SEQ ID NO: 144392 - DNA, 601 bp, Human
agaatagcatattgaaaaaaaaaaaaactccctgggattttttttttccttgattaaaaataatgctgttaaatatacatgctttgggccaagcatggtggctcatgcctgtaatcccaatattttgggaggccaagataagaggatcgattgagcccaggagtttaagaccagcctggacaacatagccagaccgcatacccaccaataaaaaaataaaataaaaaagaaagaaagaaaggaaaaaaaaaaaaaacacagaaaagaaatttgcacgtcatagtggtatgcacttgtaatyctacatgggaggctgaggtggaggattgcttgagcccaggagtttgaggctgcagcaagctatgattgtaccactgtactctagcctaggcgagagggctacacccctatctcccccccacccccccaaaaaaatacatataggtatgaggtgtatgtgtgtgtgtgtgtgtgcacactttccttgccttagatcacatgtagcacatcgaaaactaatctagtttatctatgtttctctaatctttatataattataatacattttaaatggaggttaattagtaaaatatatgcatat

SEQ ID NO: 144393 - DNA, 601 bp, Human
gacatttaacatcatttgcaacaacccacaatgcttgaactactgccaatatgatggataaaaacacaggggggctatttgactttaatttgcattcctttgctagaaagtttaatatattttaattttaaatgtaatactttaatatacttcccaattttaaagaattggttattcttcgtggaaagggctaggagacacaagtaaataaatggtaaaggtgacagtctatgatttttctcattgggaaaaaaaacttcgaattaatgtttttactctagttctggtttagaaagcttgyatttttttaaacttcaatttaataatgtaaaactctaagaatgatatttaaattactagttgcaatagtgcagcagttctcaaactttttggtgtcaagatccctttatattcttaaaatgtattgaggaccacaaagagcctttgttttcctaggtcatatttatcaatatatgttttttacttacaggatattattacttattatatgccctttaaaggagtcttttctcagaatagcatattgaaaaaaaaaaaaactccctgggattttttttttccttgattaaaaataatgctg

SEQ ID NO: 144394 - DNA, 601 bp, Human
cctttcagggggctcctgagatcacaactcttttcataataatggcaaggtattatttggcttttccactgtgttgacacttgccctgatgatgcaaaagcaaagcaggatgaaactgcgagtgcctctgccctgaccaaggctgcaccctcaagccatgagtctactccttaccactgggcactcacattttaaaaaggcgacttcacttaagaatgtctttgaagaagagtaaaaactattttcttgaatctcaaccattaaatacatatgtttttaatattctgagtgataaaattgsaggtacaaataaagtactacttctggcataaacagaaatagcattgttgtcttgagaaaaagcatttatgctattattcttcgacctgtgagccaaactagctgctgctttcatgaaatgtaatttttacttaaaagaactaattattattcagaattggatatctggcagaaatttttccaaaaattaataaagcatgcccatcacttcaaggaaaacaactaacagcaattgtcaccaattataaaatgcaagctttcaactgaaaatcagaattttggaaaacttgtatgtatctac

SEQ ID NO: 144395 - DNA, 601 bp, Human
attattattaagtatcaaaaaatgattgataccactgccaattccttttgctgtaaaaataaggttgctatacaaacatcccttagcctactggagaagccagtaactgccccctcctgctattcaacttcccttttcttaatcacaaaggcatcaactaaatggaagcactgagactcagaaccaacgccttcactttctttgacgaatgttgatttcctcattagagaggtgccaaaaacagaaaaatactgtgttataagcttgtatttaacataaactttaataaaagtatatttcytccatataacatttatttaatcaacccctaatttttagacatttgtattatttctaatgctgcattattcacagcgattcacaaaatgtaatcctcagacccacaaaggatccagagaccctttcagggggctcctgagatcacaactcttttcataataatggcaaggtattatttggcttttccactgtgttgacacttgccctgatgatgcaaaagcaaagcaggatgaaactgcgagtgcctctgccctgaccaaggctgcaccctcaagccatgagtctactccttaccactggg

SEQ ID NO: 144396 - DNA, 601 bp, Human
ataagtattacatcttcctttcagtttattcttaagactaacaggttgtaaattatcctataacaatatgcaagtttttctctgatctacagatcaaaggatcaggcacgatgtctagtttgcaacgttcataccatgaaaacattttgaataaaataatttacacaatataccttatgtctaaatacaaactttttaagttgcccttcaaactaaaacacatgtaacattaattcgaattaattattcaaacttaaatctaaaatcttaatggtatttttccttataatttagtacataygtacattttgtatagtatattttaaaactttatgtacatagcatgctgtatatattcttccagcatactttacccaagtttatctaaaacataaaattttgaataaacacaatggctatttggaaaggaactttaaacatcaaaccctccttagaacttggtgcttaggaaaatattaaaccttactcaagacaagtcatgattattattaggcttccactataacagagaaatatctcggatgcacaaagcatcctatcttcaatgatgccgctcacaaaaagtgttcctccctgctgc

SEQ ID NO: 144397 - DNA, 601 bp, Human
caatccttaagaatgaattcaattcattactcatatgattcatattctgtatcataaacttgggcaaaatgcagctatcttatccattcatattggtcaatatttacctaggctataataagcataagttgccacaattacaattccaccagagtttagtgctattccattctaggtcaatgtccaaaaccactcttcatattttacttcacagaagtccatcttcagcttcctgtgacctctctttcctaaagagaacttaacatatacctaataatcagctgtaagcatggtagtaggstcctgaagtaacatttcttaaatgaatggctttgaaaaacgatttcatttttacccagtatttttcaaccagaaggatcttgctcattctttataggagtctaagaattattagtgccttcctagcatatctttagtatatctctgctctcacttgtaaatgtattggctaaattgtccccaatatctagggaataaggagtaagtgttccccaaaccatgaaggaagaatgaaggaagaagaacatcacccatttccttacacattagctcccctcccctatcctctggctctgatgct

SEQ ID NO: 144398 - DNA, 601 bp, Human
actgactatcaacaaagcaggactgataacttgcatctttgatctttggtcatttttaccatggcttcttatcagcactctcctgtactacaatttatatcccccaaccaaactatctctactcccttctcacttcctgtatatcccaaacttggctcatgttatttactcatatatattcaactatatacaaccaaatagaactctgttctccataggtgaatcctgcctgcttcaagtcatgttaaccaaccttccagttaattataactaaggtgtgctcacctttcaccatgccaarctgcctcccaaactaataatcaatccttaagaatgaattcaattcattactcatatgattcatattctgtatcataaacttgggcaaaatgcagctatcttatccattcatattggtcaatatttacctaggctataataagcataagttgccacaattacaattccaccagagtttagtgctattccattctaggtcaatgtccaaaaccactcttcatattttacttcacagaagtccatcttcagcttcctgtgacctctctttcctaaagagaacttaacatatacctaataatca

SEQ ID NO: 144399 - DNA, 601 bp, Human
acctctgctatacctatccaaaaaaaaaaaaaaaaaaaacctaccacaaaaaaaaaacaacctttaagcaactgactatcaacaaagcaggactgataacttgcatctttgatctttggtcatttttaccatggcttcttatcagcactctcctgtactacaatttatatcccccaaccaaactatctctactcccttctcacttcctgtatatcccaaacttggctcatgttatttactcatatatattcaactatatacaaccaaatagaactctgttctccataggtgaatcctgccygcttcaagtcatgttaaccaaccttccagttaattataactaaggtgtgctcacctttcaccatgccaaactgcctcccaaactaataatcaatccttaagaatgaattcaattcattactcatatgattcatattctgtatcataaacttgggcaaaatgcagctatcttatccattcatattggtcaatatttacctaggctataataagcataagttgccacaattacaattccaccagagtttagtgctattccattctaggtcaatgtccaaaaccactcttcatattttacttc

SEQ ID NO: 144400 - DNA, 601 bp, Human
ggtgaagagtgtttatgcaaacagagccaataaaaaagtattttggtcttgggatctaagattcaatatgcacgcaaagactcatttatagtcttttgaagaagtattcttaggagcaaacaccacacaaattaagatttgaaaaccacaatgactgagtaaaaaaccaagtgtctaaacaacagaacaggccctcaaactattttacccaactgtttacataagtaacacttgaccaccttgatatgtgaccctccccccaacctctgctatacctatccaaaaaaaaaaaaaaaaaaaacctaccacaaaaaaaaaacaacctttaagcaactgactatcaacaaagcaggactgataacttgcatctttgatctttggtcatttttaccatggcttcttatcagcactctcctgtactacaatttatatcccccaaccaaactatctctactcccttctcacttcctgtatatcccaaacttggctcatgttatttactcatatatattcaactatatacaaccaaatagaactctgttctccataggtgaatcctgcctgcttcaagtcatgttaaccaaccttccagttaattata

SEQ ID NO: 144401 - DNA, 601 bp, Human
atggcgagaacccatctcaacacaaattaaaaattagatgggcatggtggcatgagctggtggtcccagctacttcggaggctgaggttagagccacttgcactccacagagcaagaccttaccttaaaaaaaaaaaaaaaaaggcaagtcccatctcaaaaaaataaataaataaataaatcagtgtcgtctatattcttttggacaagcactctttagggacctatctgccagacacttgtgggtaagggagaagggtaggaaagcaacaagtagctaagaagactttccctacaggcrcttacaatctatcaactaaggcaaatgcaaatcatagtaatatgtatgctatagcagaagtgggcaaagttcattctcccatgtaattcagtaattatttactatgtcccatctcttaagattataagctacttgaaaacaaaagacatataataaatttttctatatattaataaacacagtttaaaagaatattaagtaaagtgtatattaaaaagtcaaactaggtcaagatcaaaggaccttttattttcttaatatttacttactaaaattcttcattaaacagtaaaagattag

SEQ ID NO: 144402 - DNA, 601 bp, Human
gtgagagaccctgttctaagtgctgggaatacagcagtgaacaaaccgaccaaaatttgtgccctcatagggcttagaatctagtgatcttaatcacaacattctgtttcccctcaaaatattctgctttaaaaatgtaaagccagatgcagtggcacgctcccatagcagggggctgaagcaggaagatcactccagcccaacagttcaaggttgccgtgcactgtgatcacaactatagacagccacttactccaagcagggcaaaacagcaagaccttgtttcaaagaaaaaaaaaaatggggattgtcaggcaacataggctgttatcttaaaacccatgaaagaaacttctgtctctctcgttcaatatctaactcctagttacaatccaacccctgacaactggacacagagaatgtgacgtctcctacagtaaatgggggactaagagttgtggggagaagtttttttacctttcagagacgatctgtgagtatataaggtgaggggaagggaaaatctgggggggaaataggtacagataaatccaaaaggaggctgttccaggtaaagctgatttacttaggggtaacctca

SEQ ID NO: 144403 - DNA, 601 bp, Human
tgggattacaggtgcccaccaccacgcctgtctaatttttgtatttttagtagagatggggtttcaccatgttggccaggctggtcttgaactcatgatctcatgatccacctgcctcggcctcccaaagtgctgggattacaggcgtgagccactgtgcctggccaacatttttttttaattattatttatatgaaggctgggcatggtggctcatgcttgtaatcccaacaccttgagatgccaagatgggaggatcacttgagcccaggagtttgagaccaacccaggcaacatagcwagactccatctatcttttttttaaaaagagaaccacatccatattttgtggaaccacaaaagatctcaaatagcaaataacaaagctggaagcaccacactacaagtcttcaaaatagaatataaagctataataaccaaaatagcgtggttggcataagaacagacatacaacgtgagagaccctgttctaagtgctgggaatacagcagtgaacaaaccgaccaaaatttgtgccctcatagggcttagaatctagtgatcttaatcacaacattctgtttcccctcaaaatattctg

SEQ ID NO: 144404 - DNA, 601 bp, Human
ccgacacaaaagaatgcagagactcaaaaatgaccaaagtttagagatagttaacagcctgataagagctaagagttcacaatgggaaatagaaagtcaggcagtagaatttaggcatgatttgagaagaagtaaaaaaagttgctggaggttatcaaactgggttgcaacaatagatggtggtcgatgactataaagcccaatgcaagtcatgtaagtgggatgtggcaaccaccatccaaaaacgatgaggacagtttaaacagacattccacagcttgactgctacattgaaaacttygcatcaccaatgtgtatactgccctccttaaattcttcattaattacttaaaatagagattctcaacagtgctttttattctgctcagggtgtggcaaaactctttaaatcacctaatttactccatgtttttgttcttcacctaagaattggaagaggggagaaataggaaaataagattttcgaaaacgtatgactaattaccacataatccttcttattattcaactgaacatcaaaactgcccatcattcacttgaacaccagtgtaactttgaaatatatgaactgttgcatctt

SEQ ID NO: 144405 - DNA, 601 bp, Human
gtgggaactaaactgaacctcagaaggaaggtaggagttggagagactaaaggggaaaggaaaagatagtaaaatatattgtgtctgtgcgtgtatgcgtacgtgaatgccgacacaaaagaatgcagagactcaaaaatgaccaaagtttagagatagttaacagcctgataagagctaagagttcacaatgggaaatagaaagtcaggcagtagaatttaggcatgatttgagaagaagtaaaaaaagttgctggaggttatcaaactgggttgcaacaatagatggtggtcgatgackataaagcccaatgcaagtcatgtaagtgggatgtggcaaccaccatccaaaaacgatgaggacagtttaaacagacattccacagcttgactgctacattgaaaacttcgcatcaccaatgtgtatactgccctccttaaattcttcattaattacttaaaatagagattctcaacagtgctttttattctgctcagggtgtggcaaaactctttaaatcacctaatttactccatgtttttgttcttcacctaagaattggaagaggggagaaataggaaaataagattttcgaaaacg

SEQ ID NO: 144406 - DNA, 601 bp, Human
agaatacactgataccagggtagcatttatagcaccctgcagaacagccaaacagactgaatacctagacctgtccatacctgtggtctcaagtttaactctttttttgagcatgttctgaaaacaaagagaattcaaaatcaaaagagaaatatcagccaggtgcagtggctcatgcctgtaatcccaggactctgggaagcccaagagggcagatcacttgaggtcaggagttcaagaccagcctggcctacatggtgaaacctcgtctctactaaaaatacaaaaattacctaggcakggtgggggggtgcctgtaatcccaggtacttggaggccgaggcacgagaatcacttgaacccaggaggtggaaattgcagtaagctgagatcgcaccactgccctccagcctgggcaacagagcaagactcagtctcaaaaagaaagaaataaacaagcgaaatatctaacagttatgagatactgttttaattctgttcattaaaaagaaaacataaacatgctaaaacgtctttatcagcaaaacctgttcaggcagttaaaaaaatttctctctccaacaaacaagatttaacttgc

SEQ ID NO: 144407 - DNA, 601 bp, Human
tagctggggctataggtgtgtactaccacacctgactaattttttataatttcttttgtagagaaggggtctcatcatcttgttgaggctgatctcaaacttctgagctcaagcaatcctcccgtctaggcctcccaaagtgctgggattataggcatgaaacactgcacctggccgggttctttaatttaaattaggcattttttaattgagggggagtaagcagagggaagtgcccaggacgttatcaaaagtatagttttatttttatgtaaataaagcacaaatcgattttttttttgtataggatgtctcaatcaaacttctggtgacttaagcaaacctgaaacaggttttggcaacttgatcaaggtcaccttagcttcaaccatgctaataataaaaaaaaaaaatcaatatgatcaaactaaacagactgacttttctatgtgtttgcctttttgctgacaaccaggtgaaaagttccaggactctgaaggcagggccacaattactcactacccaaacctgaaattccagttctttcacatagttcttcacttcccatcattggccacttggactaacctggtatcagaat

SEQ ID NO: 144408 - DNA, 601 bp, Human
ttaggagccaacaaatttctgttgatcacctctctaactcaagaattctctagctcgagaatcaagactgacctcttttggtgatagtacagaaatgtaatcttcatatatcattctagccttttctcttttctttgattacttttttgttctgttctttctttaagtcttcacaggcaatccagaaaagtaggttctctttgttgtattctgttcagaggaactctctgaaaaggtttcttcctgctggggccttcatcatcttgtcaaaattttgagaccagggcaagacttcctctgsagtggggttttggcattcctctaggacctggatactctccatttttgtagtgtgtgtggttcttcctgcattttcccctttcttcattcctaacagtgaggcaggagcagctgcaacaacagcaccaacaaaagcaacagatgttgttgggcctctggtttccaggcgcttgagacacagcaggtgttccttcattttgggactgctgcctttttcacatttcagctacaagacccaattagccagttgcctgcaggtgtgggcagtgcaccgatgggtctggggggagcggggctgggc

SEQ ID NO: 144409 - DNA, 601 bp, Human
tttaatacagcaataagagctagatctttagaaaggaaatgtatccaagcttaggatagaaacacaatctgtttattattctaaaatgtttatttctaactgtttaaaagctgttatgcagtgatagcagttaggtataagtcaacagttttaaaattctaaaatttctgaaatgagatttaatatgagaaataatgaaggaagaatgaatttcacattgcacatatgacatatttaaaaatattacatttggttattgtcatcaatgcttgatagtgttccttttccctactcatcttaragcttttatcataggaataaaatcaattcccaaactgggaccttctatcagttagggcaacattttccttttgtagtgttttcattagagtcaaagtcttgaacatcccctggaattcatctgaaaagatgttacttggggctggagagaactatacatgtgaggattaggagccaacaaatttctgttgatcacctctctaactcaagaattctctagctcgagaatcaagactgacctcttttggtgatagtacagaaatgtaatcttcatatatcattctagccttttctcttttct

SEQ ID NO: 144410 - DNA, 601 bp, Human
ctaactcagctaagtgatcaaggttaacatcaacagctaagagaagcctaaagtttgagagactgtcacaactaagaagagtcctgatgatggcatatacctttgatatcatgtgataagcatggcactttacctttgtgttcttccaaaaaccaaaaacccatgtctagtcatgaggaaaacatcagacaaatctccacagagggacattccacgaaataccagtttatttctcaaaactgtcatcaaaaacaaggaagctttcagaactgtcacaactaagagaagcctaaggaaacaygacaactaaatgtaatgtggtgggatcctgggacaggaaagggacatcaggttaaaaactaaggaaatctgaataaagtatgaacttaatgaccaatactggtttattaattttgacagatgtcccataggtctgtaagggacctttctatttacagtttttctgtaaatataaaactactctaaaattaaagttttcatggacacattactattttaaattttacttttattgtaaacatttttattttttcttagagtcagggtctcactttgttgcaaagacagatctggaactcct

SEQ ID NO: 144411 - DNA, 601 bp, Human
taccttcaatataatctctttaaaaatatattactttggccaggtgcagtggctcacacctgtaatcccagcactttggaggctgaggtaggtggaatgcctgagctcaggagttcaagaccagcctgggcaacatagtgaaatcccgtctctactaaaaatacaaaaattagccgggcttggtggtgtgtgcctgtagtcccagctactcgggaggctggggcagaattgcttgaacccgggagacggagggtgcagtgagctgagatcgcaccactgcactccagcctggtgacagagygagactctgtctcaaaaaaaaaaaaaaaaaaaatgtgttactttacagtggagaaacataatagatgctaactcagctaagtgatcaaggttaacatcaacagctaagagaagcctaaagtttgagagactgtcacaactaagaagagtcctgatgatggcatatacctttgatatcatgtgataagcatggcactttacctttgtgttcttccaaaaaccaaaaacccatgtctagtcatgaggaaaacatcagacaaatctccacagagggacattccacgaaataccagtttatttc

SEQ ID NO: 144412 - DNA, 601 bp, Human
tattgtccactaataaacattggtggagtacaatatatggttatagattaagtatgatgaacatggtagtaaaaatttatacacattcgatacataattttacaaaaccaaacacattatttagcaaacattcaaaaatcatacacaagaaacatatttatgacaaattggttaaagctggtaggaaatacatcaggtcttttacattatttcaatattcagtgttcattgactagtggagggcaatatagaaatgcactaagcaaaactaccagtttaagttacctcttatgacaatgartaagactaagatatttaatattgaaagtatatggaggattattgtaattatttacccagatagttcaagggaaaaattcactttcgcctctattaggtgaatattcaggataagacttttggacttttatttttctactttactgtattttctttatagcatgtattagtaatcacttaatggaacctaatatcagggttgaagaatctgctcagaatttgtttagctcagtgtaaatgtccagaaattttaccttcaatataatctctttaaaaatatattactttggccaggtgcagt

SEQ ID NO: 144413 - DNA, 601 bp, Human
ctacctagtttgagacttctgaatttttttacattattgtcgtgctcaaattctactacatggtgaaaattctagcattttccagaaatatattattgtacataggtaaaatgataaaactgattctaggaagggggaatttaaaaaaccagaaaagcttaaattggaggaaacataatctggattaactattcaatttattgagtatccactgttattctggcattgcaaaataaccaagtgtggtgtctcttaagttgtattcatgcatttaaaacttctttattgtccactaataaayattggtggagtacaatatatggttatagattaagtatgatgaacatggtagtaaaaatttatacacattcgatacataattttacaaaaccaaacacattatttagcaaacattcaaaaatcatacacaagaaacatatttatgacaaattggttaaagctggtaggaaatacatcaggtcttttacattatttcaatattcagtgttcattgactagtggagggcaatatagaaatgcactaagcaaaactaccagtttaagttacctcttatgacaatgagtaagactaagatattta

SEQ ID NO: 144414 - DNA, 601 bp, Human
aaatcatttcattgcactcagtgttctcataattgaaaaagaaaatgtttctataccccaactgttcatttaaattttttcaaatattcaacgaatttaagaaagttgagagaaagtttaaaactatgtttttgcaatctaaacaggtaccatgtatttactatgaatatattttaggtaggtatgcaagatagctacttaaaattaagcattcttttattttttaattaatttttttattgttgaattctttattaattcaaaacattttaagtcagtgtaatgcacatgcattttacataacatccatagatttccacaatatagtaaaatgaaaacagctctatcttgatttactttgaaaactcaaagaaagctacctagtttgagacttctgaatttttttacattattgtcgtgctcaaattctactacatggtgaaaattctagcattttccagaaatatattattgtacataggtaaaatgataaaactgattctaggaagggggaatttaaaaaaccagaaaagcttaaattggaggaaacataatctggattaactattcaatttattgagtatccactgttattctggca

SEQ ID NO: 144415 - DNA, 601 bp, Human
aatatggaaaaaacaataaagaaacatcccaaaatgtaggtatagttaagaaaccagatttgaactttcccaaaaaagaatagtcatactttctcagctcctgctttctctaaaccaggtactctacacacaaagttgaagggaaaaaacacaagttaatgtcacaaggcaaacaaatcatttcattgcactcagtgttctcataattgaaaaagaaaatgtttctataccccaactgttcatttaaattttttcaaatattcaacgaatttaagaaagttgagagaaagtttaaaactaygtttttgcaatctaaacaggtaccatgtatttactatgaatatattttaggtaggtatgcaagatagctacttaaaattaagcattcttttattttttaattaatttttttattgttgaattctttattaattcaaaacattttaagtcagtgtaatgcacatgcattttacacaacatccatagatttccacaatatagtaaaatgaaaacagctctatcttgatttactttgaaaactcaaagaaagctacctagtttgagacttctgaatttttttacattattgtcgtgctcaaat

SEQ ID NO: 144416 - DNA, 601 bp, Human
tgtataagcctttttagaaggctaccacaatttagtaactcattaaaatacttcaaaatagatttgtactgatatttttctctctagttcttttttttctttttgagacagagtcttgctctatcgcttaggctggagtgcagtggcacgatctcagctcactgcaacctccgcctgggttcaagtgattctcatgcctcagcctcccaagtagctgggactacaggtgtgcaccaccacgtctgactgatttttgtaatttcagtagagacagtgtctcactatgttgcccaaggtggcytcgaactcctgagctcaagtgatctgcccacctgagcctcccaaagtgctgggattacaggcatgagccactacgcctagcctttctagctattttaaatacagtattattgctagaatttacattaaaatatgcgaatatggaaaaaacaataaagaaacatcccaaaatgtaggtatagttaagaaaccagatttgaactttcccaaaaaagaatagtcatactttctcagctcctgctttctctaaaccaggtactctacacacaaagttgaagggaaaaaacacaagttaatgtca

SEQ ID NO: 144417 - DNA, 601 bp, Human
tgcagagggtttgtagatttccctatttactactttaagtcttagagttttactattattatctcccaagtttactatatcatatcatcttgccttacattttcactcagcctaaaaagtaaaaaggaaacatgtataagcctttttagaaggctaccacaatttagtaactcattaaaatacttcaaaatagatttgtactgatatttttctctctagttcttttttttctttttgagacagagtcttgctctatcgcttaggctggagtgcagtggcacgatctcagctcactgcaacytccgcctgggttcaagtgattctcatgcctcagcctcccaagtagctgggactacaggtgtgcaccaccacgtctgactgatttttgtaatttcagtagagacagtgtctcactatgttgcccaaggtggcctcgaactcctgagctcaagtgatctgcccacctgagcctcccaaagtgctgggattacaggcatgagccactacgcctagcctttctagctattttaaatacagtattattgctagaatttacattaaaatatgcgaatatggaaaaaacaataaagaaacatcccaa

SEQ ID NO: 144418 - DNA, 601 bp, Human
aatatctggaaaaataagaaatcccctagacaaatacctagcaaaagtaccttaccataccccagtacaactgtcaattaaaatgcttttatatattatgcaatctcttgatatttgggataaatcattttcaaccatatttttaactgaaacaactggtgcagagggtttgtagatttccctatttactactttaagtcttagagttttactattattatctcccaagtttactatatcatatcatcttgccttacattttcactcagcctaaaaagtaaaaaggaaacatgtataagcmtttttagaaggctaccacaatttagtaactcattaaaatacttcaaaatagatttgtactgatatttttctctctagttcttttttttctttttgagacagagtcttgctctatcgcttaggctggagtgcagtggcacgatctcagctcactgcaacctccgcctgggttcaagtgattctcatgcctcagcctcccaagtagctgggactacaggtgtgcaccaccacgtctgactgatttttgtaatttcagtagagacagtgtctcactatgttgcccaaggtggcctcgaactcc

SEQ ID NO: 144419 - DNA, 601 bp, Human
aaacatgtttttttcaaagtgtcagtctttataaagtaacaaggaaaaacataagtgaaactacttcttcatcacacagacataagcggtcaacttatttgcacagttttcagagggcatccaggcagacatctaccagataataaaaaatcttaggctggctcagatgtctcttaattgggtgaggaccatattcttattctccaaggagacatgccacaggaatacttagcaacaaggttcctaacctgtcatccccaaaataagctttggagttaaagtaaaatagtaacacaaagcrgttcagagaacaggctctggagtcagaccgattgggtgccaatcttctgcagtgtgacagaagactggacaagttacttgcttggtgtctcagtcccctctttccataaaataggtgtcagtctcaagtctcttccttctgtaaaacgggtaaagtaataccaaaacctagagctgttgtgtagatgcaaaaatgcatgtgcagaatacttggcacataacatgcactgaattaacattagcttctttagcgctgtaagtatatgcaagaaatatgtaacaggtgcatgctaggtaacta

SEQ ID NO: 144420 - DNA, 601 bp, Human
tgatatctcaatttcctcattataaaatggggatcagtatttaccttacatggttaatacttataaaatccttataacacctgcacaaaatatagattcattttgttagacaaaaacaaataacttaagaaaatacatatatgtacatgctgatgttaagctaacagtaccatctccctttccaaaaacataaataacctctgcaaaacaaactaagtatatcatacatagtaagtgtataagtgttgttttgcaaaactctttttaggctatgtagacacatgtatgaatatggtaccayaatgtaaaattcacttctctcatgttccaaagagtgtcaaatccactataactagagcatattagtgagtggcttagggctttgtcctctgctgctacatcctgagatcaaacctcaccacatcaagcctagcatctatatacagcatctttcatttaagagggctgcatagtaaacacactgtttcaaaccttaatatacacacaaacatcctgtcttaaaccaaattcaaaacacctttcttcctaaaatatattttgtattgtctctagattaaatccatatcactattaatatatt

SEQ ID NO: 144421 - DNA, 601 bp, Human
tcaatgattctaatgtagtgaccataatacttaaaaaattcccactgggcaaaaggatatattaataagtaaatcaaagaaaactctaattgaaaataaataaaatttacaaataaaccacttcaccactagtagtcaaggaaatacaaattaaaatagtaaaatgtcatttccaccctaaagactggccaaaaaaaaaaaaaggacttctgttgataatggtttgggaaatacactattagtagtagtagaaattaatacagctcctcttaccccccgcaacttttattttagattcagsgggtacatgtgcaggtttgttacatgagtatattgcttgttacataggtgaggctgagatttgaggtatgattgatcctatcacccaggcagtgggcacagcacccaatagttagtttttcaacccttgcctgcttccttccttcccccatctagtagtccctctttatgtccacgtaacacagacttgtccatctttatgtccacgtaacacagccttttaaaagaatatttgtatttatatttttagtaagctcagtaattctgtttttaataaccctacagatataatcacataagt

SEQ ID NO: 144422 - DNA, 601 bp, Human
gcttgaacctgggaggtggaggttgcagtgagtcaagatcacaccacggcactccagcctgggtgacgaggcaagactcagtctcaaaaaaaaaacaaaaaagaaaagaaaatgtaaagagagtatatactaattttaggagtgacaggagtgaagagaataaagctttcctaagcagaaggcaagaaaagcccccaaaactaatattattaatttgtaatattgacatattttattaaaaacatttaaaatttctatagcgcacaagatatcacattgttaaaagacaacactagactgrgagaaaatatcaatgattctaatgtagtgaccataatacttaaaaaattcccactgggcaaaaggatatattaataagtaaatcaaagaaaactctaattgaaaataaataaaatttacaaataaaccacttcaccactagtagtcaaggaaatacaaattaaaatagtaaaatgtcatttccaccctaaagactggccaaaaaaaaaaaaaggacttctgttgataatggtttgggaaatacactattagtagtagtagaaattaatacagctcctcttaccccccgcaacttttattt

SEQ ID NO: 144423 - DNA, 601 bp, Human
aagaaaatgtaggccgggggcggtggctcatgcctgaaatcccagcactttgggaggccgaggcaggcagatcccgaggtcaagagatggagaccatcctgggcaacatggtgaaagcctgtctttactaaaaatacaaaaattagctgggcgtggtggtgcgtgtctgtagtcccagctacttgggaagctgaggcagaagaattgcttgaacctgggaggtggaggttgcagtgagtcaagatcacaccacggcactccagcctgggtgacgaggcaagactcagtctcaaaaaaaaaacaaaaaagaaaagaaaatgtaaagagagtatatactaattttaggagtgacaggagtgaagagaataaagctttcctaagcagaaggcaagaaaagcccccaaaactaatattattaatttgtaatattgacatattttattaaaaacatttaaaatttctatagcgcacaagatatcacattgttaaaagacaacactagactgagagaaaatatcaatgattctaatgtagtgaccataatacttaaaaaattcccactgggcaaaaggatatattaataagtaaatcaaagaaaact

SEQ ID NO: 144424 - DNA, 601 bp, Human
agtaaataggtttccttctctttagaaacttgtatccatagacttctgcttgcttcttcttctcatacattcaccatgctaacacgcttgttaagatcaaaccaaagcaccattgcataaagggatattgcattcaatactgatggggttgctctcccatagaagtgcttcattctcagctacaaatattcccagtttagaacagacagcaacaacagagttttaaattgtcagcatcaacagcattgatatttcctttccaacacccccgccatgacccctgccatctccactcaagagygccaagcaattctggaaaatatgaactgaataagggaagatgatcaaaatgctggcaaccctattaatagtgtcagtttctttagactaatatatatttataacctagaccataactgaaaacaaaaaatatattctaatctggtgccttcagtgattttataaacagccaaaacagaatacattattttaaaagtcataaatactttttaactttaaaaagttaaaaatcccaacagggttttcatgtagcttaacaagctaactctaaaattcattcaaaatcctattccaatttggg

SEQ ID NO: 144425 - DNA, 601 bp, Human
caagataatgtttgaaattccattgcaaatccttgtggagttattttttaacaaagtctaatcctagtgtaactgtgtcatgacaattggctttctttagtctttgcctagattcttctttttgtagccaggataaattacaatttggccatacatctcaaaaagtaagagtcaatgagaatgatctgttttcttattggaatgtccacattaaaagcttaatagtattggtgggttgtgtatgtgtgggtatatgtaaacagaatcagttatgaggtaaacaaacaggtagttttttttkgggggggggtatagtaaattttaaccagatgtaaatgtttactttacttacaaactaagtagattaataaatatcagagtagtcactaccagacaggtaagtgttttaaacatgcagattccatataactcaaagaattttaaaaaatcataaagggcaatttctgctatgaaaagatggactttgacaagaatcttatacaatatgtacacagcaaagaataaaatgaggtaaggcatccttgaatacaggcagtttagctacaatagagtctctcccagaatggaaaattcatactac

SEQ ID NO: 144426 - DNA, 601 bp, Human
accaggcagaaaagtttatgtagttgtagtacccactgctcaacacattggtctaaattataagaacatcatagttttactgactacaggtgtagtacatgagtctagttcttaaaaatgttatacataaatgtatttgggaaaaagtaaaaaatcgcactaatcctagatataatcagtataaaagacaatttacttaatagtcttccatattctctttttcctttatggttctttttctctcttataccctagcataatggttaagagtttgggctctctcaggtcagtcaatttcaayacaagtggcactttacagttgtgtgtttctgggtaacatgcattccttcaacctctttgagattcctcattatacatgttttccttacttgtaaaatggggataacaagagttgtcacaccatacaggcttttaaagatgaaaatataaaatgcatatcacgtgcagggcctggcaagggtaagagacaataagtgttcattaattattaaacagcacataaatttttagattagcctagtgtttatatgtgtgtatgcaaattctgccaggttttggtatcagtgttatgtcagttttg

SEQ ID NO: 144427 - DNA, 601 bp, Human
ccaagagtatgaaacatcattgcttcctttccatatagtgcccctcctcaatggtttctactatttctaaattccaaagtgtattttaaatgatttcaggaattgatgtattacacaaagcaagctaggattgtacaatagatttccaaagcccagtacaaagttttctgtgaagaattcttcatagccaaattctccacatactttaaaaaaatacgccactaaaacagctccaaatatttctgttgattaactcaagctccctgtaaacactttctatattctttttttttttttttttagacagggtcttgctccgttgcccaggctgtagtacagtggcacaatcacagctcattgcagccttgacctctggggctcaagcaatctttccacctcagcgacatgaatagctgggagaacaggcatgtgccaccacacccagctaatttttgtgttttttgtagagatggggttttgtcatgttgcccaggctggtctcaaactcctgggcttaagcagtccatctgcctcagcctcccaaagtgctgggattacagacatgagccattgcgcccagggacctattccttattataaa

SEQ ID NO: 144428 - DNA, 601 bp, Human
aagttgaaatcctttcaacaaatccccatggcacatttttaataattatctttgggaataaataatacagaacatatttatattccaagagtatgaaacatcattgcttcctttccatatagtgcccctcctcaatggtttctactatttctaaattccaaagtgtattttaaatgatttcaggaattgatgtattacacaaagcaagctaggattgtacaatagatttccaaagcccagtacaaagttttctgtgaagaattcttcatagccaaattctccacatactttaaaaaaataygccactaaaacagctccaaatatttctgttgattaactcaagctccctgtaaacactttctatattctttttttttttttttttagacagggtcttgctccgttgcccaggctgtagtacagtggcacaatcacagctcattgcagccttgacctctggggctcaagcaatctttccacctcagcgacatgaatagctgggagaacaggcatgtgccaccacacccagctaatttttgtgttttttgtagagatggggttttgtcatgttgcccaggctggtctcaaactcctgggctta

SEQ ID NO: 144429 - DNA, 601 bp, Human
ttcaaacaattacatttttatattattagatcttttgctatttgtcacttgcagattattttcccctttggtttttgaacagaaccaaaataaaccacaaaccatgggaacaagagagggaagatctcctggaactaaaatctatcaaagatcagggtttccaaagcttcaatatctagaagcaaattactgcagtgataaagtaattttcaattgtttcataactttcttgaaggtcttaacagctccaaagagatttcccctttctattaattatagataaatttaggatatatgttgwaagcaaaatttcagcaaacatttttggagcaataataaaattcaaaccaagttttagcagaagagagtcacagttccccaaatttcaacattgtccacgatatagtttccacttgtggttgatcacgtatgtggcaataccatcaagttaaaaagagaaggaaagcgaccaatgtaagcaggacattatgtgactcccctaactaggcttgcttgttccacataccacaatccaaggtcctatgtggatatttcagaaaccatgaatcattattccaacttcattaataattttgttcat

SEQ ID NO: 144430 - DNA, 601 bp, Human
cttaacccaggaggcagaggttgcagtgagccaagatcgcaccactgcactccaacttgggtgacggagcaagactccgtctcaaaaagaaaaaaaaaaagaaagactatgaataagtcaggtaagaggcttgaatctgtatatacaaaatacatttaggaaacacctctcaggtgactagaaagattcttcccactctactaccataaatagaaaaaaaatgcacactcctgaaactccagctgctgatctgggctcatgatgaactgctttgtaaactggattgactagtaactggctraagtatgagtcatcaagaacctaagaactctagaaccacacattctacaattccttctagagaactgcttccctaccttttaaagaaatagtaaaatttcaaatgctgaattttcctaggtttagattttcaaaacaaataaaatattgggacttatattagtttgctacggctgctgcaacaaagtactacaaactgggtccctcagcagaaatttattttctcacagttctggaggctaaaagtctgaaatcaaggtgttggcagggctggctccttttgcagactgtgggggaagga

SEQ ID NO: 144431 - DNA, 601 bp, Human
gcacttcccaggatcactcctaatttagtcctacagccttctccttctgaggtacttgcttttatcatgaaaggcatggtccattcttttctagtccactgacatgggatgtatattcaaagttgttcatctctcgtttccccaggatgctattaatccatatataagaaagagaccaacttcagattttcataagaatatgaatagttaggtgctgggcgcagtggctcacgcctgtaatcccagcactttgggaggccgaggcgggcggatcacgaggtcaagagattgagaacatccyggccaacatggtaaaaccctgcctctactaaaaatacaaaaattagctgggcatggtggcatgagcctatagtcccagctactcaggaggatgaggcaggagaatcacttaacccaggaggcagaggttgcagtgagccaagatcgcaccactgcactccaacttgggtgacggagcaagactccgtctcaaaaagaaaaaaaaaaagaaagactatgaataagtcaggtaagaggcttgaatctgtatatacaaaatacatttaggaaacacctctcaggtgactagaaagattcttcc

SEQ ID NO: 144432 - DNA, 601 bp, Human
ttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatggctttgttaaacagatatttgaaggcagcatgctcgttaagagtcatcaccactccctaatctcaagtacccagggacacaaacactgtggaaggccgcagggtcctctgcctaggaaaaccaragacctttgttcacttatctgcacttatctgctgaccttccctccactattgtcctgtgaccctgccaaatccccctctgcgagaaacacccaagaatgatcaaaaaaaaaaaaaaaaaaaaaaagaaagttggaaaggcttcaggattgtcagttaaatataattgtttttgcctgggtctactgacaggtttacatcgtctctattacttttttttttttaatttgttttttgtttttgagctggagttttgctctcattgcccaggctggagtgcagtggtgagatctcagctcacc

SEQ ID NO: 144433 - DNA, 601 bp, Human
attccctcactggtaagggaaaagtaactctagattcaacaaaaaacttttattggtttgctctgaacaaaaaatgtgaatacatgcaaaaaatgctttgttaaaaaaaagggagtgatatggcttggatttgtccccgctccaaatctcatgttgaattgtaaaccccaatgttggaggaggggcctggtgggaggtgaccggatcgtggagatggattttccccttactgttcttgtgacagtgaatgagttctcatgagatctagtggtttgaaagtgtgtagctctccctctccctyctctccctctccctctccccacggtctccctctccccacggtctccctctccctctctttccacggtctccccctaatgccgagccaaagctggactgtactgctgccatctcggctcactgcaacctccctgcctgattctcctgcctcagcctgccgagtgcctgcgattgcaggcgcgcgccgccacgcctgactggttttcgtatttttttggtggaggcggggttttgctgtgttggccgggctggtctccagctcctaaccgcgagtgatccgccagcctcggcctcccgaggt

SEQ ID NO: 144434 - DNA, 601 bp, Human
cccattcctagcttcaactattatcaccaaatggccaatcttctttcatccataccccactcactgccctcaagtccttaccctctgtacaggattattttgaaggaatctaaaataccatattttatctctaaatactttagcatgtgtatctaaaagatgtctaacacaatactactatcatatcttaaatatactaacaataaatcttttttttttttttttgagacaaagtttcaatcttgttgcccaggctggagtgcaatggtgtgatcttggctcaccgcaacctctgcctccyagattcaagcgattctcctgcctcagcctcttgagtagctgggaatacaggcatgtgccaccatgcccagctaattctgtattttcagtagagacgggatttctccatgttggtcaggctggtcttgaactcccgacctcaggtgatctgcccgcctcggcctcccaaagtgctgggattacaagtgtcagccaccgtgcccggcctacagtaattctttaatatcatctattataggctgaatggtatcccccaaaattctatgttgacatgctaacccccagtacctcagaatgtctt

SEQ ID NO: 144435 - DNA, 601 bp, Human
ccccctctaactgagtagtcatatctggaggcttgatgaaattcaactttaattttttttggcaagactaaaaaaaaatttatgtattttgatgacagctcaaaatataatctaagcctcaaatttcataaaatcattaaatctttttggttttgctttttttttttgagacaaggtcttaccctgtctcccaggctagagtgcagtggctcaattatagctcactgcaaccataaactcctaggctcaagcaatcctaccacctcagcctcccgagtagacaggactacagtctcaggcyaccatgcccagctaatttttaaaatttttttagagacagggtcccgctatgttgctcacttgaattcctcaagccaggcctgaattcctcaagccaggccttgaattcctgggctcaggtgatcctccctccttggcctcccaaagttctgggattacaggtgtgagccgctgcatctgttcaaatatttttattatgaaaattttaaacaaaataaaaattgtggagtatagtatatataatgaatccccatgtgcccattcctagcttcaactattatcaccaaatggccaatcttct

SEQ ID NO: 144436 - DNA, 601 bp, Human
taccccctctaactgagtagtcatatctggaggcttgatgaaattcaactttaattttttttggcaagactaaaaaaaaatttatgtattttgatgacagctcaaaatataatctaagcctcaaatttcataaaatcattaaatctttttggttttgctttttttttttgagacaaggtcttaccctgtctcccaggctagagtgcagtggctcaattatagctcactgcaaccataaactcctaggctcaagcaatcctaccacctcagcctcccgagtagacaggactacagtctcagrccaccatgcccagctaatttttaaaatttttttagagacagggtcccgctatgttgctcacttgaattcctcaagccaggcctgaattcctcaagccaggccttgaattcctgggctcaggtgatcctccctccttggcctcccaaagttctgggattacaggtgtgagccgctgcatctgttcaaatatttttattatgaaaattttaaacaaaataaaaattgtggagtatagtatatataatgaatccccatgtgcccattcctagcttcaactattatcaccaaatggccaatctt

SEQ ID NO: 144437 - DNA, 601 bp, Human
aacaaagtaacccacctaccttttttcctcttaggctgttctggtgatgaggctcccggtgagtctgcatatttttcttgcacctgctgtgtttccatcacttcaggaatcccatctaatgtgacggacacatgggtgactggggcaacaaccatgtcatcttcaggtgaactaaatatattattatctaatgaaaataaaatcaactaattatagtccactgtgtattataagttaaaaaacgattgagaaaatttcttgtttctattatgactagaagattaaagtagaaataaaatcytgaaatctattcctgcgtttaagttccccttcccaaaatcaaataccctaaaccagtccaggcacggcgagctatttcaatgtctttcttacttgacttcctatcaccagtctgtctcatctctcctcttgattattcacattgctgtgagagttattttctgaaacctaagtctgacctgaccataaaattaggggaataaaaaacaaaactgacatacctttccatagttcataggaaaaacaaaaaacaaacaaaaaaataatcacaacccatctctatagcatgccttacaaagct

SEQ ID NO: 144438 - DNA, 601 bp, Human
ctgatttccaacccattgtatttttccaactggagtcttatactggaatcaccggtacagactggaggctttcaaacaataacccctgggaaggaagctgactagaccttacccaaggacaaaagggtttagataaaaatttgaggctttaaaaagttggaaaatcccttttctgtaagatagaccaaactttttaaaagtataaaataatttaattattatcattatttttttgagatggagtttcactcttgttgcccaggctagagttcaatgttgtggtctcagctcactgtaacckccacttcctgggttcaagtgattctcctgcctcagcttcccaagtagctgggattacaggcacctgtcaacatgcccggctaattttcatatttttagtagagacggggtttcaccttattggccaggctggtctcaaacccctgacctcaggttatccacccacccccacctcccaaagtgctgggattaaaggcatgagccaccgcacctggcccaatactttaattttttaaaagaaatgattctactatgaagaaatacctctttttcttatttatttatttttattttattttat

SEQ ID NO: 144439 - DNA, 601 bp, Human
atcctcctgtgtatttctaaaaacatctcgtttttctgtacctttcaattcacaacaaacttcatagttaccttacccaccatcaatgtctaaataagtccatcccaatagcctcagagtggggtcgataaactattctaaagccgtatttgtgatcttcttttgccaagtatctagaaccatggcctagcagcgccactgccttgtatttaggttgagatcatgatcatgctgtctgaacatactaccattctatatgtgagaaacaatgaagagttactacctcctacccaaacatccytgaggctgccgctctggtttagattactgtggtgaattacaggtaaatataacacagggcagggcaataacttagaaaagcagaattttacagctaaaaaaaaaaatcacaaggtcagtgacaatttatccccagaaatggaataggaaaacatttctgaagtcatttgggtgaatgaaaggaagggagaaaagtgtcaaaaagcccgctcttcagtctctaagactgccaaatgtatgctagtcagccaagtatctcgactttcatcactggagacatctgcagagaacccttcatgag

SEQ ID NO: 144440 - DNA, 601 bp, Human
agttctcaagtataagaaacttcccaaactctagaaatacagaaaatatgtgaggcaaaattttggtgaaccacatagttaaatgctatcctcctgtgtatttctaaaaacatctcgtttttctgtacctttcaattcacaacaaacttcatagttaccttacccaccatcaatgtctaaataagtccatcccaatagcctcagagtggggtcgataaactattctaaagccgtatttgtgatcttcttttgccaagtatctagaaccatggcctagcagcgccactgccttgtatttagsttgagatcatgatcatgctgtctgaacatactaccattctatatgtgagaaacaatgaagagttactacctcctacccaaacatccctgaggctgccgctctggtttagattactgtggtgaattacaggtaaatataacacagggcagggcaataacttagaaaagcagaattttacagctaaaaaaaaaaatcacaaggtcagtgacaatttatccccagaaatggaataggaaaacatttctgaagtcatttgggtgaatgaaaggaagggagaaaagtgtcaaaaagcccgctctt

SEQ ID NO: 144441 - DNA, 601 bp, Human
catattaaagggtctatgaactgaaaatctaacctggttaaattcttccaagagtctctttattaaatgaaaagaatagattattttgacaggtaagtgaaaatcactcaaacgagtttcttggtctactttactatcagttttaagaatttggcaaatgtatctaataagcatgtggcagcaataagatccactgcagtatatcaagaaagctggtggtttctagttataataggtaggcactataaagcaatctgagtgttatttgacctataagtattacacagtagtaccctttccrtctttgtttttcttcttcacagatatatttggcgtagtggctggggaatctggtcgtggtggtttagtttttcttcctgaaataaaaacagctctgcataaatatttgccttcaaaagtgagagaaaatggacaattcagctattttgtcgtttaccctaaatttcaagtgccaaatgtttttatacatgggtcacatatacaggtctcttaaaatgctgtttactaaaaggaaaacaactttaataaaacttggacattaatgcaggttaaaccataaacacacttatgtaagaaatga

SEQ ID NO: 144442 - DNA, 601 bp, Human
taggacaagtagccttgtcctggagcagtgccagtaaaaactcccaaagataaattgtgtttcctgaaacaaaaacaatttctttctaaatgaccaaaatttcatttaaaagaacctcaaaaaagacaactaaaagtcttagaagtgccatttatatttatacaaaaatattacataattcagttagtattggtgacataatttagttagtatgggtgatataatggtcataatttttagcatctaataaagatctttttatgagtcccatataaaatatgtgaacaaagcaatcttgtcrtaagatttgtgatgatttaggagaaagtactttgagataatttttttctgtctctttgtgaactctctcaacagtagttctctttagattagagccagcaggtcggccataacagttttcttcaaatttgggcaacagttatacaaatgcttgaatttcaagacaacatattaaagggtctatgaactgaaaatctaacctggttaaattcttccaagagtctctttattaaatgaaaagaatagattattttgacaggtaagtgaaaatcactcaaacgagtttcttggtctactttac

SEQ ID NO: 144443 - DNA, 601 bp, Human
taccaactaaatctaaaactaatgctgattgggggactgttgataaactatgtggaatcctctggtctttcacttttcttcctctttctgctaacttatttacttatttatttggagacagagtcttgctctgttgcccaggctggagtgcagtggcatgatcacagctcactgcagccttgaactcctggccttaagcaatctttccacgtcagcctcctcagtagctgggaccacaggcgcatgctaccacacgtggctaatttttgcattttttggcagagactgggttttgccatgytgcccaggctgatctggaactcccaggctgaaacgatccttccttctcaggctcccaaaatgctgggattatagaagcgagccaccacactcagcccccctctgccaacttgccaggataatcaaaactaccaaaagcctcaagaaattgtttctcctccacggctttctagaaatgttcctactaggcaaattttatcagtttaaatttgattcaataaatttaaattggcaaatgtatcagtttaaatttgattcagtaaatttgattgacttttgtgtataaaatttaaccatatgc

SEQ ID NO: 144444 - DNA, 601 bp, Human
ttaaactgatacaccaagcgctgaccttccacttttgccagaatacccctttggtaatagtacctattcaaagcagacaatttcatcaatcaatcaaacatcaattaaaatattcaacaaaatcaaatttccctaatcataaacaaaactttaaagttggaatcaaactaatgagaaaagaatttctaaataaagggctgttattttatatgagataaacatacatttatgcacagatagagataagttcttattaccaactaaatctaaaactaatgctgattgggggactgttgataaactatgtggaatcctctggtctttcacttttcttcctctttctgctaacttatttacttatttatttggagacagagtcttgctctgttgcccaggctggagtgcagtggcatgatcacagctcactgcagccttgaactcctggccttaagcaatctttccacgtcagcctcctcagtagctgggaccacaggcgcatgctaccacacgtggctaatttttgcattttttggcagagactgggttttgccatgttgcccaggctgatctggaactcccaggctgaaacgatccttccttc

SEQ ID NO: 144445 - DNA, 601 bp, Human
cctgtagtcccagctatgaggaaggctgaggtgagaggactgcttgagtcctggaagtaggatgcagtgagctatgatggtgtcattacactccagcctaggcaacaaagctagctagactttgtctcaaaaaaacaaaacaaaacaaaaacctactctataatatctacaatttagtatctttcaaagctagagttttttgttttggttttattctcacagtctaaaaagaatattttgaatacagatgctaaaaaaattccatggaatcagctgtggccactgtaggtctcctatcaayacaaatacaaacaacaaacagcctagaaaccaatgggaggaaccacacactcccaaccagacacccagtcatcacctgtaacccacagggcctagggaaatataaaacattaaggggagaatacggacagtaagagttaaataagcacccactgagcatcccaaatccgaaaatctgaaatctaaaatatgaaactttttgagcaccaataagatgctcaaaggaaatgctcacgggagcattttggatctcagatttttggatttgggatgctgtgccgggtaagtataatgcaacgat

SEQ ID NO: 144446 - DNA, 601 bp, Human
caaaatgctatcaatttgtgaatttaggtggatagtaaataagtgttcatagtactagctgaatttttccatactttgaaattttccatagtaaaaggttgggtaattacaaaaatgcaaacaaaaaatataagaaataacaaaaccagaacttgtcctaataaaaaaccattctaggccagatgcagtggctcacacttataatcccagcacttcaggaggccaaggtggtaggattgcttggttggtcttggttcaagaccaacaaagtaaaaccccatttctacaaaaaattaaaaaattagctggacatgcctgtagtcccagctatgaggaaggctgaggtgagaggactgcttgagtcctggaagtaggatgcagtgagctatgatggtgtcattacactccagcctaggcaacaaagctagctagactttgtctcaaaaaaacaaaacaaaacaaaaacctactctataatatctacaatttagtatctttcaaagctagagttttttgttttggttttattctcacagtctaaaaagaatattttgaatacagatgctaaaaaaattccatggaatcagctgtggccactgta

SEQ ID NO: 144447 - DNA, 601 bp, Human
aaatcaagaaagatatagtcaaagagaaaaaaaggtataaataaatagagaaaacaaataatgcaaaatgctatcaatttgtgaatttaggtggatagtaaataagtgttcatagtactagctgaatttttccatactttgaaattttccatagtaaaaggttgggtaattacaaaaatgcaaacaaaaaatataagaaataacaaaaccagaacttgtcctaataaaaaaccattctaggccagatgcagtggctcacacttataatcccagcacttcaggaggccaaggtggtaggatygcttggttggtcttggttcaagaccaacaaagtaaaaccccatttctacaaaaaattaaaaaattagctggacatgcctgtagtcccagctatgaggaaggctgaggtgagaggactgcttgagtcctggaagtaggatgcagtgagctatgatggtgtcattacactccagcctaggcaacaaagctagctagactttgtctcaaaaaaacaaaacaaaacaaaaacctactctataatatctacaatttagtatctttcaaagctagagttttttgttttggttttattctcacagtc

SEQ ID NO: 144448 - DNA, 601 bp, Human
ctcggcctcccacagtgctgggattacaggcatgagccaccgcgcccagcttctatatgcttttaggataacctacacattatacattttcacaggtttgtttatttatttacttgagacggggtctcactctgtagccccagctggagtgcagtgatgcaatcttggctcactgcaacctctgcccctcctgagttcaagttattctcctgcctcagcctcctgagtagctaggattacaggtgcctgccaccatacccagctaatttttgtatttttagtagagacggggttttgccayattggccaggctggtttcaaactcccgacctcaggtgatccacccgcctcggcctcccaaagtgttggaattacaggtgtgaggcactgcacctggccaggataatttatttaaaagatcctaagaaaaattattaatgcttggataaataaaagttatgctaggtaaaatggtctccaatgtttaccaaggggcaattttcagaaaatagtttaccagcagtttatttctgttgttgtttctttgactaccatgaagccagaatcaaactggcttctttttgtaaatttgtaaaaactg

SEQ ID NO: 144449 - DNA, 601 bp, Human
gggaaggctggtctcgaactcctgacctcgtgattcacccgcctcggcctcccacagtgctgggattacaggcatgagccaccgcgcccagcttctatatgcttttaggataacctacacattatacattttcacaggtttgtttatttatttacttgagacggggtctcactctgtagccccagctggagtgcagtgatgcaatcttggctcactgcaacctctgcccctcctgagttcaagttattctcctgcctcagcctcctgagtagctaggattacaggtgcctgccaccatacycagctaatttttgtatttttagtagagacggggttttgccatattggccaggctggtttcaaactcccgacctcaggtgatccacccgcctcggcctcccaaagtgttggaattacaggtgtgaggcactgcacctggccaggataatttatttaaaagatcctaagaaaaattattaatgcttggataaataaaagttatgctaggtaaaatggtctccaatgtttaccaaggggcaattttcagaaaatagtttaccagcagtttatttctgttgttgtttctttgactaccatgaag

SEQ ID NO: 144450 - DNA, 601 bp, Human
ctgtgctttacagataaggaaacagactcaaaataattaacgtgattcaatttcacatctaataattagcaaggctgaagagctgaaaattttttttgagacagagtctcaccctgtcacttgggctggagtgcagtggcgccatctcagctcactgcaacctctgcctcccaggttcaagcgattcttctgcctcagcctcccaagtagctgggattacaggcgcccgccactacgcctagctaattttttgtatttttagtagagtcgggttttcaccatgttgggaaggctggtctcraactcctgacctcgtgattcacccgcctcggcctcccacagtgctgggattacaggcatgagccaccgcgcccagcttctatatgcttttaggataacctacacattatacattttcacaggtttgtttatttatttacttgagacggggtctcactctgtagccccagctggagtgcagtgatgcaatcttggctcactgcaacctctgcccctcctgagttcaagttattctcctgcctcagcctcctgagtagctaggattacaggtgcctgccaccatacccagctaatttttgta

SEQ ID NO: 144451 - DNA, 601 bp, Human
tagtggaggagaaaaacaaattggcttggtggaaagatgaaacaaagacccagagcaattcaggacacgttcaaaagaagtgggaataaagacacaggatgactagagcccgcccattcacgcaggatacagattaccaaacttagatggccacccaagttctcttgcccatttgattcagggaaatctggggtgagatgggagcctgggtacagtacctgacgctatagccagataccattttttttttttttttgagatggagtctcgctctgttgcccaggctggagtgcagtggtgygatctcagctcactgcaacctccaccttccaggttcaagcaattctctgcctcagcctcccgagtagctgggattataggcacccgccaccatgcccagctaatttttttgtatttttagtaggaacagggtttcaccacgttggccaggctgttcttgaactcctgacatcattggcatcacgtgagccaccgtgcccagcccagataccatttttaaataaaaaaggcctaagggcttcccatgacaagagtttacataacatacacatagataaaatagtacttggcatatagttag

SEQ ID NO: 144452 - DNA, 601 bp, Human
tgaaagttagttatgcagtctgtttctcacatatgagaaataaaatagtggaggagaaaaacaaattggcttggtggaaagatgaaacaaagacccagagcaattcaggacacgttcaaaagaagtgggaataaagacacaggatgactagagcccgcccattcacgcaggatacagattaccaaacttagatggccacccaagttctcttgcccatttgattcagggaaatctggggtgagatgggagcctgggtacagtacctgacgctatagccagataccattttttttttttttttgagatggagtctcgctctgttgcccaggctggagtgcagtggtgtgatctcagctcactgcaacctccaccttccaggttcaagcaattctctgcctcagcctcccgagtagctgggattataggcacccgccaccatgcccagctaatttttttgtatttttagtaggaacagggtttcaccacgttggccaggctgttcttgaactcctgacatcattggcatcacgtgagccaccgtgcccagcccagataccatttttaaataaaaaaggcctaagggcttcccatgacaagagtt

SEQ ID NO: 144453 - DNA, 601 bp, Human
acagctagactagtctccataaaccaagcgttaaatattaccactagattattaaagctacattttgaaagttagttatgcagtctgtttctcacatatgagaaataaaatagtggaggagaaaaacaaattggcttggtggaaagatgaaacaaagacccagagcaattcaggacacgttcaaaagaagtgggaataaagacacaggatgactagagcccgcccattcacgcaggatacagattaccaaacttagatggccacccaagttctcttgcccatttgattcagggaaatctgsggtgagatgggagcctgggtacagtacctgacgctatagccagataccattttttttttttttttgagatggagtctcgctctgttgcccaggctggagtgcagtggtgtgatctcagctcactgcaacctccaccttccaggttcaagcaattctctgcctcagcctcccgagtagctgggattataggcacccgccaccatgcccagctaatttttttgtatttttagtaggaacagggtttcaccacgttggccaggctgttcttgaactcctgacatcattggcatcacgtgagcc

SEQ ID NO: 144454 - DNA, 601 bp, Human
tttcaaaatgctgcttcccatattttcaacagagcatgaccaatatcatgccagactttgtattaaacactacatacagagatgcctaacacaaaactctcaggccattaactatgataccatctgctgagtgctatggaagaaaggtctgtacatagggccacattaacacaaatgaggagctaattttgttggggaaggaggaggatgttaaaatgcttagcaagaagtttgcatgagcttcttaaaattaggaatttaaaagcaaatctgtttgattcattcctgctttttttttttttttttttttttttagatggagtttcactcttgttgctcaggctggagtacagtggcgtgatcttggctcactgtagcttctgcctcctgggttcaagccattctcctgtcagcctcccgagtagctgggattatagtcacgtgccaccacgcccggctaatttttgtagttttaattgagatggggttttctatgttggtcaggctggtctcaaagtcctgacctcaggtgatccacccgcctcggcctcccaaagtgctgggattataggcatgagccactgtgcccggcctgctattt

SEQ ID NO: 144455 - DNA, 601 bp, Human
atctacccctagaaattctgattttgcaagtctggaatgagggcccaggaatatgcattttaaccagctcccccatgggattctaatgcagctgatccaagggctgcagtttaagaaataacttacagttaatgatttggataatttaagcctccatcgcatcttgtatctcttttcctcattccctaaacacgtagataacaggtagactctcaatagggtttggtttacctatattcactcttgtctgtcctgaaggaaaaaaaatgtgagtagggatatggggcaggtatttttttttccatccttttcatcttgttttgtcattagctgagaagtagaatctaaaagcaggctctcatattgtgtttctgagccttcttcaggaccagactccatctctctcgttgctattcccataaacccaactgttcttatctttttttttttttcattttcatctgtctatcacactcagtccacctgtatcaaagcccacaaggctgcaaggtcagctgtaaatgatcttgaaatagtacacaaaaatatcacctgaaatgaccagtacttcaaaacccactgctaatgctcagatataaac

SEQ ID NO: 144456 - DNA, 601 bp, Human
gacagaaagcaggacaatgcgaaacttgtgctagagattgttactgaactccgtgtcctcgactcttgtagaaatttctgtggcacatggagcaagatttaaatggaaggaaatgatgtaaaggaggaagagaatacccctgcctcgatatattcatattgaagttcctcctttcagacctctgtgtgctggccccttctccaaaattcactttgaattataactcaaggccactggctggaatggaattaattcttagcctccagccacccctggaggctgtgggagcttgggaaaacaygcctttatgtgatcctgatcccctgctacttagaatgtgcggtaccactatcttcaatttttttgtaggaacaagcaacaaaatgaataacccttcaaagtgggaaaacagccaggagagaagggaacagagccccagtgagagacacagttatgcctcggtcattgtgctctgtagactgagaatcaccactttgtagctgtgtgaccttagaaagcaacatcatttcttggagcctcagtttccttttttgtagaaggatacaatttctatttgattgagttattgtgaaaattagag

SEQ ID NO: 144457 - DNA, 601 bp, Human
gggaacagagccccagtgagagacacagttatgcctcggtcattgtgctctgtagactgagaatcaccactttgtagctgtgtgaccttagaaagcaacatcatttcttggagcctcagtttccttttttgtagaaggatacaatttctatttgattgagttattgtgaaaattagagataatacgtataaagggtcaactgattagcaatgagtcttctatttgtggaagcaattgtgatcattgttgtatgtgtcaacttttattacttatttcaatccctgtcttctgaaatatcttygtaaggtaactaggtactgtatataacccttcctctggagagaaatgtcaggagattttgcccagtagttactggattggggtattttgaccaacacttgtaatcaactgacaagtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgat

SEQ ID NO: 144458 - DNA, 601 bp, Human
tggagcctcagtttccttttttgtagaaggatacaatttctatttgattgagttattgtgaaaattagagataatacgtataaagggtcaactgattagcaatgagtcttctatttgtggaagcaattgtgatcattgttgtatgtgtcaacttttattacttatttcaatccctgtcttctgaaatatcttcgtaaggtaactaggtactgtatataacccttcctctggagagaaatgtcaggagattttgcccagtagttactggattggggtattttgaccaacacttgtaatcaastgacaagtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgatcagtgactctcagaaggcttggaatgcccaatcagagttgcaatgcatagcaaagaactcctgagtttcaggggatgtcattttgtaaggttctggtggaaagacact

SEQ ID NO: 144459 - DNA, 601 bp, Human
ggagtgcagtggcgcgatctcagctcactgcaagctccgcctcccgggttcacgccattctcctgtctcagcctcccgtgtagcgccaccacgcccggctaatttttgtatttttagtagagacggggtttcaccgttttagccgggatggtctcgatcgcctgacctcgtgatccgcccgcctcggcctcccaaagtgctggaattacaggcgtgagccaccgcgcccggccttgggtaaatcttgtgtcttacgctttataggatgcttagcagcatcgcggcccctacctcctagttrcaagtaggacccccagtgccccagatgtgacaagtaaaaatgtcttcagtcactaccaaatgtcccctgggcataatacagtcactcccggtggagaaccactggtctagaacttcaatttggacagcaaaatctggacttactttaggaccctgtcacacgcatggataaactacctgcaatgctttatggcaaaacttttaagaaggtcaggggacattgggttgccaagaagaaatagaatattaataagagcataattatacactttagttaataaaactaagccatcaggctaat

SEQ ID NO: 144460 - DNA, 601 bp, Human
tttatttatttatttacttatttgtttatttatttttgagatggagtctagctccatcacccaggctggagtgcagtgacacaatcttggctcgctgcaacctccacctccggggtccaagctattttcctgcttcagcctctctagtagctgggattacaggcattcaccaccatgcccggctaatttttgtatttttagtagagacggggtttcaccatgttggccaggctggtctcaaactcttgacctcaagtgatccgcaccccctcggcctcccaaagtgctgggattacaggcrtgagccaccacaacctggcccatttttgtgaattctcatactatttaccatgactgccccaacccctttcttatcttgagcaccccatccctattcctctaactgtctgatcaaagaatgaatcaaatatctgaagaaatccagttttctttcaagaaacaatccagggattcattaaaacctgttgtggctattgtgggatcaccaagctttctgggctgacatcttaatgaagggaagagtagtggttcttggaggccagagctaactgcaggggctcctcggtcatccaaggtgcag

SEQ ID NO: 144461 - DNA, 601 bp, Human
catattccgctgagaattaagaaggctgtctttctagttctgagcacggagactgggttatgatgaaggctggttacagagtaaagtgaaaacccttccatgtggttgtgtgtgggaaaaggatggcataagtgggtggcacaaaaggagcgggggtgggggagaacccattgtacctttgcaatatggagtttgtattctgtttctgccgaccttccttgtgagaaggtttgggtatggaaggaaaacgctggcctgggaatctgagtaatgatggagggaagttctgtgcaggtgattytgggtttatggaaggtcagaggattctcttacttttcccaatattatgaggtgaagcttcgcttaagggcgtgcagttcgtgtatctttccagtccagcagactgataatgtctgcaggttgggagcgccatgactgatagtagctgtgcccggtgtctcaagcatcttggaagtgctgttcattcatcaggggctaggagatcctgaaggggagggagtctgcatggttctggagacaggtagacatttttctgtttcttgtagagtttatcttctccacggatccctgtagaggacag

SEQ ID NO: 144462 - DNA, 601 bp, Human
atgatgaaggctggttacagagtaaagtgaaaacccttccatgtggttgtgtgtgggaaaaggatggcataagtgggtggcacaaaaggagcgggggtgggggagaacccattgtacctttgcaatatggagtttgtattctgtttctgccgaccttccttgtgagaaggtttgggtatggaaggaaaacgctggcctgggaatctgagtaatgatggagggaagttctgtgcaggtgattctgggtttatggaaggtcagaggattctcttacttttcccaatattatgaggtgaagctycgcttaagggcgtgcagttcgtgtatctttccagtccagcagactgataatgtctgcaggttgggagcgccatgactgatagtagctgtgcccggtgtctcaagcatcttggaagtgctgttcattcatcaggggctaggagatcctgaaggggagggagtctgcatggttctggagacaggtagacatttttctgtttcttgtagagtttatcttctccacggatccctgtagaggacaggcttgctgacattcacaggatagtagtcccaagcctgtggcaaaaggtatttttgggta

SEQ ID NO: 144463 - DNA, 601 bp, Human
catgcattttttttctttcccatcatgtccaacacttacagcctgacctttctcttccttctgggttgggacgaatcggttccctgatgttaaccccgcagcatggcttctgggttaccaactcctgttttgccaatgtggaaacagccactgtctgggtgcccagtcccccagctctcgtgtgagccctggcaaccctggctgcctgcctgcatgaccgtgtgctccaggcacgtggctgtgccctgtggagcttgcccaacgctgtgtggtgtgctggcttgcttttttttttttttttccctcctccccctcgcttcccttcccaggagaatgacagcaagtgccagcaagcaattgtaatcctgaccctggcatgagaaagctgagctctggagggcagttcagatgccagggaaacctgttctgtccaacattctagccagaccccaaacctggccctctctcctgcctgtctgcccagaggccctgtcttctctgcactgctgcggtgggcaggattcctggaggccagctcctgccaagggtcttggcagagtctttccagttcagcactgtgcctaccagactagaaaaatag

SEQ ID NO: 144464 - DNA, 601 bp, Human
gcccagaggccctgtcttctctgcactgctgcggtgggcaggattcctggaggccagctcctgccaagggtcttggcagagtctttccagttcagcactgtgcctaccagactagaaaaatagcaatataaagacagaattaggtggaggagaaggaaagggggtgggggaggtgggaagaaaaaaacccttgataacatcctaatgtagaaagccagaggaggggaagacagccgtgatttattaggtttctcagaaacctctcttccaattagcactaatcacttttacccaggaatcrttttttatgtctcagcaatgaaaatggaggtaagagggaaggtagtagagaaagtaataagatgaaaaaaagtagaaaataacatattagagaggtacagggcctgtgtttgattctgtaatgggtgtgggtgagaatattggtcacagctaatattgattatagtatttggccctcccccagcaaatgtcttgtcctaaagctactaaaccactgtttttctataaatttaaatttccctcagacttaggtgcctctgtctcaccatgcacaatgtctgtcagaatgtcctgtgtttga

SEQ ID NO: 144465 - DNA, 601 bp, Human
acagggtgttttaggcaacagggtgtagatccaatttggctggtgcagaaaattcatatgaaggagtcagggagatgagtcagagaggttggtgccagtcaggctgacaacttcatgagtaccaggctgcagagcttgaactttatccagtaggcaatagggagccattgaaggtttttcagcaggaaagtgcatgtgaacatttccacttgagttcaaggttggatttgaaacatttttagaaacttgacaatagtttcctctggcaagccaggatttccttatttttattattttgaarataaatactctcccttgaacatcaaacagcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaat

SEQ ID NO: 144466 - DNA, 601 bp, Human
tcaaacagcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaataagtatattgaaccagatgttrtgtgtgtgtgtgtgtgtgtgtgtgtgtgtgtgtgtgtgtgcgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaataagttttactcctgggaaacaaaggagtcattattacagttttgcattcttgagtcctgaccttgtatttgtggctcccttcttccctgaaaacagaact

SEQ ID NO: 144467 - DNA, 601 bp, Human
agcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaataagtatattgaaccagatgttgtgtgtrtgtgtgtgtgtgtgtgtgtgtgtgtgtgtgtgtgcgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaataagttttactcctgggaaacaaaggagtcattattacagttttgcattcttgagtcctgaccttgtatttgtggctcccttcttccctgaaaacagaactgtacat

SEQ ID NO: 144468 - DNA, 601 bp, Human
gattttaataaacccaactcattaacgttcatcacttttaaatgcctctattttatacagcttactaggtttgcaaataagtatattgaaccagatgttgtgtgtgtgtgtgtgtgtgtgtgtgtgtgtgtgtgtgtgtgcgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaatmagttttactcctgggaaacaaaggagtcattattacagttttgcattcttgagtcctgaccttgtatttgtggctcccttcttccctgaaaacagaactgtacatcatgcttagatatgggatgtgtgtgtgtgtgtttcatattgggagtactagtaaaggaaagggacattgtgggaggggatcggattggggggggttggactgctgaatgtcaagtgcatgaaatgacttgctcaagcaccccctgaagtgtgctctgatatcaagccaagatttcagaaggctgaaagagttgcc

SEQ ID NO: 144469 - DNA, 601 bp, Human
catttacctgccaccagagaggatgtcatcggccaacccgcaaaggtggtgggatctaccagccatataactcttctgcatttgttccctccattgtaagtgagggtgctgatacctgcttcagaggattcctggagaagtaaatgagatgatacatgtacagcacttagaacagtgctcagtatataaatggcagctttcagcagttttatttttattctacaattactattccttctcttcttccacctccatggctattttatggacacttaagtaggaacacatcttgtgttacagyaatgctatagcagtgatggcctggaaactgcttttgagttattgcagggaagaaaggatcaggaagagatacagcaggtgagcaccctgtgtttttacacctgtgagaagatacatcccacctcaaacaccatttgtggtcctatcaccctagcatgtcacagtgtaattgcctgctttcttggatagctctttgaatagatgtatgctctgtgagccctggctgtgtcttccatctccatatgccctgctgtgcctgcatatgtcttctggtgctatgcctggaagatcttgagtgggt

SEQ ID NO: 144470 - DNA, 601 bp, Human
gttgtgcactgtacatgtggatgtggcagggtaaggcttttaaaggtacagcagtcttgagggattacaaagtacatcagcatgaaactaggcaagattttagcctcttgtgagggatgttgaatttcagctaaagctccctcagcatatttttgtatcccatcaaatatctctgagtcgcggccaggcgcagtggctcatgcctgtaatcccagcattttgggaggctgaggagggtggatcacttgaggtcaggagctcgagaccagcctgaccaacatggtgaaaccccgtctctacraaaaatacaaaattagccaggcgtggtagcaggtccctgtaatcccagatactcaggaggctgaggcaggagaatcgcttaaacccgggaggcggagattgcagtgagccaagatcgtgccattgcgctccagcctgggcaacaagagcaaaactccatctcaaacaaaacaaacaaaacaaaaaatatctctgagtctgtctccccttttataaaagagtgaacacaatgctcctaagtttaaatcagataaattcagtatgaaatcatagcaatagccattatgtgttaaaaccagca

SEQ ID NO: 144471 - DNA, 601 bp, Human
ttcggagtccgaatctggtatttaaaggccacgttctaaaatgcacttgtagttaatatctttggagtcttgcttccaggtttttgagttgctggactgggtctttgtaagctccgtgatgctgctttgggaacacaagagatctaatctgtagtcctggctatgctattaattgcaagtataaccttaggtgttcagcttctctggcttttacttcttcatctgtaaaatgggaataatctacgtccttctaacttacaagtatgtcataatagaaaactgaccaaacagtttacatcartgtccattattatttccattggcttttaggcggcaagagatggaaaacacatagcaacaatttcaaaggtaggccagttccaaagagcactgaacttggagtcagccaatctaggttctaaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatt

SEQ ID NO: 144472 - DNA, 601 bp, Human
gttaatatctttggagtcttgcttccaggtttttgagttgctggactgggtctttgtaagctccgtgatgctgctttgggaacacaagagatctaatctgtagtcctggctatgctattaattgcaagtataaccttaggtgttcagcttctctggcttttacttcttcatctgtaaaatgggaataatctacgtccttctaacttacaagtatgtcataatagaaaactgaccaaacagtttacatcaatgtccattattatttccattggcttttaggcggcaagagatggaaaacacrtagcaacaatttcaaaggtaggccagttccaaagagcactgaacttggagtcagccaatctaggttctaaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatttaaagcctcttgggggtaatggagctgctcccaagccaagtagtagatgga

SEQ ID NO: 144473 - DNA, 601 bp, Human
aaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatttaaagcctcttgggggtaatggagctgctcccaagccaagtagtagatggattaagaatctgacattcttccactcataaaggatgacagagtttaaaaactaacgctgaaaagcaaaaracatttgacaccttttggaataaaaaaatcaacaataatcaagctagttacttccttaaaaaatggtcttcatgccgaatggaaaccaccagattctctctggtgttcagcattccagaacaaccctgaaaataaattatctggctggaatcattgctccaacggttggatttcttagtggtcgtttactagccagacaaaataatttttttataaagaaaagaaaaaaaaaaggaaagcccacagaaggaaacaccccagggcccactgctggctcttttgatggcaacttttctagga

SEQ ID NO: 144474 - DNA, 601 bp, Human
accctgaaaataaattatctggctggaatcattgctccaacggttggatttcttagtggtcgtttactagccagacaaaataatttttttataaagaaaagaaaaaaaaaaggaaagcccacagaaggaaacaccccagggcccactgctggctcttttgatggcaacttttctaggaggacagtggccagagggggcctttggctgctcctctaggtggctggagtcaggtttgtaggacctgcctgtgatagtaggtttcatcttgcaactggctctgatggattagtaggtgcctgaraagtcattttgaaagggtctgaggctcggtctgggctcagtgaagagttctgtgattaattagtgatgtctgcccttggcttgggtggggcagtactggtgcctggtgtttgctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggtatggaagaaagg

SEQ ID NO: 144475 - DNA, 601 bp, Human
gaaagcccacagaaggaaacaccccagggcccactgctggctcttttgatggcaacttttctaggaggacagtggccagagggggcctttggctgctcctctaggtggctggagtcaggtttgtaggacctgcctgtgatagtaggtttcatcttgcaactggctctgatggattagtaggtgcctgagaagtcattttgaaagggtctgaggctcggtctgggctcagtgaagagttctgtgattaattagtgatgtctgcccttggcttgggtggggcagtactggtgcctggtgtttkctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggtatggaagaaaggaagtctattgattcagctccttggtcacgagacaggaattgcaaggtggagggaagctgtaattccaacacgtaagtccatggatactccagtaaagcacaggcataggtgc

SEQ ID NO: 144476 - DNA, 601 bp, Human
gtaggtgcctgagaagtcattttgaaagggtctgaggctcggtctgggctcagtgaagagttctgtgattaattagtgatgtctgcccttggcttgggtggggcagtactggtgcctggtgtttgctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggwatggaagaaaggaagtctattgattcagctccttggtcacgagacaggaattgcaaggtggagggaagctgtaattccaacacgtaagtccatggatactccagtaaagcacaggcataggtgccactgatccagcagaggcagccacaaaccacaggccctggtaagctgcctgtggccagaggtcatggctgcagattccagggaaactgcgtcctcggtaggcagtcagccgtacactccatacttgcgattcttgatatttgaaatcaaaatcaaagtgcagccactttctttaag

SEQ ID NO: 144477 - DNA, 601 bp, Human
aaggaagtctattgattcagctccttggtcacgagacaggaattgcaaggtggagggaagctgtaattccaacacgtaagtccatggatactccagtaaagcacaggcataggtgccactgatccagcagaggcagccacaaaccacaggccctggtaagctgcctgtggccagaggtcatggctgcagattccagggaaactgcgtcctcggtaggcagtcagccgtacactccatacttgcgattcttgatatttgaaatcaaaatcaaagtgcagccactttctttaaggaagctttrgagaacttgccagtctgtttaggattgaaggtgattctcagttatccatgctaaaggaacagataatctgaagtttatttctcctcagctgtggaacgtgctttgcgtttttgtgctgttgatctgctttcctggtaaggtttgaactcttcagatttttctttctataaagaacggttgagggggagtgtagtgctttttgcagctcccccagtatgtttctaacatagccagccaaatgtctctgagcccttccagcctcctaactttaaatccatgaactgcaccagggaaataatc

SEQ ID NO: 144478 - DNA, 601 bp, Human
gactgcaggggagggggaccaagggatgacttcttccaggaccttctactctctccaaccagaggtgccctctagccctgtaaacttctgcattctccagcacagttcctgagaggttcagaagttacctgggtcctggtgctctgctcctgctacctttcagctcctgcccccaacaccctgttcaaattgggaacaagttgaccacagggcacagtgaatttgaaagtccggagattaagtcatatgttgaaagagggcccagtgagcaggggccactaatcccctttcttcctcaacmtaggaacctcctcccttcccaagatatagatatatatagattgagaccctgagcaatggatctcttttgaggccagtggagaccaagaccactgaagcaaggagtcagggactgcccacaacagcaaagctccccagagtccaggccaccccatggtgattgtttgggttccctgtgattgcctcccatggctgccctcgttcatagagagttgactgcatttgcctgggtccctgtggggtgagagtatggaagtatgtgtattagtcacaccttacaccagaccagaagatatacagt

SEQ ID NO: 144479 - DNA, 601 bp, Human
aaatagacccctctcataacaaacggttgaaaataaactctttttccccatcacaccaagccataaattccataaggatttcccagcgccaagccttattcagagtcttatatttactgctttggaatgttacttttgccatcagtatcatccagccaagcaacaaccaatcaagacttacagaaacttttccagctagatgcatgtgccaggctgcttcttccttccatgatggaaggcctcccttgtcatagaggatgcccaaaatctcagggactgggatacagcctcctgccagtcygtgggtacagtctttgcttactctgcagaagggaggtgacagaaacccattccacctgtctcagaaacctgctggtaattaactttaaaaataatgccaagttctcacgtggctggtagatgcattagctcaatcaggggggaggcaggggagaagcatgctgcttcaaagagtaatactgttgcaatcacattagtcattccaggggaggttagataaggttattgaaaaggtgaagtcaccctgtacattgaaagaggtcttctgaaagtgttgagaaatagttgaagttcagaagtt

SEQ ID NO: 144480 - DNA, 601 bp, Human
tcacattagtcattccaggggaggttagataaggttattgaaaaggtgaagtcaccctgtacattgaaagaggtcttctgaaagtgttgagaaatagttgaagttcagaagttttatttggagctttgctcccccttccccttgtaaataagaccagtattttttaaaagccacattttctttgtttgatcgatgaacactctcatagttgatgattgagagtcatctacagccagtatcaagggtcagttctgcattactcatgtgtagattatctctttggtatactagccatggtcamtgtgtaagccctggccagttgccacccagcataacaacaccataaggcatctaccccctgcctgcacttgggaagtgttcagggaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaagg

SEQ ID NO: 144481 - DNA, 601 bp, Human
gaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaaggtttgttgaagtccatcttccaaactcccaaagtactctggataccttggtaggtccttgtggactccctgttgttgacttgcargtttcccagaggtggggactggcttttatctccagcacctaggcagctgctttgtaccagagttgatatacaggaaacatttgttgagtgaatgaagtaacaaagatactaatttcattagaaatggtttgaaatgagtgcttgtgttggcagaattttgtccaacatggttggtctttgcaaagggttatgatagtatgatgcacgcctttgggccagatgtgagtcaggatggtcttggaggaggcgaagtgcagatatacccctgctgataggctcctcataatacttcagtgagct

SEQ ID NO: 144482 - DNA, 601 bp, Human
tagtgcataaaattattcctatgacaaggcatttgaaaaattactttgagaatgacttaaaatacagaacaatttttttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctarcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctgaaaaagaaaaccagacaaataagcacaaccaacattaacagaaggccttggtacagcctcaagaattaaag

SEQ ID NO: 144483 - DNA, 601 bp, Human
ttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctagcactttgcattcattgtattaataaataagcctgttttcagcctagttagaaaaaaaaaggccagcctcattcattrgaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctgaaaaagaaaaccagacaaataagcacaaccaacattaacagaaggccttggtacagcctcaagaattaaagtgctgtactctatggaaaacagtgtggaggttcctcagaaaactagaaatagatctaccatatgacccagcagtgcc

SEQ ID NO: 144484 - DNA, 601 bp, Human
catttagttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctgaaaawgaaaaccagacaaataagcacaaccaacattaacagaaggccttggtacagcctcaagaattaaagtgctgtactctatggaaaacagtgtggaggttcctcagaaaactagaaatagatctaccatatgacccagcagtgccactgctgggtgtacagctgtacttcgttttatcggacttcaccatattacactttgccgatagtgtgtttattaaaaattgaaggtttgtggtaaccctgcattgcacaagccttttggcactatttttccaacagtatgtgttcacttggtgtctc

SEQ ID NO: 144485 - DNA, 601 bp, Human
gttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctgaaaaagaaaaycagacaaataagcacaaccaacattaacagaaggccttggtacagcctcaagaattaaagtgctgtactctatggaaaacagtgtggaggttcctcagaaaactagaaatagatctaccatatgacccagcagtgccactgctgggtgtacagctgtacttcgttttatcggacttcaccatattacactttgccgatagtgtgtttattaaaaattgaaggtttgtggtaaccctgcattgcacaagccttttggcactatttttccaacagtatgtgttcacttggtgtctctgtcat

SEQ ID NO: 144486 - DNA, 601 bp, Human
gtgaacattgttgaaatgccagcaaaggatttagaatattacataaacttagttggtatagcagtggcagggtttgagaggatcgactccaattttgaaagaggttctactgtgagtaaaatgctatcaaataacaccgcgtgctacagaaaaatgtttcctgaaaggaagagtcaattgatgcagcaaacttcattgtcgtgttattttaagaaactgccacaaccaccccaaccttcagcaaacaccaccctgatcgattagtagccaccaacattaaggcaagacccatcataagtaraaatggcccactaaaggctcaggtgatctttaccattgtttagcaatatagtattcttaaggcatgtacattgtttttagtcataatggtattacacacttaatagattacagtatagcataaacataaattttatatgcactgggaaaccaaaaaaaaaatgatgtgacttgctttattggattcttagctttattgcagtggtctagaaccggtcctgcaatatctgtgaggtatgcctttatatccaaaggaatagaaatcagtctttcaaagagataccggcattccatgtttatt

SEQ ID NO: 144487 - DNA, 601 bp, Human
ctttcaggtcaacatttcccagggttatattagaatgtattgactaactggtagatttttatggggaaaaaatgcatatggcatctgtgtgtctaaaatgcccttgatagaagcagtagtgtagaatgctttggggcataaatagtccttagagtagcaaaaagacaggttaatgcaaaattggttggacaggttttggttggaggcctgagtgattgcctccggagcaccaccttctggggagtcatgggtatgacatggtgtgaatattcctgaggtgtgggtggttggtttccttacwaggtagggtttgcaagctccttacatccacaggggctgtttcctctggaccagtcgttctcaatcttggcctcacatgagaattaccagtgatttttttaaaagaaatttaaacattttattacaaaattaatatacgattgttgtaaaataggactgtataaagagtaacttgagttcccatattccatttccagatttaactgtccacagtttctgcgtactcttccagacgttccctttgtgtttataagcatttatatacatatatatgggggtgggtgtgtatatattgtgtgta

SEQ ID NO: 144488 - DNA, 601 bp, Human
tagattgaaagaaaatggacatctcttcttcagaaaacctgttctaagaattatccatcttaggaaattagggtggttattgctcttctttactgcctgcctgaaaaaaatttcccagccctcatttctttcatcctttcctttgaggccatgacttgtcaccctctgctgtgttcctctgtcccctgagcagctgtaaggggtgagagtcacctaccctcaccccttacactcccaccaacctgaggaccacgtgtcttcatctaacagcatttctttttttttttttttttttttttttgagatggagtctcgctctgtcacccaaccaagctggagtgcaatggcgcgacctcagctcactgcaacctctgcctcccgggttcaagcagttctcctgtctcaacctcccaagtagttaagattacaggtgcccaccaccatgcccagctaatctttgtatttttagtagagacggagtttcgccatgttggttgggctggtctcgaactcctgacctcaggttatgtgcctgcctcggcctcccagagtgctgggattacaggtatgagccaccgcgcccagccagcatttctttctt

SEQ ID NO: 144489 - DNA, 601 bp, Human
tgcctgggaagtgggtggttaaagtttaaagcctggaagaatgggggaaatagttcacaggcatgaggtgacctgcaggagaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgygggaaagaatctgtggatctctttgagaagctgcagaacagcagatacacctgaatcctattcatgttcatccagaaacgcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaata

SEQ ID NO: 144490 - DNA, 601 bp, Human
agaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaaygcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaact

SEQ ID NO: 144491 - DNA, 601 bp, Human
acatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaacgcagactttaaaacaaccttgttattcttcctttgttttgtttcrtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaactcagacaattaaaaagactccagggacctaggtggtgctgattcaa

SEQ ID NO: 144492 - DNA, 601 bp, Human
atgtgaaacgtgtggcggaagttctggctgtgacgtcagtaagctcgttctgcacagactccagttggccatattggtcccaaacaattttagccagccttatctttccagtagagggagttttagtgtttccacaagcttttatttaattttttttttcttatctgccatcctgtaagctcaagaatttctgttagtcactggtttaagtctttggggcatggtttcaatatgagtgtgggaaaggggaagccattgcctcttgtttcccattcgtgaccatccctacccacttcagtgsgcccagtgttgccagacctgaaatatacctcatgtgggtgtttgtctctggtactctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattag

SEQ ID NO: 144493 - DNA, 601 bp, Human
agactccagttggccatattggtcccaaacaattttagccagccttatctttccagtagagggagttttagtgtttccacaagcttttatttaattttttttttcttatctgccatcctgtaagctcaagaatttctgttagtcactggtttaagtctttggggcatggtttcaatatgagtgtgggaaaggggaagccattgcctcttgtttcccattcgtgaccatccctacccacttcagtgggcccagtgttgccagacctgaaatatacctcatgtgggtgtttgtctctggtacyctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaacaggctgtggttatga

SEQ ID NO: 144494 - DNA, 601 bp, Human
ccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaacaggctgtggttatgagttccgctggtctcacctttcagtgggttcaagggggcagattttgctgacaccataggcaaggaagcatgatgrtaaacaccactggaatgagaggccttgttaatccagcccaagctcctgccaagttagaagctgaggagtctagtctgggccactttgagtactgatgcatgatcccagggcgatgtgctgttctgggcacagggtcacactgggtgacatctaacaggctttgcttgggctgtagctagagggaaatgggagctggggagtgtgacaggagggaagtgtggactctccacctaccaaggggccttcccacatactgtccatcccattcagcgccctgaggtgggcgtcatttctcccact

SEQ ID NO: 144495 - DNA, 601 bp, Human
tcctagtgagccgtggtctctggcctatccagaagctccttaaaaatactagtgcatgagatgtagcattgacaggagccctggcctgtgggtcaacagttgctttgtcaaatgcaatcttgcccttggcacagctcgccattcaggaggatggaggaagtggacgagagagagggaggtaaaagaagggagggaaaggaagcaggatgcctggctgcctggagcttccttgggctcttgtccatgagaggaagccatacctacctctctggggtttgccaactcttgtccaggaacctaytgggctagagtggaggggaactgcagagtctccccttcctttctcttctgcccccatgaggaggaagtgaagtggagcagaaagagcgtgggctatggttgagcccactggagtctgcactccacccagcctccccctggctttctagctgtatgactttaagcaggtggtttcaccccctctccctctccactttttcctctttaaaatgtgggatacagtgcccgcctcgcagaggctgatggttctgtggagtgttgtgcacaaggctccagcccaggtcctgatgcaggactctca

SEQ ID NO: 144496 - DNA, 601 bp, Human
cattttgggaggccaaggtgggagcattgtttgagcccaggagttcaaggtttcagtgaactatgatcacgccactacactgcagcctggagacagagcaagatcctgtttaaaaaaaaaattgctgatattgattattcagtaggccagggaagcccgtctaccagcctacaggacgtcattgcattcaccttctcagtaaatggcaacagactcttttcctaatgtttacacgtaatggattgaactggcttagcatcatgctttacccatatttctgttgacagcctgttactgtgtrgagagaattgctggataagagccactgagatcaaagggatctttacaatgggcctttcagtatatttgttctgtaatcatggactgaaaacttactgagcacttgccatctgaatgaggcaaaaaggaagtgtgtgtgtgtgtgtgtgtgtgtgtgtgtgtgtgtgtatgcatgtgtatgtgtatgcatgatttgtttttgccttaaaattagtacatcaaccgtgtaatgtgcaggacatttaaaatatgtcagagctatgacaggttcccagctactgggatccaggacaccttccaa

SEQ ID NO: 144497 - DNA, 601 bp, Human
aaaaaaaaacatcaaacagagttgtttgatgggtattgagcaggggtagaggaaagtcagagggttcgaggaattggcatttatgctaatgtctacataacgtaggaggactaggtaggcagagagcagaggaagaatgctttaggtagagaggaaactaaatacaaaggcctgggtgggatcacattcaggggacgcaaggagcagaaggaaggccagtgtggccaagtgtgtgagtgaggtagagccgtggatctgatcatatgtggcaatgggaagccttgggagggtttgatatggrgatgtgacccacacgggtctgcatgtttagaattatcacagtgtaccgctgtggagacgtgggagatagaaaagggataatggttaaaagttgcagtagttcagaggacagacagtgctggcttagacaaggggaatagtctgtttatttgatttactttcaagtatctctgaactattatctgtattttgtatatgtgtttatatagagaccatttattgcacactttccgggtactacagattgtgctaagcactttgtatgtattatctagttcatttttcacatagaatcaggcat

SEQ ID NO: 144498 - DNA, 601 bp, Human
gggtctgcatgtttagaattatcacagtgtaccgctgtggagacgtgggagatagaaaagggataatggttaaaagttgcagtagttcagaggacagacagtgctggcttagacaaggggaatagtctgtttatttgatttactttcaagtatctctgaactattatctgtattttgtatatgtgtttatatagagaccatttattgcacactttccgggtactacagattgtgctaagcactttgtatgtattatctagttcatttttcacatagaatcaggcatagtaatctccttttrcacataagggaattgaaactcaggtaggttaagaaaagaagggggaaaaagtcaacgatagtccctttccccaatacagaccttattaggatttagaggggcattttttgggggtcatttatttacaaaggcccaagtttataacatacaggtgacagaatcagcattcagacccaggtctgactcacttcacagcgtaaaacgactgtcctgtacaaatttaaatcctgctataatgttattgtgggtgtaaacactctccccctatgcaataactcagcttataggtcagtctccatt

SEQ ID NO: 144499 - DNA, 601 bp, Human
cataagggaattgaaactcaggtaggttaagaaaagaagggggaaaaagtcaacgatagtccctttccccaatacagaccttattaggatttagaggggcattttttgggggtcatttatttacaaaggcccaagtttataacatacaggtgacagaatcagcattcagacccaggtctgactcacttcacagcgtaaaacgactgtcctgtacaaatttaaatcctgctataatgttattgtgggtgtaaacactctccccctatgcaataactcagcttataggtcagtctccattgcmatgagaatgtttaccagacaatcacagaaactcaccgtacacaaataaaggcttattgttcactcatctgtaattgctatgggttgctcaggtggctctgctgatcttggccggactcacatatctagagttcaggtgatttaagctgacctaggctggcctcttctttcattttccagcaggctagactgggcatgtttatggtaatgacagaagtgctacagaaaaggggcagaaacatgcaaagcctctttaggcccagcctcagaactaacactatcatttctgccacattctgtt

SEQ ID NO: 144500 - DNA, 601 bp, Human
ctcaggtggctctgctgatcttggccggactcacatatctagagttcaggtgatttaagctgacctaggctggcctcttctttcattttccagcaggctagactgggcatgtttatggtaatgacagaagtgctacagaaaaggggcagaaacatgcaaagcctctttaggcccagcctcagaactaacactatcatttctgccacattctgttggccagtgcaagtcagagaccagcccagatgcaagaggtagggaaataggctctgcctggaagtgcaggtcccatggaataggacaygaatgggttaggaatgagcctttggccatcaggacgttagtgttaagcttttgcagaaaggacttgttggacaaataacagattcctgctgcgggaatggagaccagctaatatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatc

SEQ ID NO: 144501 - DNA, 601 bp, Human
gtttatggtaatgacagaagtgctacagaaaaggggcagaaacatgcaaagcctctttaggcccagcctcagaactaacactatcatttctgccacattctgttggccagtgcaagtcagagaccagcccagatgcaagaggtagggaaataggctctgcctggaagtgcaggtcccatggaataggacatgaatgggttaggaatgagcctttggccatcaggacgttagtgttaagcttttgcagaaaggacttgttggacaaataacagattcctgctgcgggaatggagaccagctratatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatccctgatgatggtatcatcatcaagggatgccaagagggtaaaagcactatttcagattatggctacgtgggatccaggaagtcatgacaagtgaacagaccctaaactgg

SEQ ID NO: 144502 - DNA, 601 bp, Human
ttggccatcaggacgttagtgttaagcttttgcagaaaggacttgttggacaaataacagattcctgctgcgggaatggagaccagctaatatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatccctgatgatggtatcatcatcragggatgccaagagggtaaaagcactatttcagattatggctacgtgggatccaggaagtcatgacaagtgaacagaccctaaactggtgatgaggaggagggcagaggtgagcaggagggaaagattcggcaccaaactttgaatcactaggagtttcactcatcagctctaaaggaaaccctttggccaaaataaaaattgtcttctctttcctcagccttaattgatagaggataatgttatcagctggctaatgctcatcagtgatcaacattagactactgtgttttgacgttac

SEQ ID NO: 144503 - DNA, 601 bp, Human
ttagaaagaaaaacaaaaaaaacgaaaaacaatgttccagtaactgcagaggctacatgatggggttgatcttgtccactatggatcttttaaataaagctttggaaataccaagctcagacttaacaaatacaggagaaaaaatggcatgattatctcaataaataaatatcaaaaggcatttaagagaacttaatacattatttctggttttaaaaattattagtaaaacaaggttggaagaattggaactgccttactttgtcaagttgtatctactaagatactagaacaagccttwatattgaaggatctgaagaattaaaagcatattcctttaaagtctgggacaagcagtgatcattagtctcagtctctctttcttctcattgtcttgcagaaaccggctaatgcagtgagactgaaaattattaaaaagaaagtaggaattataaacatagaaaggatgccacctctgtctatagaggcagaagatgagattgttcacctaaaaactaagagatgttagaactgttagaactattagaactaataagaaagtaaagtggctggatataaaccagtaacttttaaaaccagt

SEQ ID NO: 144504 - DNA, 601 bp, Human
cctgtatttgttaacatttcgcagcgaacatctttgatcatttaaaaaattaatgatgcattcttatattgacaattcttatactaaaattttgaaaatccacaggagataggaaaaaataccccttacttttgatactattgacattttgaaatgaaaggaaaaaatgagtttagtagagttaattcagcagaaaatataaatatataagatggcactaaggtatctttggggagaaacgggacctggttttgtttcgcaggtcctttgccatttgctgtttgatactggggaagccacrtaccttgtctgtggtccagttaggtttctccactctgcaggtagggctgacctacttccattggaggaaaaacctagagagaaagaatgtcaagaaaggttccacctgaatgggaagtgttattgttagaatgtccatgaatgaatgtcagagtccagcatctcagaggccatcattaaatgaggagcagtctttgtagaagctgaactctgaagtatgcatcatggtgaggagtcaggtggggataaatgaataaaacataaaagaccatgtggtatggtagaggaggaggtgtgtgcg

SEQ ID NO: 144505 - DNA, 601 bp, Human
cgtaccttgtctgtggtccagttaggtttctccactctgcaggtagggctgacctacttccattggaggaaaaacctagagagaaagaatgtcaagaaaggttccacctgaatgggaagtgttattgttagaatgtccatgaatgaatgtcagagtccagcatctcagaggccatcattaaatgaggagcagtctttgtagaagctgaactctgaagtatgcatcatggtgaggagtcaggtggggataaatgaataaaacataaaagaccatgtggtatggtagaggaggaggtgtgtgygtgtgtgtgtgtgtgtgtgtgtgtgtgtgtacagcttaagaacataaagcaataaaggagaacattttgatacagcataataaacaatattggagtactaaggaggagcttggagcaattcgatttgggaagtattaagaggtgttacatgatgataggagatgggtgcacatgcctgtgtaagaatggggaggtggggacattgtagtgatggggcattggcattgggtagctttgttattaagttcaaagagtttctaaagggaaaataaaatccccatttgaatcacaggtggttca

SEQ ID NO: 144506 - DNA, 601 bp, Human
atgaagttcactttcaccagtaagacacattgagaaacacaagaaacccattgttctctggatgtttgtgcatttcagtggttttgcctgtaggaccctcaagtggaagttagattgtctctattatgttctttctaatttgttaaatatttcttgaactaatctccttctcactatctccattgctaccgttaatgtgtacactgtttatcacaacagccttgcatctcatcagtctgcagccgtggctcatgcaatccgttcatcatgctgcctgattcttctttccaaacatcagctstttgtcacttcactgctcagcatctctcactgacatttggattgttcaaaatcatatccccactgcccaccttcttggccacatctcttgtgcttgcacctctccccactctgttttcttctgattcaatgtgacagctacccaagactatacgtggttctgcaaaaatgcaaacctctgtcttgtcttggcacctagaataccctttttttgctaattactctttgtctcaagatgcggctgtaccaagagtcatctctaggaaatgctccctaacctcctttgtgttacgtaccattt

SEQ ID NO: 144507 - DNA, 601 bp, Human
cttcttggccacatctcttgtgcttgcacctctccccactctgttttcttctgattcaatgtgacagctacccaagactatacgtggttctgcaaaaatgcaaacctctgtcttgtcttggcacctagaataccctttttttgctaattactctttgtctcaagatgcggctgtaccaagagtcatctctaggaaatgctccctaacctcctttgtgttacgtaccatttcctcacactgtggaagcacatgagaattacttccatcccaacatctgtactctcccctaactggctagttwttggtctgtctccctgactcacctggaaaccaccctcaaggtgaaaattacgtagttctgttcattgcatcttgcagagtgcctggcacatcgctgtgtgataggaaagaatgaatgtgtatttttaaattgggcttctccttctctagtttttgaacatgtgtatgtgggtttctgttttgcctgatgtgacgtgagtcaagtcatactcaacctgctgtgttctcagaaatgcagtgcggatgagtaagataaatcatgttagcatcatatataagtgagctgaagactcttaccact

SEQ ID NO: 144508 - DNA, 601 bp, Human
tcaaggtgaaaattacgtagttctgttcattgcatcttgcagagtgcctggcacatcgctgtgtgataggaaagaatgaatgtgtatttttaaattgggcttctccttctctagtttttgaacatgtgtatgtgggtttctgttttgcctgatgtgacgtgagtcaagtcatactcaacctgctgtgttctcagaaatgcagtgcggatgagtaagataaatcatgttagcatcatatataagtgagctgaagactcttaccactcatctcagagcaccattaagtagctgcctactgggyctctctagggtgttcatgaattaaaactcctgtgttgttccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggtaaattggaactggtaatcagtctttgggcaaatg

SEQ ID NO: 144509 - DNA, 601 bp, Human
agaagagaaagaaaatcatttgagaagggcatctgaacctcattgccctcgaagggttaccttccttttagaaaatttttgataatttgctgctgccatttccctgtaggctgcgaggaataacagccagagataggaccttcctccatattgccaaccttggatgaccagggtgggattttgtgaaggaaactggtagttccctgacaccatttatatgtatcttaagtaacgatcacttgaatatctcaccgctagattaattctaagtaggttttctctgcagtgttgaagggacacsttatttataaagggaaatagatttaccttggaagtcaaatacagcttaaaacaaaattaaccagacacaataatgacatcttaggatgaaaattctttccaaaattatgccatgtctgctaatgccaaaatagaaccatttcttattaaccattgcttagaactttcatgcttctttccaatcatgtgggtactagagatatgattattatgtagtcaaggccttggaaccaggcataattagcccttttctactgtctgccccccatctctcaaacctaactattgttcctatgtagag

SEQ ID NO: 144510 - DNA, 601 bp, Human
gatctaaaagaagatccctgtttcttagtcttcttaagaagtttttcctttctgtcagggaggcagcagtgggggtggagggcagggaaggagggattgtttttacactgaccacagtaaaatattactcaggctaattaaggcctagagaatggttaaacaagaaattagagtaaattatgtaaattctggccaccaatatgagtacattgattagcggcaggttgaagatttttttttttaatttctatttttaattaccaaagtgtatgtatctattatatgatattgtaatagttcrgaataatataaaaggtagaaagtcttacatctttgcctctgccaatcccccttctagaggctccacctttatagattagtataaatctttttgcgcctctttctatgaatatatgatttttaatcaaactgggatgagaccatacatatttgtgtgtaaactgtcattgtttccacccacatagtggcatatcatatgaacatctttctggtgcaggtgggtcattatttttaacagctgccaagtatccctttgtatgactgtatcataacgtggttgttaaatctcctatgcatagtt

SEQ ID NO: 144511 - DNA, 601 bp, Human
caccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaaytctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtc

SEQ ID NO: 144512 - DNA, 601 bp, Human
cacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatt

SEQ ID NO: 144513 - DNA, 601 bp, Human
atttggtaatttagagggtgccaagtcaccatgtcagatgccataaagaaagaaaaatcaaggttctttaccaaaaataaccaaaacacaaggacagaatgaattaagtcctataaagggatatacagataaaatgctaaagagagaaaacaagtaacttagactgggaaaaaggaaagtctaaaaaaggaggtggctttgaaatgctttttttgttttaaccttatagaagaaggcagaagaaaggctaaaaatcattctgaacaaggatacaatccggtagcttcatgagactagagcygaagatcatgaaaatggtgagacaaagccagaaagactggagatgggtcagactgtgactgggagttgggactatatccagttatcaaagagccagtttttaagcaggagatgaagaattcaacttttgttttttagacagttgtggcaagagtgttaaggaactaaaaaggctgacagaccaacaaagaggttattacataatccagtggtaatgccatcttcaattacagcaatacaagacagagtggtaaaaagatactgggtataatcaacaggttaaatgtgttgcggagagaag

SEQ ID NO: 144514 - DNA, 601 bp, Human
ccaatcgtgtttataaaagggtccatttggtaatttagagggtgccaagtcaccatgtcagatgccataaagaaagaaaaatcaaggttctttaccaaaaataaccaaaacacaaggacagaatgaattaagtcctataaagggatatacagataaaatgctaaagagagaaaacaagtaacttagactgggaaaaaggaaagtctaaaaaaggaggtggctttgaaatgctttttttgttttaaccttatagaagaaggcagaagaaaggctaaaaatcattctgaacaaggatacaatscggtagcttcatgagactagagctgaagatcatgaaaatggtgagacaaagccagaaagactggagatgggtcagactgtgactgggagttgggactatatccagttatcaaagagccagtttttaagcaggagatgaagaattcaacttttgttttttagacagttgtggcaagagtgttaaggaactaaaaaggctgacagaccaacaaagaggttattacataatccagtggtaatgccatcttcaattacagcaatacaagacagagtggtaaaaagatactgggtataatcaaca

SEQ ID NO: 144515 - DNA, 601 bp, Human
cacatatatatggggcacatcaaaaaaaaaacaatcagcaaagaagaatgaaacaacagaaacacagaatagtaaggccaagataaaacagaaccacaagtgccaaaataattatttctatgaaagagtgggcttctgtatcaaaagcagcaaggaggtcaaataacatatgaataataagaccactgggtttgaaaagaaaggagctgctgatgtgctctcacaaagagcagtttcgctggagtaccatatgcagaaaacaaatggcagagggttaaggaatgaatgggatatgaggaartaacaagaatgagcatatcaaagacaggaaatacaataaagcctgtaagttgtgttcaaacactgtcatttaaaggaaacttttactcccttacatccaatttggtctctacatttctgttgcttaaggtctgaagacagcacttattaaagacacttgacataatgcattaagaaagcaggttaaataatttcctgagggtctataaaagtagctgctagaatgaggttcttcatctttaaatgaaatgcaaaataagcatcctaatgggtaatctccataaactctaagtaaataatt

SEQ ID NO: 144516 - DNA, 601 bp, Human
gttcacacccataatcccagtggtttgggaggctaaggcagaaagatggcttgagtccaggagttccagatcaacctgggcaatataatgagaccctgtcttgacaaaaaaatttaaaaattagctgagtgtggtggtgcacacctgtagtctctgctattcaggaggctgaagcaagaggaccgcttgagcccaggaggtcgaggatgcagtgagctatgatcatgccactgcactgcagcctgagcaatagagcaagacactgtctctaaaaaaaaaaaaaagcaatcaaccaaccaaycaacaaacaaaagaatacatgtactcaatctaccaagggtaagcactcatgttagatactttcatatatttttttactatcactatgatactttacagatgaggaaattgagaccagaaggctaaatttttggcctaaacttttccaaggccaaaatgctagtaaatgactaagctaggattcacatctcttcaatctatgtctagtatactacatctcgattcactcttccttttccacatgtttagctactcactacattcaattggttcttagaagacatggtaatcactaaaaggt

SEQ ID NO: 144517 - DNA, 601 bp, Human
aattcgttctgcatttattcccttattttattttttttgagaccgagtctagttctgtcacccaggctagagtgcagtggcacaatcttggctcattgcaacctctgcctcccagtcccaggttcaagcgattctcctgcctcagcctcccgagtagctgagattacaggcacccaccaccatgctaatatttgtatttttagtagagacggggtttcactgtgttggtcaggctggtctcgaactcctgacctcatgatccgcccacctcagcctcccaaaatgctgggattaccagcaygagccaccgcgcccggcctattcccctatttttaagacaggacataggggtttttcttcagcaagtatacctaaccactctgtgacaatcacaattaaaatttttctgtgtggaatgtcaagatttaagaagtacttagtggttcacacccataatcccagtggtttgggaggctaaggcagaaagatggcttgagtccaggagttccagatcaacctgggcaatataatgagaccctgtcttgacaaaaaaatttaaaaattagctgagtgtggtggtgcacacctgtagtctctgcta

SEQ ID NO: 144518 - DNA, 601 bp, Human
attaaaattcgttctgcatttattcccttattttattttttttgagaccgagtctagttctgtcacccaggctagagtgcagtggcacaatcttggctcattgcaacctctgcctcccagtcccaggttcaagcgattctcctgcctcagcctcccgagtagctgagattacaggcacccaccaccatgctaatatttgtatttttagtagagacggggtttcactgtgttggtcaggctggtctcgaactcctgacctcatgatccgcccacctcagcctcccaaaatgctgggattacmagcacgagccaccgcgcccggcctattcccctatttttaagacaggacataggggtttttcttcagcaagtatacctaaccactctgtgacaatcacaattaaaatttttctgtgtggaatgtcaagatttaagaagtacttagtggttcacacccataatcccagtggtttgggaggctaaggcagaaagatggcttgagtccaggagttccagatcaacctgggcaatataatgagaccctgtcttgacaaaaaaatttaaaaattagctgagtgtggtggtgcacacctgtagtctc

SEQ ID NO: 144519 - DNA, 601 bp, Human
tttatccacgcattgtacaaatttgtgcggcaatcttgtaaaaaggccatattaatcttcatcatcaaaattttagcacatgtcctatgagagaatgtacataccttctcactgaaatttctgacagaaaaagattttaggtccatagaagacagtattctaaatcaattatgggattagaaaaatgatggatacatgggattataaaaaagtcgaagttaacatggatccttaattatattcaatcattaacagggcaaaaagagccatcaattggagataaggccttttgtattaaaaytcgttctgcatttattcccttattttattttttttgagaccgagtctagttctgtcacccaggctagagtgcagtggcacaatcttggctcattgcaacctctgcctcccagtcccaggttcaagcgattctcctgcctcagcctcccgagtagctgagattacaggcacccaccaccatgctaatatttgtatttttagtagagacggggtttcactgtgttggtcaggctggtctcgaactcctgacctcatgatccgcccacctcagcctcccaaaatgctgggattaccagcacga

SEQ ID NO: 144520 - DNA, 601 bp, Human
tgggagccccgggcggcctcgccggtggggaggggaggcgaggggaggggagaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggtgagtgcttccacccccgccctgctcccagctccccgcggcgcgttcttcgaggggccgctgggggaggaagcccgaggccggcgcagsggccgggccggggaccctgggcgcggggcctggcgcggcggccttcccctcctctcctcgcctcctcgtctcctcccctcctcgccttttctggcccagtcgggtggtcggggcggcggcgggcgaggctggagctcgcccgagccgggcccgctgcggaaatggagctgggggttttaaactgcggacgtttccctccatgttggcggcgcggcgcggctgtggagcggcggcggcagggagggttcgtgggcgcctttgtcctgccccaccgcagcctggctcccggcccctccgagc

SEQ ID NO: 144521 - DNA, 601 bp, Human
aaacagtaacataccggagctggaatgtgtgaggattgcagtgccagttgactctgaagttagcgggcatctggcttaatagagaaaaacctgagggtctccgtgtttttcctgtttatggcgaatgaggacattgggtgcagtgaacaaaatttttctttacaaacacacttgcctaaaacatctcttgtaagaaaatcctgtgtgtatcttgactcctgtaggtgagtgcatagtgagtgacacgaacaaatgtggggcttttgtgtgccatcctggctatttcactcctgtgggggartatattaggatgtgattgcactgtatcctcacgtttgacaattgtgtgtggatcttgtgtaaagtgggggtgcacatcatgttgttggcttcatcttttggaacatttgtgtataagataatggtcttctaagaagaatgccggttcattttgtttgtttttcaagcaaatcttaattcttcttttaaaaagtaagctttagagacctaacaggtatccaccatatgtgttaacttgttcaacccagaataattgataagaatctttttggcactggcctgcgtttatattacacagata

SEQ ID NO: 144522 - DNA, 601 bp, Human
tgacacgaacaaatgtggggcttttgtgtgccatcctggctatttcactcctgtgggggagtatattaggatgtgattgcactgtatcctcacgtttgacaattgtgtgtggatcttgtgtaaagtgggggtgcacatcatgttgttggcttcatcttttggaacatttgtgtataagataatggtcttctaagaagaatgccggttcattttgtttgtttttcaagcaaatcttaattcttcttttaaaaagtaagctttagagacctaacaggtatccaccatatgtgttaacttgttyaacccagaataattgataagaatctttttggcactggcctgcgtttatattacacagatactgtgtatgtggtgtgtaagtgcaatggaaagatgccagtaaataagtttttaagaacacgcagaaactgttcaagggtcttttaaaacctcaagtagcccctgcgtcctgaagggcttgtgtttcaaaagtttataaagagttttttgcaacttgagcatcttcctgtaggaagacataattgccttcttttaactctggctgaccagtgtaggagagctagtactagtaagagtggtt

SEQ ID NO: 144523 - DNA, 601 bp, Human
ccaggcctgacttcatcccgaaaacttgtgggctcctccccactactccaagcccaaacccattcattaccccagtgatgcccaatctcaggtaggtgtagggaagaaagctgcctctcttacctaatgtgttaattgactgacatcctctaatcaccagataagtacttgtgttttctttcatctaccaacctagctgccatctctgtaaactagtagagcttgttaagttttttcacagacgattaacagtgaaaaaatgtggtggttaagaaaggcctccctcaccccgcctcccccsccactctcccactactcccttggggtaggtaattcaactttctccttaattccagagtcttcaaaggttcctaaatgttgcttttattgtatcatcagctcttaacaggagccagtgaggaatgtacattgataggcttggacaatacatcaagaagtgcttagttggtgaaatgaaggtgatttgggggacagctcatatctgtcctactggctgccccttggacgtggccccagctagttcatgtggtactggggaaggtcggcagccctggttttgttgtgtggaaatgtgattccg

SEQ ID NO: 144524 - DNA, 601 bp, Human
tctgggaatgtatgaatgaggcatagtccttgttcccaagaagctcacacttactgggaaagacagccatttgcatctgttggtcccctgggtttactacgttctgtgtctggagtttgctgtgggtggtgttgagtgtatcaagggtagagaagagccctgggcttcaggggaggctttcagaggcagtgacacctagccaagtgctgagaacaaacaggaaaaacagcagttgatggggctgtttctgcagagagggcagtatgccaaagtcaggggtctgggggacacagtcagccamgtgctggaagggggtggtaggggagggctaagcaggagccaggctgggggggcttttatattccatgcccaagggtttgggcttcatcctgaacaccaaggatttaatcaggagagtgacattaattagattcgagtctagcccagggcttttcaacctgtctggtgagggcctgggttttaagatatctgatccgtagtatacaaacatttatataaaatgccataaaaatgagttactagaaaaataaagacatacacaatagacgactcacagttttactatcagattcgatagata

SEQ ID NO: 144525 - DNA, 601 bp, Human
acttactgggaaagacagccatttgcatctgttggtcccctgggtttactacgttctgtgtctggagtttgctgtgggtggtgttgagtgtatcaagggtagagaagagccctgggcttcaggggaggctttcagaggcagtgacacctagccaagtgctgagaacaaacaggaaaaacagcagttgatggggctgtttctgcagagagggcagtatgccaaagtcaggggtctgggggacacagtcagccaagtgctggaagggggtggtaggggagggctaagcaggagccaggctggrggggcttttatattccatgcccaagggtttgggcttcatcctgaacaccaaggatttaatcaggagagtgacattaattagattcgagtctagcccagggcttttcaacctgtctggtgagggcctgggttttaagatatctgatccgtagtatacaaacatttatataaaatgccataaaaatgagttactagaaaaataaagacatacacaatagacgactcacagttttactatcagattcgatagatatgagattactttgtcaaaatgctataaacatttccatacacctatttc

SEQ ID NO: 144526 - DNA, 601 bp, Human
tggaagggggtggtaggggagggctaagcaggagccaggctgggggggcttttatattccatgcccaagggtttgggcttcatcctgaacaccaaggatttaatcaggagagtgacattaattagattcgagtctagcccagggcttttcaacctgtctggtgagggcctgggttttaagatatctgatccgtagtatacaaacatttatataaaatgccataaaaatgagttactagaaaaataaagacatacacaatagacgactcacagttttactatcagattcgatagatatgagrttactttgtcaaaatgctataaacatttccatacacctatttctcaattttggtacttgcacagattagtaacgagcatttctaggacccatggctgaggatgacactttgagtgctctagaccaggaataaagcacagaaagtaaatattttagactttatgggagcggctccaggcagtatggaagggagcagacatggcagtgttccagtacaactttatggacagtgaaatttgaattttggataattttcacacttcaggaaatactgttcttttgattttgtttgtaatcattt

SEQ ID NO: 144527 - DNA, 601 bp, Human
agtgacattaattagattcgagtctagcccagggcttttcaacctgtctggtgagggcctgggttttaagatatctgatccgtagtatacaaacatttatataaaatgccataaaaatgagttactagaaaaataaagacatacacaatagacgactcacagttttactatcagattcgatagatatgagattactttgtcaaaatgctataaacatttccatacacctatttctcaattttggtacttgcacagattagtaacgagcatttctaggacccatggctgaggatgacacttygagtgctctagaccaggaataaagcacagaaagtaaatattttagactttatgggagcggctccaggcagtatggaagggagcagacatggcagtgttccagtacaactttatggacagtgaaatttgaattttggataattttcacacttcaggaaatactgttcttttgattttgtttgtaatcatttaagaatgtaaaagccattcttagtaggaaggccacacaaaaattggggtgagggacttggcctggggcataatttgtctacatccctagaagcaacataaggagattcgg

SEQ ID NO: 144528 - DNA, 601 bp, Human
tagtaggaaggccacacaaaaattggggtgagggacttggcctggggcataatttgtctacatccctagaagcaacataaggagattcggagtaggtggggacacagtgaaacagttcccagtcatccaagctcatgttttattttcaagatctgcttatgtgttttgttcagagtgaaactgtggtactgtttttttttttttggtctgtgtgcttatttattttgtcctgtcgtctcagttttaatccatgttaattattacccttcttgcatatggtgttggaaataagtacagctarttggtttagatacattcgtttcatggaaataccttcaaagaacaggaatggaaaggctgcatttgtctcatgaaagatggatcattatgaaagcattttccattggcttcatctgatccattctcagatcctaacatttcccgtgctgattttagagttaatggtagcagttcctgcctttgttatcctcttctagtgtgggtctgtctgtatgtgttatgatttgtggtaaagctctttgccttcttccccctttctagcctttaacttcctttaggcaaaggaaaggtggctcaactt

SEQ ID NO: 144529 - DNA, 601 bp, Human
taccatcatgtttctttttaataagttacagttcttttgattaaatgtttatattcttcaatttagaagccatttggaaatagcatcagcagatataatggggagcctgagcatattgagagaaatgacgcacctcataaaaatacacaggtgggaaagtgttccctttcatcttggttgtttttttttttcttttttttggttaaaagtgactctcccttgagaagcacattgaaaattgtaatattttataacctgttctaaaattctgtccttaaattaagactgaatataatttcayaaatttattcttactagtgtatagctgtattgagatgctgaaatagttaatgcagtagcattaatggtaattgttcactgcagatatttaatttttaaatttttcatttaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacct

SEQ ID NO: 144530 - DNA, 601 bp, Human
aagcaaaactatttctttagccaaaagaaaaaaattggatcttccagtgagcctttctgtgtggctgcaggactagcccggaacgagagttctgtggagcgtcacagggcgggtgctttttaacttggcattgcacgtgaatgtccccgcctgctgtccctaccccccaggtactcgcagtcccctgcctagcctcgggcatttgtgttgtggcatcttttctgcgggtggcatgttaagatctctgttctggatgatagagttttactagaatcttttgaaaccattattggcaacttgrttaagtataaatatttataattttgtaactaccaacctggctcggtgcctgacccctggtaggtgcataataccctccccttaggtaatggcattagactttaaaatatgtgtttggcccagctctgttaataattagccatttgactttgtgcctgagagtttggattgtgggaattttcaggttgcacttcttgtctgttttcccttaattaaaagcaaataatgaccatttgaactgaaaaagaatcaatatgttaaactatttggaaagttctacaagagataatggtatgtatat

SEQ ID NO: 144531 - DNA, 601 bp, Human
ggcgccgaggcggcgggcctatttccaggatcagctccgcctccagttttctagaaaaacccaagcccggaaagagcgtctcctccgccaggaggcggcggggaggattgcacaacctcaggcgggggagcggaggaaacccgagcccgctcggcccggactcccccacgcgcaggcccgaccgactcaccttcccctccacctccaggcacaacccgtccgcgatctcccggatcttgtagatgtcggagaacatctcatcgtctgccggatacacagagccgcccatcaccgtgcgccyggcgccgccatttcccgcatttcccgcgccggcggccgcacgcgggatctgcccctccgtagcacaccagagctgggcgcgagccccgggcaccgacccctccgcgctcggctaagaccgccggcgtcccctaggcccgcgacggctgcgccttccccgcccccacccgcaccccagacccccgtgtgcggcagtaaggatagtgcagtgaggactcacggctgatgaggtcccggtagataatcatgatggcgactgaagggagacgacgacggcgctagcttagcacgagcctgaaac

SEQ ID NO: 144532 - DNA, 601 bp, Human
gcaacccccctcccaggtttaagtgattttcctgcctcaggctctcgattagctgggattacaggtgcccgctgccatgcctggctaatttttgtatttttagcagagatagggtttcgccatgttggccaggctggtctcgaactcccaacctcaggtgatgcacccacctcggcgtcccaagtgctgaaattacaggtgtgagccaccacacccagcctaaactgtactttattatgccccatctgcactcaacgttttccacaaataagattctaagcctttttataccctaagaatyttttacatatgaaacacaattctcttgatccccaaagagaaaactaaaaccatgtttcagaacgctgtaaaactcattctcagtgtcacaaaacaattgcaaatcacatctaaaatgtcttttttacattatttattttaacccacttccttgtacttacacatttttccatttctaaaccatccttaaagaaaatcatatatggggtcacaccatcctcacggtagtccaatagagcaaccatgccatctggattcatgttttcaccaataaagaacttgggaagcaaacaaaatacct

SEQ ID NO: 144533 - DNA, 601 bp, Human
aaaatatgattatgaagtgaaagtgaggccatatctagaggaagatcaatggtgttctctgatctccttcagcatttaaactctactgtatttttttgagacagcacctcactctgtcacccaggatagagtgcagtggtgggatctctgctcactgcaacccccctcccaggtttaagtgattttcctgcctcaggctctcgattagctgggattacaggtgcccgctgccatgcctggctaatttttgtatttttagcagagatagggtttcgccatgttggccaggctggtctcgaaytcccaacctcaggtgatgcacccacctcggcgtcccaagtgctgaaattacaggtgtgagccaccacacccagcctaaactgtactttattatgccccatctgcactcaacgttttccacaaataagattctaagcctttttataccctaagaatcttttacatatgaaacacaattctcttgatccccaaagagaaaactaaaaccatgtttcagaacgctgtaaaactcattctcagtgtcacaaaacaattgcaaatcacatctaaaatgtcttttttacattatttattttaaccc

SEQ ID NO: 144534 - DNA, 601 bp, Human
atactgttctaagtaatttctgtctactgttgactctaatcttgttcagtatagctttatgtttctcttcttccttatacagaagcctatgaaaactaggataatgaatgcctttgtttctgtacagcttccagcagttccttccatagaagacaccaagttatttattattagtaaaacaatttgcataccagttcagcagtcagctctatttactaagctagtactgcactaggcttttcaatgatcagctgcccattatcagtaaaccaaagtgaaaaccactgatactgatccataygtatacagcaaaatatgattatgaagtgaaagtgaggccatatctagaggaagatcaatggtgttctctgatctccttcagcatttaaactctactgtatttttttgagacagcacctcactctgtcacccaggatagagtgcagtggtgggatctctgctcactgcaacccccctcccaggtttaagtgattttcctgcctcaggctctcgattagctgggattacaggtgcccgctgccatgcctggctaatttttgtatttttagcagagatagggtttcgccatgttggccaggct

SEQ ID NO: 144535 - DNA, 601 bp, Human
caatctgggccgccacaaagacagacagaaagcgcagggatttctttcttttgcatcctagtgcaaaccaaaagaacaacagtaaattgttcaaggtctatcagtggatgcagaacacccttaccaaatcagcggtagctcatttttcagaaggctgtggcatgtaccacccacaccctgctctaccaacaaaaacctcagatactgtctgaataacccctttggtaagtcatcttatactgttctaagtaatttctgtctactgttgactctaatcttgttcagtatagctttatgtttytcttcttccttatacagaagcctatgaaaactaggataatgaatgcctttgtttctgtacagcttccagcagttccttccatagaagacaccaagttatttattattagtaaaacaatttgcataccagttcagcagtcagctctatttactaagctagtactgcactaggcttttcaatgatcagctgcccattatcagtaaaccaaagtgaaaaccactgatactgatccatacgtatacagcaaaatatgattatgaagtgaaagtgaggccatatctagaggaagatcaatggtgt

SEQ ID NO: 144536 - DNA, 601 bp, Human; identical to SEQ ID NO: 115266

SEQ ID NO: 144537 - DNA, 601 bp, Human; identical to SEQ ID NO: 115267

SEQ ID NO: 144538 - DNA, 601 bp, Human; identical to SEQ ID NO: 115268

SEQ ID NO: 144539 - DNA, 601 bp, Human; identical to SEQ ID NO: 115269

SEQ ID NO: 144540 - DNA, 601 bp, Human; identical to SEQ ID NO: 115270

SEQ ID NO: 144541 - DNA, 601 bp, Human; identical to SEQ ID NO: 115271

SEQ ID NO: 144542 - DNA, 601 bp, Human; identical to SEQ ID NO: 115272

SEQ ID NO: 144543 - DNA, 601 bp, Human; identical to SEQ ID NO: 115273

SEQ ID NO: 144544 - DNA, 601 bp, Human; identical to SEQ ID NO: 115274

SEQ ID NO: 144545 - DNA, 601 bp, Human; identical to SEQ ID NO: 115275

SEQ ID NO: 144546 - DNA, 601 bp, Human; identical to SEQ ID NO: 115276

SEQ ID NO: 144547 - DNA, 601 bp, Human; identical to SEQ ID NO: 115277

SEQ ID NO: 144548 - DNA, 601 bp, Human; identical to SEQ ID NO: 115278

SEQ ID NO: 144549 - DNA, 601 bp, Human
gggaccgcgggtcggggccgcgggcgctctcgcccccgccgccgggtccccgcgcgccgcctggcctccgcttcgggccaggggacgggctgagcgtgacatttttgcactgtccctcgccgctcgccggagggaaatcgcgctcaccgcgccaccccgagtggtccccgagcagccagttgaggaagagcccagcactggcgtggagggactcctcccaggccacaactgggttctagctttcctttcagaaggaacggcggggaaaatggtgtgcaattgtgactcgttattgtttttrcactgttattttaatgttactttaaaagttttcggtccggagaaaaaccttgtttgttgttgttgctgctactgctgttggtttttggtagagacgtgaaagctaactcttaagtagctcgacagttattttggacgaatgactgaaaccagaaacgccgcccctcgccttcggagctgcaggctgctgcgttccttgccgcggacggggcgagctccgggaagggttggtagagcagctacccacccactccacgcgcgtcttcaacagcctctctcccccagcgagggttaacccttt

SEQ ID NO: 144550 - DNA, 601 bp, Human
ttgtgtttccttaggtaagataggattctttctcctcagaggtgattttagggaagtaattgaagatattttaaaggaaagctccatatctccaaaatattatttagtagctgaagttctaccaggtagtttcagttagctttcagatatgggatgctttgggttgggtgtgggggtgagagttgcaggggcaagttgcaggggcaagatgctgggcaaattgcaggggtgagagttgcaggccttaagtactctattaggggaatagagtacctaaagaattgtgtattttaagttaaargttatacaggtatatggtaaaaaaaaaaaaaatttaatgatagagtaaaaaatgttacttttctcctccccccacaggtaatccactgttaacagtttcttaaaagtttactttaaaaaaaattgtacaaagagtattgttatactgttgtactgtaatttactattttatttatttattttattattattattattttttgagatggagtctcgctccgttgcccagactggagtgcagtggggcaatcttggctcaccacaacctccacctcctgggttcaagtgattctccttcctc

SEQ ID NO: 144551 - DNA, 601 bp, Human
agatattttaaaggaaagctccatatctccaaaatattatttagtagctgaagttctaccaggtagtttcagttagctttcagatatgggatgctttgggttgggtgtgggggtgagagttgcaggggcaagttgcaggggcaagatgctgggcaaattgcaggggtgagagttgcaggccttaagtactctattaggggaatagagtacctaaagaattgtgtattttaagttaaaggttatacaggtatatggtaaaaaaaaaaaaaatttaatgatagagtaaaaaatgttacttttytcctccccccacaggtaatccactgttaacagtttcttaaaagtttactttaaaaaaaattgtacaaagagtattgttatactgttgtactgtaatttactattttatttatttattttattattattattattttttgagatggagtctcgctccgttgcccagactggagtgcagtggggcaatcttggctcaccacaacctccacctcctgggttcaagtgattctccttcctcagcctcctgagtaactgggactacaggcgtgtgccaccatgcccagataatttttgtattttt

SEQ ID NO: 144552 - DNA, 601 bp, Human
attgcaggggtgagagttgcaggccttaagtactctattaggggaatagagtacctaaagaattgtgtattttaagttaaaggttatacaggtatatggtaaaaaaaaaaaaaatttaatgatagagtaaaaaatgttacttttctcctccccccacaggtaatccactgttaacagtttcttaaaagtttactttaaaaaaaattgtacaaagagtattgttatactgttgtactgtaatttactattttatttatttattttattattattattattttttgagatggagtctcgctcygttgcccagactggagtgcagtggggcaatcttggctcaccacaacctccacctcctgggttcaagtgattctccttcctcagcctcctgagtaactgggactacaggcgtgtgccaccatgcccagataatttttgtatttttagtagagactgtgttggccaggctggtctcaaactcctgacctcgtgatccgcccgcctcggcctcccaaagtgctgagattacaggcatgagccaccacgtccggcctactgttttattttttaactgtgatttacttttttccttagttaagtc

SEQ ID NO: 144553 - DNA, 601 bp, Human
aaaaattgtacaaagagtattgttatactgttgtactgtaatttactattttatttatttattttattattattattattttttgagatggagtctcgctccgttgcccagactggagtgcagtggggcaatcttggctcaccacaacctccacctcctgggttcaagtgattctccttcctcagcctcctgagtaactgggactacaggcgtgtgccaccatgcccagataatttttgtatttttagtagagactgtgttggccaggctggtctcaaactcctgacctcgtgatccgccygcctcggcctcccaaagtgctgagattacaggcatgagccaccacgtccggcctactgttttattttttaactgtgatttacttttttccttagttaagtcacaagctcttttcatactggcacatacagatcaacataattaagaaataataagaatattttattataacataatttattttttctgactcctgttgagtagtactacgttgtaatagtttacattgaccagcagcgtatgagaatgcctgtgacatgtatttaccaacattggactttaaaaaactatattgccaatt

SEQ ID NO: 144554 - DNA, 601 bp, Human
gaggtggaagaggaggcaggagagggaggcgcactgtaacttttactgaaaaaaatccatgtataaatgaacctgcacagttcaaacctgtgttgttgttacatattttcaactagctagaagagaggcttttgaatgttcccaacacaaataaatgataaatgtttgaagtgatggatatgttaattaccccgatttgatcattacacattgtatatgttgaagtatcaccatgtaacccacaaacatgtacaattatatgctggttaaaaagcataaaaataaaacccccgaacctacyagctgtcacttcccatcaccccttatttctttagtgtttgggataagccaggtcaaatgcttaggttggtgccaaaatgtaagtacacagtaaaaaagcagttataactttttgcagggagactgtgtggcaaagtccatttacatagttttagagaatgcaaaaatgggataattactgaatggatgtttgcatacttccatactgtgcaaggatgtggtgcacagtgctggctagagatacaaagatgaaagatactcaatcaagagatgtatattcaagtgggaggaaagaggctgg

SEQ ID NO: 144555 - DNA, 601 bp, Human
gaggcttttgaatgttcccaacacaaataaatgataaatgtttgaagtgatggatatgttaattaccccgatttgatcattacacattgtatatgttgaagtatcaccatgtaacccacaaacatgtacaattatatgctggttaaaaagcataaaaataaaacccccgaacctactagctgtcacttcccatcaccccttatttctttagtgtttgggataagccaggtcaaatgcttaggttggtgccaaaatgtaagtacacagtaaaaaagcagttataactttttgcagggagacagtgtggcaaagtccatttacatagttttagagaatgcaaaaatgggataattactgaatggatgtttgcatacttccatactgtgcaaggatgtggtgcacagtgctggctagagatacaaagatgaaagatactcaatcaagagatgtatattcaagtgggaggaaagaggctggtataaaaatacttataaaacaagccagagtatagttagtgccttcaggaagggctcaatacaatatttggaattggaaacttgacaaatggagattagtcatgttactctgagagtacaggaac

SEQ ID NO: 144556 - DNA, 601 bp, Human
tagagaccatcctggctaacatggtgaaaccctgtctctactaaaaaatacaaaaattagttgggcatggtggtgtgcatctgtagtaccagctactcaggaggctgaggcaggagaattgcttgaacctgggaggcagaggttgcagtgagcagaggtcgtgccactgcactccagcctggcgacagcgagactctgtctcaaaaaaaaaaaaaagaaaattaatttcagtgttaacataaaatatgttttaaaatgatgaatttttttttaaatgagagtgaacatcctggtcttgttstgatcttaagggggaaggcatttagtctttccccagtaagtagtatgtcagcagtggatattctgtagattaaaaaaaagaaaatcagacgagacgtttccttccagtttactgggattttaattaaatcaaattaattaatttactttttgagatggagtctcactctgtcacctaggctggggtgcagtggtgtgatcttggcgcactgcaacctccacctcccgggttcaagcaattctgcctcagcctctcaagtatctgggactacaggcacccgccaccacgcccagcaaattt

SEQ ID NO: 144557 - DNA, 601 bp, Human
gggtagctaggactacaggcacatgccaccaagaatttcctttaatgttgcataatgcataggtctagtaatagcatcagttttcattactttaaatatatctatattttactgtcatttttcaaggatatttttgctggatatagaattctcagttgatggttttttttctctcttttttttttttttttttgagacagagtcttgccctgtcacctaggcaggagtgcagtggcactatctcggcttactgcaggctccgcctcctgggttcacgccattctcctgcctcagccttccragtagctgggactataggcgcctgccacggcgcccagctaattttttgtatttttagtagagacggggtttcactgtgttagccaggatggtctcgatctcctgacctcgtgatccgtctgcctcggcttcccaaagtgctgggattacaggcgtgagccaccacgcccagcctcagtttttttcctttaatcaatttaaagatgtcattttattcttctctggtctccattgtttctttaactttcaacaatttgatgttgaaagttattgtcatataaatataacattcatattgagt

SEQ ID NO: 144558 - DNA, 601 bp, Human
agaatttcctttaatgttgcataatgcataggtctagtaatagcatcagttttcattactttaaatatatctatattttactgtcatttttcaaggatatttttgctggatatagaattctcagttgatggttttttttctctcttttttttttttttttttgagacagagtcttgccctgtcacctaggcaggagtgcagtggcactatctcggcttactgcaggctccgcctcctgggttcacgccattctcctgcctcagccttccgagtagctgggactataggcgcctgccacggygcccagctaattttttgtatttttagtagagacggggtttcactgtgttagccaggatggtctcgatctcctgacctcgtgatccgtctgcctcggcttcccaaagtgctgggattacaggcgtgagccaccacgcccagcctcagtttttttcctttaatcaatttaaagatgtcattttattcttctctggtctccattgtttctttaactttcaacaatttgatgttgaaagttattgtcatataaatataacattcatattgagtaggataaagttatattgaatttgtgaattgt

SEQ ID NO: 144559 - DNA, 601 bp, Human
gcctgtagttccagctacttgggaagctgaggcaggagaatggtgtgaaactgggaggcggagcttgcagtgagccgagatcgtgccagtgtgctccagcctgggtgacagaatgagactctgtctcaaaaaaaacaaaaacaaaaccttttctgccccattcctctgtttttcctcttgagattctgcttacacattattctgtttaaaattggtccatgagtatgtattaatttttttctctgtttttcagagactcttttaaatgttgtatctaatgtgcagtgaagcctgttttcartgaatgcacccttcagttacagtattttgtttaaaaaattccatttatctgccaagattccccattgtgaccatatttttcttttaagtctttgaatgtattcataatagctgttttgaagtccttgtttattcctttgtctgtattaatggacttttgactcttttttcccccttgatagtaggtcacattttcctgcttcatttcataaatacaaaatttttgttgtagagtggatatgatacatcatatctctaaactctttttatcttcccttgatgaatgttaaaattagtggct

SEQ ID NO: 144560 - DNA, 601 bp, Human
gcctgggtgacagaatgagactctgtctcaaaaaaaacaaaaacaaaaccttttctgccccattcctctgtttttcctcttgagattctgcttacacattattctgtttaaaattggtccatgagtatgtattaatttttttctctgtttttcagagactcttttaaatgttgtatctaatgtgcagtgaagcctgttttcagtgaatgcacccttcagttacagtattttgtttaaaaaattccatttatctgccaagattccccattgtgaccatatttttcttttaagtctttgaatrtattcataatagctgttttgaagtccttgtttattcctttgtctgtattaatggacttttgactcttttttcccccttgatagtaggtcacattttcctgcttcatttcataaatacaaaatttttgttgtagagtggatatgatacatcatatctctaaactctttttatcttcccttgatgaatgttaaaattagtggctgattatattgaatttttggaaccttggtcttctgttttaagatgggtctatagaaagtctgaggcgttggccaggcgtggtggctcatgcttgtaatc

SEQ ID NO: 144561 - DNA, 601 bp, Human
tagttgttgttttcttctgggatccttggaatcttccctgagcatatgaagttcggggatcagcaaataatttgaaggagtttatatttttatatttttgaggcttccctaccgtagctctctcctttgaattttccctttgattttctagccactttgtagccttgaataaaacagctttctgcttgagctctatctgccctatgctgctgcaaactgggagtgtcctcaggagtaatgctgtacaaatttgaatctcctccactatacttccccttctttcatgatcagatctccagtktctacttgctcttgattgctttcctctgttttcaagtcattctttaaaagtattttttttcccagggtttataattgctatttgtggaaagattatttcagtgagtttgctgaattctattccaccatgtccagaactgttcacactcattttcattcattttaaactgggcgttaaacacagttgctaacttaatacacaccttgttttagaataagatagaaactcagtattgtttcagtcacatacacttgataagaataggttatttgatggaaagctaagagctaatgaatgttt

SEQ ID NO: 144562 - DNA, 601 bp, Human
ctatttctccacatcctctctagcacctgttgtttcctgactttttaaagatcgccattctaacgggtgtgacatggtatttcattgtggttttgatttgcatttctctgatggccagtgatgagcattttttcctgtgtctgttgactgcataaatgtcttcttttgagaagtgtctgttcatatcctttgcctactttttgatggggttgtttgattttttcttgtaaatttgtttaagttctttgtagattctggatattagccctttgtcagatgggtagattgtaaaaactttctyccattctgtaggttgcctgttcactctgatggtagtttcttttgctgtgcagaagctctttagtttaattagatcccatttgtcaattttggcatttgttgccattgcttttggtgttttagtcatgaagtccttgcccatgcctatgtcctgaatggtattacctaggttttcttctagagtttttatggttttaggtctaacatttaagtctttaatccgtctggaattaatttttgtgtaaggtgtaaggaagggatccagtttcagctttctacatatgggctagtcagttttccc

SEQ ID NO: 144563 - DNA, 601 bp, Human
actgagatctctagcagaggctaaaattgtggggatgggaagaaaaaaagaaaaaaaaaaaacaaaaaaatgagaacacctttttatgctaatggcaataaaatttaatagaggaaaaaagttgatggaggcaggaaagagatgatagaattgctggagcaatgtcctgcagtaggaaaagattaactagtgtaagagttggcttatttaagagcactgagaatttcttgtaacatgaagagatggtagagtatatgggcatagatgcatataagctggcagatgatgtggtgtgtcttaygtatcagtggattagatcatcagttgagaatgacagtgagttaatacaaatcaatgtaggtacgtataggtaatacttgggaagttaagggagcccaatacaaaaatgttgaagacgtataaataagaaagtgcataataagttaagggacaggttgctgttagcgattgagttctaattctaatgatattctctgaaagacaattttgaggattagataaaataccctatgtaaagtgcttaaggtgtaatgtcttgatgtattccagtaagtactcaataaatgttaagtatgattgt

SEQ ID NO: 144564 - DNA, 601 bp, Human
gtggttaaaaatgtggactctggaacttcactgtgtttgagtcctggctctccccttactagttgttcatccttgagtgaatgatttaacctctttatgcctcactctctaggaaagagattacttacctcagagttcttggtgaggatgaaatgaattaatacgtattaagtggttagaattttgagcactgggtaggtactcagtgttattcctctcctcttagtattataccatgctgcctttagttcaaaccttttaaaacctttcttattgaaaagtttaagtgaggctgaaattwtcactttcctttttagagccatctttttttttttcataaagtagtgttaatctttatggtttaagttcccaaatataataattatgaattttacttatgtgaattgatcacaaataggggcatttcagtttggagaaaaactatcccacaggattttgtcttttttgtttttcaacctcctttctaagcgttttctgcatagtcattcatttccatggcttcccttatatgttactcccaaatcagcatctgatgttttacctcatttctcattttcattcactgatttgttttcttctt

SEQ ID NO: 144565 - DNA, 601 bp, Human
gctctccccttactagttgttcatccttgagtgaatgatttaacctctttatgcctcactctctaggaaagagattacttacctcagagttcttggtgaggatgaaatgaattaatacgtattaagtggttagaattttgagcactgggtaggtactcagtgttattcctctcctcttagtattataccatgctgcctttagttcaaaccttttaaaacctttcttattgaaaagtttaagtgaggctgaaattatcactttcctttttagagccatctttttttttttcataaagtagtrttaatctttatggtttaagttcccaaatataataattatgaattttacttatgtgaattgatcacaaataggggcatttcagtttggagaaaaactatcccacaggattttgtcttttttgtttttcaacctcctttctaagcgttttctgcatagtcattcatttccatggcttcccttatatgttactcccaaatcagcatctgatgttttacctcatttctcattttcattcactgatttgttttcttctttcttcaattagtcactaaatttacttcttttattatcccaaaccct

SEQ ID NO: 144566 - DNA, 601 bp, Human
cacccctcaaccttaggcatccactgactgactttttgtctgtagttttgcctattctgaacattgcgtattaatgaaatcatattgtgttttgtaactagtggcattcattcagcgcagttttccaaagttcactgatgttttagcatgtatcagtacttcattttttcttattaccaaatatttcattttatggctgtattacattttgcttatcagtttgatgagcatttgggttatttccatttttcagctattataaataatgctgtttgaagatttgtgtacaagtttatgtttkgacatatatgttctttctcttgggtataaacataggagtagaattgctggatcacatggtagttccatgtttatccatttgaggaaaagccagactgttttccagagctactgcatcatcttacattccctccagcagtgcatgagcgtttcagtttttccatgtttttgcccatacttcttattgtctgtcattttgattatagtcattgcagtgggtgtaaactggtatcacgttgtggttttaatttgcatttcctgatgattaatgatgctgagcatctttttatttgtatattgg

SEQ ID NO: 144567 - DNA, 601 bp, Human
atacttactttttgccatatggatagttgtcacaacctcattttttagagtccatcttttctgcagtgatgtgcagaacgaactctcatagtcaagtttccatatacatgtgagtctgtttctggactcaattctgttttgcagcctaattgtctatcttcaccgtcataccacacttccttaattattacagctttatacaagtctcactgtctggcagggcaaatacccctaccctgtatttcagaagttgtttggctgtttgcatgtctaaatgatttaaaaatttggtggtaaggtstttgaggtaccctgttgggggagagttgacatctttatgatattgagcatctttatgatatagacatagtagagttacatgtcacttaacaacaggggtacattctgagagatgctttgttaggcaatttcttcactatgtgaacatggcagggtgtacataggctatacggtgtagcctgttgctcctaggccacaaatctgtacagcatgttactgttctgaatatcataggcaattgtaacacaatggtatttgcatatctaaacatacaaaaggtacagtaaaaatatgatggata

SEQ ID NO: 144568 - DNA, 601 bp, Human
tataatggaaaaacagaaattacagaacatttccattattgtggaaaattctgttagtgctgtggtagagttgtctttttaaatacattgctgaagttatctggctaatctgtgtatgtatgtttatgagttttcatgtcaaacttatacttgtttcattgaaagagatggaatggctgggtgcggtggctcacgcctgtaatcccagcactctgggaggccaaggcagacagatcacttgagctcaggagtttgagagcagcctgggcaatatggcaaaattttgtccctacaaaaaatwaaaaaattggctgggcgtggtggtgtgttcctgtagcaatctcagctactctggaggctgaggtgggatgattgcttgagcctgggaggcagaggttgcagtgagccagtattttgccactgcgctccagcctgggtgacagagcaagaccctgtctcaaaaaaaagaggagaaggtggaaagtattctctttgtttctgtgttctggaatcgtttgtgtaagatggagacagttcttccaaaatttggaacagctcatcaagcctgatgtttctttttgggaagattttaacttagttt

SEQ ID NO: 144569 - DNA, 601 bp, Human
tgcttgagcctgggaggcagaggttgcagtgagccagtattttgccactgcgctccagcctgggtgacagagcaagaccctgtctcaaaaaaaagaggagaaggtggaaagtattctctttgtttctgtgttctggaatcgtttgtgtaagatggagacagttcttccaaaatttggaacagctcatcaagcctgatgtttctttttgggaagattttaacttagtttctttaatgattactgctctattcaggttttacatttcttcttgaataattttttgttaattacatttttttttctaggaaataacatctaaaatagcacatttattggcataaagcaggactcagcaaactatggcctgtcacaggctgcctgcctctttttctaaataaaatcttgctggaatatagccacacctaatcatattgtctggttgctttagtgctataaatgcagagatgagtagttatgacagaaggtatgagccccaagccaaaaacatttactgtctggtcttttaagaaaaagtttgccagtctctggtttgaactattctttatctatcattctttcaatatttcttttaatctctgta

SEQ ID NO: 144570 - DNA, 601 bp, Human
tgactttctttttttttactgacttgattacattttagtcaggaatatgtggtgggtgagatttggattatttttaatttgttgagacatgggttaagtaccagattgtcattagtttttgtaaatgttatatgtgtgcttgaaaagactgtgtaagggtacaaagctctataaatgaccaacaaaacgtacttgttaattaccttgtttaagtcttcttatgtctttactagtttttctagtatataatctatcagtagtggaaaagatgtgttaaaacttgtactgtgccggtggacaygttggtttgtccctccgggtctatcagtttttattattttcatattgtttaatagctgatataaattaatttttttctgataatttgaatcttttaatcattttgtgatggcttctgtatgtgttaaaattctttgtttttaaaaatttgtttggtctgatgagaatgtaggtgcctgttacaacccattgaggttcttgcctgctgcacagaaaaaaccaatatgctgaggcaacaggtattgcagcagagaaagagtttagtcgcagggcagctgagtcaggggaatgggagatagtt

SEQ ID NO: 144571 - DNA, 601 bp, Human
aagtcttcttatgtctttactagtttttctagtatataatctatcagtagtggaaaagatgtgttaaaacttgtactgtgccggtggacacgttggtttgtccctccgggtctatcagtttttattattttcatattgtttaatagctgatataaattaatttttttctgataatttgaatcttttaatcattttgtgatggcttctgtatgtgttaaaattctttgtttttaaaaatttgtttggtctgatgagaatgtaggtgcctgttacaacccattgaggttcttgcctgctgcasagaaaaaaccaatatgctgaggcaacaggtattgcagcagagaaagagtttagtcgcagggcagctgagtcaggggaatgggagatagttcttaaatctgccttgccaagaatttggagactagggtttttaagggtggtttggcaggcaggcaggggtctagggaacgagttctgctgattggtttggttggaaatgaaatcacagggatgtcaactgttttcgtgtgctgaatcagttcctgggtgagggttacaggaccagtttagtcattttcttggtatgggtcaccagccctgt

SEQ ID NO: 144572 - DNA, 601 bp, Human
aagatatcagagttgtctttttgtcctctagcatctcctaatttcatttaaaatttttcatctgtttgtctcttggccctgcattttgggtagtttcttcagttactggtttttgtaaaactagtcgtgtttaatctgcttgacctgtccattgaggttttgaaatcaacagttacttttcattaaagtatttattactgttcagtctcttgttattttcagcagcctcttgttgcttgctgattttgtgatttcatttttaaaagtttaaacattcatattttgtattttggcaatgagrttataatatctgaattcattggggcgtgaatcactcttggtgtttggttttcttatgtgtttgttggtccttgggaaggactcatgttttgttgagcttggtatgtggaaaatttgggtgcctaaactgaggaattttttaactccacagaagatttcagtttgcttctactgagaaattgcttctactgagaaataggatttgtcatctacctgggaactttctagagtccaagctcaattggcaaaagggcaaatgctaatatgcacatttgcccttttgcatctccaagtgcatact

SEQ ID NO: 144573 - DNA, 601 bp, Human
cccaaatgttctgttcatggtgtccttagtgtctcatcattttttcatggagccaaaatagaatacataacagttctgttttagttagatacaagtagcctaataagtatttatggttcaagaattatatgttcaatcaaataaaaacattccctttttatgcttaaatagtgacatatgcttactgatctgatgtgtgtgcctgttgggcatatgcaaagttcttaagtcttggaatcagattgaacactgccacctttgtttcctgttttccactgatttctatctagcacttttttttatcacatcagctgtcccaaaacctagcttctcaaagataatattaccttcaaaaagaaggtagaacaatgatctcatgttcaagtggaactaccttgagctgataagcttacctggtgtctgacagatcttgagaatagctgtattttccttgagaacttaaaatatccctcagtgcctgtgaatttgctgtgatatctaggggactctgagatgtcttgttttacagtttgataactgcaggtgcagtgctttacagtctgtacagtaattaagcagatggatgctatctacattttat

SEQ ID NO: 144574 - DNA, 601 bp, Human
ttggagtgagccgagatcgtgccactgcactccagtctgggcgacacagagagactcccatctcagggaaaaaaaaaaaaaaattatgctctatacttcccattaatttaattatgtagatttttttttggtgttttttattgcccaataggtacttttttggtgtatgttatatttggtgtttattttaccaaatatactattaaacccacacgtgtgcacacacatacacacttgagtataatgcctttcccactcgttagtacattaatattattggctaacactgttatatttttttctttgtaatgactgcataatattccatggtaaagatttaccacacttcatgtagctgttgttcccttttcgatgtcagatttttttttccacttgttttaaacagtgctaagataaatattctagtacatttatattgacatttttattcctgtgagaattggaagagaagtattgctgggttgaagggaatgtgtcattaaaatttaataggtattaacacaaatcttttcagaaaggctgtaataattcacatttccagtaacatctgacagatcaccggttttcaaatttttctctg

SEQ ID NO: 144575 - DNA, 601 bp, Human
ctctatacttcccattaatttaattatgtagatttttttttggtgttttttattgcccaataggtacttttttggtgtatgttatatttggtgtttattttaccaaatatactattaaacccacacgtgtgcacacacatacacacttgagtataatgcctttcccactcgttagtacattaatattattggctaacactgttatatttttttctttgtaatgactgcataatattccatggtaaagatttaccacacttcatgtagctgttgttcccttttcgatgtcagatttttttttccacttgttttaaacagtgctaagataaatattctagtacatttatattgacatttttattcctgtgagaattggaagagaagtattgctgggttgaagggaatgtgtcattaaaatttaataggtattaacacaaatcttttcagaaaggctgtaataattcacatttccagtaacatctgacagatcaccggttttcaaatttttctctgtgaactttcttgacaagagaagttgggggtattggaatacccatcactcaattcagccagagcagctctcttttaacctatttgatat

SEQ ID NO: 144576 - DNA, 601 bp, Human
cgtgtgcacacacatacacacttgagtataatgcctttcccactcgttagtacattaatattattggctaacactgttatatttttttctttgtaatgactgcataatattccatggtaaagatttaccacacttcatgtagctgttgttcccttttcgatgtcagatttttttttccacttgttttaaacagtgctaagataaatattctagtacatttatattgacatttttattcctgtgagaattggaagagaagtattgctgggttgaagggaatgtgtcattaaaatttaatagrtattaacacaaatcttttcagaaaggctgtaataattcacatttccagtaacatctgacagatcaccggttttcaaatttttctctgtgaactttcttgacaagagaagttgggggtattggaatacccatcactcaattcagccagagcagctctcttttaacctatttgatatattgcacattgttataatgttttggttagaagagtttgtttcatgattaaaataagtttgaagaatcattgctccgagttgttcgattttttttttttaaccttttcttttttttctaggtcaaa

SEQ ID NO: 144577 - DNA, 601 bp, Human
gatcaaaggtgcagtaaagttgacagttttttgtgaaaattaggagttcttacctaagttgtcagttggatatagtataggccaggaatatgtatctgaaggcaaagccaggatttaagggaaaaaaaagttctttggcttctttacaacatgaattgagcacctgaagttgtgttctaaactgttttctaaacttgtctgaccataggaattgtctgagacattccttaaaaacggcagaatctgaagcttctccccacacctcctgaatcaaaatttctagaggaggaaccaggatatycttattaaaaacaaagagggaaagaatatcttcaacagatgacactgggacaactggatttccacatgcaaaagaattaagttggacctctccttcacatagtagataaaaatgagctcaaaatgatcaatgatgtaaatgtaagatttaagcctgtatacttttagaagaaaatatgggagtagaattttatgaacctgaatttattagcacaaacaataaaaaatatatattggactttataaaaattaaaaacttttctgcatcaaaggacataagaaaatgaaaacacaacctaca

SEQ ID NO: 144578 - DNA, 601 bp, Human
aaaggacataagaaaatgaaaacacaacctacagaagaaaatatttgcaagtcatatctttaacaaggatttaatgtccagaatatataaagaactacaggtcaatgacaaaaagacaacctaatttaaaagtgagcaatgatcttgaatagacatttttccaaagatacacaaatagacctgtaagcacataagatactcaacaccattaatcattaggaaaatgaaaatcaaaaacataatgaggttacactgcatacctactaggatggctataaaaaaacaaaaccagaaaataackgttgaagaggatgtggaaaaattggagccctcatttgctgatgtagctagctgctgctgtgagaaacagtttggtggttcttcaaaaagctaatcataaagttaccataaacttagcaattccactgctagctgtgtgctgaaaagatttgtacagggactgaaatgggtatttgtacagcagtgtttattgcagcactgttcacagtagccaagaatggaaaccaagtgtccactagcagaagaatggataaacaaaatgtggtatatacatataatattcagtcatacaaataattga

SEQ ID NO: 144579 - DNA, 601 bp, Human
gcggatcttgaggtcaggagatcgagaccatcctgcccaacatggtgaaaccccgtctctactaaaatacaaaaattagccaggcgtggtggcgcgcgcctgtggtcccagctactcaaaagaatttaagctctgataagtgctgtaacaggatgaacctgaaaatacactcagtgaaatttgacagaaaaggacaaatactgtgattctacttacatgaggcacttaaggataggcaaatttatagagacagacagtagaagttaccaggggctggggaaaacagggcatgggatgttaytgcttaatggttacaagtttctttctgttttgggtgatgaaaaagttttggaaatggtagtggttgcacaatattgtaaatataattaataatgtcacttaattgtacatttataaatggtagattctatgttacatatattttacataaaaaaagtattagatctaaaactattgaattgtacactctaaaagatgaattatttgatatgtgaattctgtcttaataaaactatttaagaaaacaaaaacaaaaccagctatccgtgtttggacaacactgtcacaaaacaaagttgtt

SEQ ID NO: 144580 - DNA, 601 bp, Human
tataattaataatgtcacttaattgtacatttataaatggtagattctatgttacatatattttacataaaaaaagtattagatctaaaactattgaattgtacactctaaaagatgaattatttgatatgtgaattctgtcttaataaaactatttaagaaaacaaaaacaaaaccagctatccgtgtttggacaacactgtcacaaaacaaagttgttgattttagccaggaagcatataaggtagatgtaatcagtgagactagattcagattagatttagtaatattaatccgtatrcagtccctcaaaactaatgtctttcaggaatatatcaagtgtttatgtactataatgattttgttaagttttccccattatagggaaatttattgagaaacttatcaaattaaactttttggtggacttgacatcctaatttttcttataacccctcccccagtttactcattattaatattttatttacaaggtacataactttgtaagcagatttgttgaatatttgtttatctttatggatactgtgttacttttaatgaggtagaattaatagttgtactctcatttgtcctgtat

SEQ ID NO: 144581 - DNA, 601 bp, Human
tgcttcagtgagcctcttgcagtccctcatagattcctgcagtcttcctgtgttctagctggtatgtctttgtctttggaaattctctaaaatacaaatctcatttctctttaaatttcttagaaaagaaagaaaaaaaatgacaactgccttatgtgataatgaccagactccttatcagagacttaaagccttagattaactggtcccaatttcttttataacaccttcaccaatatgtgcacatgtatatgtacatgcacagaatctagttgattcacttttgtttcagtacttttttcctttttattccaattagtatcattttgtttatccattcaccagttaatagacatttggattgtttgttgtttttgggcattatgaataatactgccatgaatattctggtaaaagtctttgtgtggatataggttttctcttggatggacacctagaaggggaattgctaggtcatattgtaagtttacatttaacttttttttttttttttgagaacagtgtcttactctgtcacccaggctagagtgcagtggtgcgatctcagcttactgcaacctccacctccagggttcaagcg

SEQ ID NO: 144582 - DNA, 601 bp, Human
ttatctgggtggttctactgatctggaccaggcttagctgattttagctggggttgcttatgcatctacagatatgcctctgtggtcacctggtgatttggttagggctggcttgttcatgatgaccatggctgggacaatgtgcctctgtgcatatacattctaattttccactgggatagcttggacttgccgacatctccatagcagaattccaagagcagtaggtaagctaacccagagcacaaacacttactaaacttctcaatgtcccattgcctaaaagagtcataacgccatytcagattctaggtctgaaaaaacacttttatttcttgatgggaggagcagcaaagtcacattgtaagggtgtagatacaaggaatggaaaaatttgttgtcattttttgcaatctgctagtgactgtggcaaaagcattttgctgatgaggtggagtgtgcgggtggggaactctttggaagccaggttggattaatatgaatagtgaatgggaattgaaagtagatagtatagattactctttgagaagcttgtctgtgaaggtaatttgggagagaggacaatacctgaggcagggga

SEQ ID NO: 144583 - DNA, 601 bp, Human
aaaaatttgttgtcattttttgcaatctgctagtgactgtggcaaaagcattttgctgatgaggtggagtgtgcgggtggggaactctttggaagccaggttggattaatatgaatagtgaatgggaattgaaagtagatagtatagattactctttgagaagcttgtctgtgaaggtaatttgggagagaggacaatacctgaggcaggggaggtatttgtagtctaaacaggtatgttgtattttctttcccttcctgcctgaatgccttccatccatccaataacagaatatatttgmatgctgagagaaagtatctagtagacacagaggatgctgatacgggggaaagaggagataactaatcaagtaaaagtctttgagtagaggatgggattttgtgtgcttatgaaggggttagtgttttgatgtgaggagggctatttcctttctggtattagggaagagggagggaaggaaggaatggggaaggagggaagggagggaatgggtgcaaatgtacataggcatgtaaattgggtaataagaggctgagggtttccgtttgatggcgcttctgttttctcaatgaagcaacag

SEQ ID NO: 144584 - DNA, 601 bp, Human
aatcactataggtatttcattaaggtttagtgttggtatctcagctcaccctactcattttctttactcatcttgtaaacccataaagcatgaacaataaattgttctaaaaatattttctcattttacactttttttctagaactttagatgtataatctacagttgccttctagagcaaactttatttttcccaagacttaatctctctctctgggttttcccccatctccattacaacgagggcagagctctttcttgtacatttgctcatcattgtattcctagtacttagtgtatygcaccaagcaaattctcaataaatatttaaataaatggccttctaggaacaaaggtttcgaatcttataatcatgttctgcttctctggtataatcattcgtaagtcgttgaatcagttttcttgttttgtagtcattgcctacagtcagttcctcattacttctttcttggaattttgcagtagttttctaacttgttttaatttctcctgtgtctagctctactttttgctgtaaccataatttcttcgaatagttctggtcgttcattcattcattatttcctgagtgcctactact

SEQ ID NO: 144585 - DNA, 601 bp, Human
tgatagtaggtatgttcctgtagttcctgaacacaaagcttttaatggattgtcagtaaacattatttatgctgtagggtgtttatagcatcctacttatctcagataaaggaaactttcacccaattcttagtttactaaacttgtttcttgtttcgtttttgttttacagtcatgagttgttgaatttaccaaatttttcttaatttattgagatttgaaaaaatctgtttagtatataatttaaatatgattttctttttaagcctgttgatgtgatgaatttaaccttgccttcccrggataaacacttatgaatatattgctgcatttggtttcctaatattttgtttaggagttttgcatttatgattaagatttgtctgtgatttattttctctgattgttcttttcttttttcttttcctttttcagatacagactctcactgtgttgcctaggctggagtgcagtggcacaatcatagctcactgcatccttgaactcctggcctcaagtgatcttgtcacctcaacttggctaattttttattcattttaatttttttgtaggggcaagatctcgctttgttgccctggct

SEQ ID NO: 144586 - DNA, 601 bp, Human
ccagatgtttgtaatgttaatccatattattgtgtgaggcaatgatttattctctcatggctgtgtttttttttttttttttttttttgcccccattgtatgactatactacaaattgctattcattctagtgttgatggtcatttgtgttttctgttttggcaactgaatggtattgctgtgaacatttttttatatgtcttacggtggacaaactatacgtttctattgagtaaataccacagagtgaatctggggcctatttatcttttttttttttaacttgatatttagcttaackggttttagtgtttgcatgacataattttccatccttttactttcagcatgtatccacttttttcattgtcttttaaggtgtttatgttgaaatttaaaaatcttttcttttaacctgattgtgtatattacatacacatatagtacttagtatgtgctaagcaatgttgtaggtactttatatataaatacttacacctcttagttttcatttggctaatttgcccttattttactctgcacttaaaaattatactccttggttgtaaacttctagatttgcagttatattctttctctg

SEQ ID NO: 144587 - DNA, 601 bp, Human
tatttaaacctagctttacatcttgcttcagatttttttctcaagcatcctgataaagatgttcgcttactggtagcctgctgccttgctgatattttcaggatttatgctcctgaagctccttacacatcccctgataaactaaaggcaagtactgatttaaataactccaagattgaccgatactttgatttatctttctaactaaaatgggagttaaggtatttagatgatttccttggattctttgacattagctacagtaatcttttgctaaacttaatgttttttttttttttttagaacttatttttgaaaaactttctggtcttgaggttaagaagtagattaatacagtgtgtattttttttatatcatgtcatcattagctctgtttctttcattataattttgggggcaattccttttcacttttgaaaatccatattgaagaccatggccattatttaaaacataatacctagtataaacatgagtttataatatataatcctcatttatttaatggaaggtgtgatataaattgttatatttgtgttataaattgtgttatacattgttatgaagaaaatacaggcca

SEQ ID NO: 144588 - DNA, 601 bp, Human
gactcatggagttcttgataactgaagtgaggaatgtgcttatttgatcaagtctaccacaattcaagtagaggatgtgcaacctgttttgggcatgcttgttttaaattttgattggtgaaagaatcttaggatgagggaggtagagggcaatatttgtcatttaaaggtggtattgaattgtaagatttgagaatggtcggagacttaaagtagataacatgagctggtccatgtagttgtatacccaggtactagcttgatttctaaatgtgaatttctcatttggagatacttaatyggtttaaggaatgattccatttgtttgatagtggctgtggctctcccgtactagatgtcttgttggcattctcatgacgaggaagtctaacttaagactgctactgtacaatttatttatctctcttggggatctttcagtttgcataatcaaggacctatttcagggctttgggggtaacgagaaattctccctaaagaatagctacatatctgttctgtttctaacaggacaatttatgagaagactgtaaaagagctgaaattagggtctttgtgcattattccctagctgaaaaat

SEQ ID NO: 144589 - DNA, 601 bp, Human
tcgctacatagggtcaatatggcgtgtgtactctttcagcaatccaggaagggttcattcatagagaacatattttccacagtactactatcaaagtaactttttttgttttaagtaacctttttttttaaaaaattgtgttttaggtgcaggggtacatttgcaggtttgttatgtaggtaaattacatgtcatgagggtttggtgtacagattattttgtcacccaggtaaaagcatggttcccaataggtagttttccgatcctcaccctcctcccaccctccaccgtcaagaagatkctggtgtctgttctcttctttgtgttcatatgtactcaatgtttagctcctggtgataagtgagaacatgtggtatttggttttctcttcctgcatttgtttgcttaggataatggcttccagtggcatccatgttgctgcacaggacataatctcattttttatggctgtgtaatagtccatggtgtatatgaaatattttctttatccattttactgttgaatggcatttaggttgattccatgtctttgctattgtgaatagtgctgctacgaacatatgcatacatgcgtctttat

SEQ ID NO: 144590 - DNA, 601 bp, Human
taattctgtcagtggagtgttaaagcctcccactattattgtgtcattatctatgtctcttcataagtctctaagaacttgctttatgaatctgtgtgttcctttgttggatgcatatatttttaggatagttaggttttcttgttgaattgaaccctttatcagtatgtaatgctcttctttgtcattgttggtttaaagcctgttttgtctgaaattagaatagcaacccctgctttcttctgttttctgtttgcttggtagatttttctccatccctttactttgaccctatcagtgkcgttgcatatgaaacgagtctcttgtagacagcatacagttgggccttgcttctttaaccaactgaccacactgcaccttttaattgaggcatttaatgtgtttacattcacggttaatattggtatgtgctggtttggtcctgtcatcatgttgttagctggttattatgcagacttgattgtgtggttgctttatacaaatgtagatacaaatgcagatatagtaataagtcaaaaatatgagatgggaatagatttagaaagatggggaaaagcaggtaattacaatgattggtagg

SEQ ID NO: 144591 - DNA, 601 bp, Human
ttaaagcctcccactattattgtgtcattatctatgtctcttcataagtctctaagaacttgctttatgaatctgtgtgttcctttgttggatgcatatatttttaggatagttaggttttcttgttgaattgaaccctttatcagtatgtaatgctcttctttgtcattgttggtttaaagcctgttttgtctgaaattagaatagcaacccctgctttcttctgttttctgtttgcttggtagatttttctccatccctttactttgaccctatcagtgtcgttgcatatgaaacgagactcttgtagacagcatacagttgggccttgcttctttaaccaactgaccacactgcaccttttaattgaggcatttaatgtgtttacattcacggttaatattggtatgtgctggtttggtcctgtcatcatgttgttagctggttattatgcagacttgattgtgtggttgctttatacaaatgtagatacaaatgcagatatagtaataagtcaaaaatatgagatgggaatagatttagaaagatggggaaaagcaggtaattacaatgattggtaggaagcttgacaagttgactt

SEQ ID NO: 144592 - DNA, 601 bp, Human
agctctcagtcattgcaacattttttattctaaaaatagcataaattttagctatctcacttttcaggtttatttgtttaacttttgctataagatgaagttttttgactttaagattatggcaaatgatttactgttttcctatgaaggatagtaagatatttaatgttgttcatataaaggtgtacttttaaaaaattttagccaaataaaatttttttctggttctttatagtttattatgatatgtacacatgagtgctgaataaactcttggagtttcatggttattttcatttarcgttcataatctaaatggcactttgtctttttttatttaaggatatatttatgtttataacaagacagttgaaggggctagaggatacaaagagcccacaattcaataggtatttttatttacttgaggtaagcaatatcttgtatcttgagatgacattttaaactgatttttttgtttgtatatttttaataatcaaaatgcttaactttcacttttttacaccttatttttagaacattgcttgggtcaagtcatataacatatgctttgagttagaagatagcaatgaaattttca

SEQ ID NO: 144593 - DNA, 601 bp, Human
tttttgactttaagattatggcaaatgatttactgttttcctatgaaggatagtaagatatttaatgttgttcatataaaggtgtacttttaaaaaattttagccaaataaaatttttttctggttctttatagtttattatgatatgtacacatgagtgctgaataaactcttggagtttcatggttattttcatttagcgttcataatctaaatggcactttgtctttttttatttaaggatatatttatgtttataacaagacagttgaaggggctagaggatacaaagagcccacarttcaataggtatttttatttacttgaggtaagcaatatcttgtatcttgagatgacattttaaactgatttttttgtttgtatatttttaataatcaaaatgcttaactttcacttttttacaccttatttttagaacattgcttgggtcaagtcatataacatatgctttgagttagaagatagcaatgaaattttcacccagctatacagaaccttattttcagttataaagtaagtttattttattaagtatgtaacattaaaaaaaggtaacaaattttgaacttgtaggtgaatc

SEQ ID NO: 144594 - DNA, 601 bp, Human
aggagtggcataaggccagtgtaaaatttttttggattgcattatttgtctataaaacatacatactgacttcttaatgcatatggctatttgagctttttgtgtatgctttaaaattatttactggaattaacttcagagcaattcaattttctgaatttaaggcagaactgaagttgcttttgatgtaattacttttgattgtgagactggttaaaaattagggaaaaatctaagaaatgtagtgtaaaaatataatttgtatacttttgtatgatgtgggagagagggaagctttaartgaatatacatagaattttatttaatattttagtattatttttgtaaagcataatgcttgtcagtgtcatcttaagagtaaatcctgtatatctcagttgtaattgaaacaaaatctgttttgaattgcagcaatggccacaatcagaaagtccatatgcacatggtagaccttatgagctctattatttgtgaaggtgatacagtgtctcaggagcttttggatacggttttagtaaatctggtacctgctcataaggtgagtagcaatgtatactgtaatgtgtctaatgcccgttaa

SEQ ID NO: 144595 - DNA, 601 bp, Human
ttggggaaaataaacccacccttcctgattaaacattttctccttggccttgttgtagggagaggacctgtaggtacttccagaaactagaatcataggatcttccaaacttcctgtctctaagtacaggagctggaatctttccaccaagtacttatagattcaatcttttgcttagtccatttagcttagggtggaaatttctcaaggcaattactgttttgcagccctttgcataacttgcatagctccttgtagtttagtgaatgacactgaataaaacattctgacaaaatttttwaaaaaaattataaatactcttgaaaggagtaatgataagaggtaaaaaatgtaataactagacatattaaaggagaaaattaggagaaaaactcattagcaatgaaaaatggctgggtgcagtagctcatacctgtaatcccagcactttgggaaaccaaggtgggtggatcacctgaggccaggagttcaagaccagcctggccaacatggtgaaaccctgtctttactaaaattacaaaaattagccaggcgtggcagcatgcgcttataatcccagctactcaggaggctgaggcag

SEQ ID NO: 144596 - DNA, 601 bp, Human
agtgacattccatcaaaaccctaagttagtaatttgaaaaatgttttaaataagcaaatgcttggaaagctagatcacaaaaaaggaaatggtgtctatgtacagttttagaatgaaatgagaaacaatggacatgaaaaagatcaaaagacaattccatgaggaatattttatgctaacatatttgaaattagaataaattcctagaaaatataacctggcaaatttgtcttgagagaaaatcaagacaaatagcctataaccaatacatttagttggttttaaaaactctgcctataaracaaaactcttcttttcaaacaacaatagcaacgataatagcagcaaaaataattacagcagcagaactcaaaccaacaacaaaagaacctgtaaacccgttaccagggatttctgttgattatttaagtggcaaatattcctaactttcagcacacttccagattatagaaaggactactccataactcattttatgagcagagaataatcttcctagggaaaccaggtgcaaaccaagcaagaaaaaaaaaaaaaggctaattgattcccaatataaaatagtaatttccagaatgat

SEQ ID NO: 144597 - DNA, 601 bp, Human
ctgattccctgtagtccattatatcactctgtgtgcctttgtgtacctatagttttgtttccacttataaatgagaacacacagtatttggtttcccattcctgagttacttcacttagaataatggcctccagctccatccaagttgctgcaaaagacattatttcattctttttatcgctgagtagtattccatggtgtatatataccatgttttctttatccactcatcagtcagtggacagttagattggttccatatcttaagcatgctatttttaatcctcattatagtaggtgygttatattagtggaataagacaagacatacaatataagaggattggaagaaactgaactgaaatatgattgtgcagaaaacacaaaatggtgtacagacaaatttatagaaaatataagaacattctagaaggttgtgagacataaggtacaaaaaccttctagcataatttcaaaaaattttcatttgtagctttaacaaagatgtgaggtacttagaaatttaaccgtaatgtgtatcacctttatgttgaaaattgttataattgactgaaaagcataatagaagacttacatatgt

SEQ ID NO: 144598 - DNA, 601 bp, Human
ccatgttttctttatccactcatcagtcagtggacagttagattggttccatatcttaagcatgctatttttaatcctcattatagtaggtgtgttatattagtggaataagacaagacatacaatataagaggattggaagaaactgaactgaaatatgattgtgcagaaaacacaaaatggtgtacagacaaatttatagaaaatataagaacattctagaaggttgtgagacataaggtacaaaaaccttctagcataatttcaaaaaattttcatttgtagctttaacaaagatgtraggtacttagaaatttaaccgtaatgtgtatcacctttatgttgaaaattgttataattgactgaaaagcataatagaagacttacatatgttgagagatttactgtttatggaaggggagacttagtatcataatgatgtcaatcttctgcatactgatcaataattcaatcaaaaatagaaaccgaggccaggctcactagctctctctcattatcccagcactttgggaagccgaggcaggggaatcacttgagctcaggagtttgagaccagcctgaacaacatggcaaaaccctg

SEQ ID NO: 144599 - DNA, 601 bp, Human
aaaatataagaacattctagaaggttgtgagacataaggtacaaaaaccttctagcataatttcaaaaaattttcatttgtagctttaacaaagatgtgaggtacttagaaatttaaccgtaatgtgtatcacctttatgttgaaaattgttataattgactgaaaagcataatagaagacttacatatgttgagagatttactgtttatggaaggggagacttagtatcataatgatgtcaatcttctgcatactgatcaataattcaatcaaaaatagaaaccgaggccaggctcactrgctctctctcattatcccagcactttgggaagccgaggcaggggaatcacttgagctcaggagtttgagaccagcctgaacaacatggcaaaaccctgtctctagaaaaattagctgggcaagtgacgcatgtctgtagtcccagtgacttgggaggctgaggtgggaggatcgcttgcagggaggtcaaggctgcagtgagctgtgatcacaccacggcactccagcctgggtgaccaagtgagactctgtctcaaaaaggaaaaagaaaaaaaaaagaaagtgatagcatgtgcactt

SEQ ID NO: 144600 - DNA, 601 bp, Human
gttagcaagatattctgtttgtttctactgatagaaatagagttaaatgtaattagataaaacatatggaacttttcattattcagagacgttgcttacaggtttttggagcttaaattgatttgtacaagaagaagatatgaactaatattaagacctagaaattgaaggcaagtatgaatggcagtagtgatttagtaaaagttgcttatctattgctattcctggggtagattccatataaatctatcttttctggaaaaaaggaacaattgtaataaaatgagacctttcagtatcwccccaaatctacttacttatggttgactatcttgtatttatttttagaagaaatattttttagctgctaggttcactgacagaagtttatggtaagttttattttctctccacagttcttttgagttctacagatttaggtggcagtattcatattatattctgtgtgaatggtgcctcctggaatacaaatgtagagtacagtgttaatggtggcccttggaattgtgtaacagttcagtccctccacctgcttttcagtttcactcacctccagacaagtaaaggatataaatttgca

SEQ ID NO: 144601 - DNA, 601 bp, Human
taaataaagaaaaaaaggctgaggaaatatttttaacaatcccagaatacatcaaggtaaaaacatttctttatcacttataccttgtgttaatttcctgttgttcttgcttgcagaaatagaatccttcccccatgaactccccaaactttcatattatgtctttatcaaaagctggggagcaggggccagagtgttctgagtacacattgaattatatactttgtctcagtacgttgtccactattttcttatttctccctgttttcttgttccttgccttatttgaaggttagctagraaataagaattgctttttccctccctttagttcctttttgtctacttatgtttccatttcagacctttataattacatgtaaaatcactttctagtggacttaatcgtcttgtagtagggtaaaattagttcagtcttagaaatcattcttagcccttttggacttacagttaaaacagctattatttactcatcctcctagttgagaattaacaattaaaaataggagtaagatactgagataataaccccacttctctcttctgtttttctttttcattcacacatacagacacattc

SEQ ID NO: 144602 - DNA, 601 bp, Human
tgcttgcagaaatagaatccttcccccatgaactccccaaactttcatattatgtctttatcaaaagctggggagcaggggccagagtgttctgagtacacattgaattatatactttgtctcagtacgttgtccactattttcttatttctccctgttttcttgttccttgccttatttgaaggttagctagaaaataagaattgctttttccctccctttagttcctttttgtctacttatgtttccatttcagacctttataattacatgtaaaatcactttctagtggacttaatcrtcttgtagtagggtaaaattagttcagtcttagaaatcattcttagcccttttggacttacagttaaaacagctattatttactcatcctcctagttgagaattaacaattaaaaataggagtaagatactgagataataaccccacttctctcttctgtttttctttttcattcacacatacagacacattcttttttttttttattcgatagtatttcttacatatcaagacttaagaaatcactgtggtggtataggttatttatgtattaaaatttgttgttgttgttgtttgaga

SEQ ID NO: 144603 - DNA, 601 bp, Human
gctttttccctccctttagttcctttttgtctacttatgtttccatttcagacctttataattacatgtaaaatcactttctagtggacttaatcgtcttgtagtagggtaaaattagttcagtcttagaaatcattcttagcccttttggacttacagttaaaacagctattatttactcatcctcctagttgagaattaacaattaaaaataggagtaagatactgagataataaccccacttctctcttctgtttttctttttcattcacacatacagacacattctttttttttttwattcgatagtatttcttacatatcaagacttaagaaatcactgtggtggtataggttatttatgtattaaaatttgttgttgttgttgtttgagacagagtcttgctctgtcacccaggctggagttcagtggtgtgatcttgttacactgcaacctctgcctctgaggctcaagtgatcctctcacttcagcctcctgagtagctgggactacaggaatgaaacaccatgtctggtgaatttttccttttttaaaaaactttttgtagagacagggtttcaccatgttgcccaggctgt

SEQ ID NO: 144604 - DNA, 601 bp, Human
ttttccctccctttagttcctttttgtctacttatgtttccatttcagacctttataattacatgtaaaatcactttctagtggacttaatcgtcttgtagtagggtaaaattagttcagtcttagaaatcattcttagcccttttggacttacagttaaaacagctattatttactcatcctcctagttgagaattaacaattaaaaataggagtaagatactgagataataaccccacttctctcttctgtttttctttttcattcacacatacagacacattcttttttttttttattcgatagtatttcttacatatcaagacttaagaaatcactgtggtggtataggttatttatgtattaaaatttgttgttgttgttgtttgagacagagtcttgctctgtcacccaggctggagttcagtggtgtgatcttgttacactgcaacctctgcctctgaggctcaagtgatcctctcacttcagcctcctgagtagctgggactacaggaatgaaacaccatgtctggtgaatttttccttttttaaaaaactttttgtagagacagggtttcaccatgttgcccaggctgttct

SEQ ID NO: 144605 - DNA, 601 bp, Human
cactgcaacctctgcctctgaggctcaagtgatcctctcacttcagcctcctgagtagctgggactacaggaatgaaacaccatgtctggtgaatttttccttttttaaaaaactttttgtagagacagggtttcaccatgttgcccaggctgttcttgaattgctgagctcaagcagtccgcctgccttggcctctcaaagtgctaagattataggcgtgaaccaccatgcccagcctaggttatttttttttaaatagaatttgttgtaacacaacaatccaggaagctaaacagtacrtatatatttgtttaaaaggtaagatggaatatcaagaacaaaaagtacatggtgataattctaaaaatttcctacacgcatcacttcttaatgatgttatttttcaccagttctttttttatcacaaattttaggatatggcaaaaaattattttgttggactgaaaaaagtacatccaatccttgttggaataggtaaaatttggttaaattgcttaattccactgagcctctgtttttgcacctgcaatgcttgggtggtggtggagaatgtgttatttaatgtgaaatattttgtaa

SEQ ID NO: 144606 - DNA, 601 bp, Human
tgtttttttatggaatttgtgagaaattaaaccagggaatgatttttttcccttaatttttcaaataagtttttcccagactgttagaagaagatgatgatggtttgaccacttgggtggtgagattgggaaggattattgttctttattaaggaatatactatttattaagtaaatagtacttgttttactattttttaagcaggagaaaatttgtgaatggaagcaaaaaagccactttattttcagcctgaataagaaattaacctttgatgtcatgaaattctcttcccataaaatkgataaataggaaggacaaacaagttctttttaaaaccaaaaaagaaagaatagcaaaatagaatttgttcttctttcttcatggctaggtagtctggtctgattcatagacctaaaaaagtcacataaaaacaacccaagaagtaaaagtaagcagaaaagacatagaaatatgaaatcctccactctgtactttcagtatagaaagctaaagcctaattaagccagttgtgtgttaactgtcacagaagagattagggcagcttgtgtggtataaagaatccttgactccttctccgct

SEQ ID NO: 144607 - DNA, 601 bp, Human
tgaaagtttgtttgctttttatatagttgtgtgaattttttatttttttgagacaggatttttttttgttttgttgcccaggctggagtgcagtggtgtgatcttggctcactgcaacctgtgcctctcgggatcaagctactcttccacctcagcctcccaagtagctgggactacaggcgtgtgccaccacccctgctaatttttgtattttttggtagagacagggtttcaccatgttggccaggctgatttcaaactcctgacctcaagtaatccacctgcctcggcctcccaatgytgacattacaggcataaaccaccacccctgaccgagtgaaattttttggtagcatgttcctaactgttttgacattaaattatgctgtaaaattgagcagaattggacaatatagttttctttttcaaatcattacaataaaattaagtaaagctggttataattattaatctttgtggacccagaaaagttcttaaatgatgtttgtgtctaaaatttttgattttctttcaaaaacaaaacagtccacattggtaatgtgaacaccccaagtagccagtaaataagtattcttcttat

SEQ ID NO: 144608 - DNA, 601 bp, Human
aacctatgtaggaactatgctgtagaaattctagcttcaggccgagcacaggccaaggtgggcagatcacctgaggtcaggagatcaagaccatgctgaccaatatgaaaccccgtctcgactaaaaatacaaaaattagctgggtgtgatggcatgcgcctataatcccagctactcaggaggctgaggcaggagaattgcttgaacctgggaggcagaggttgcagtgagctgagattgtgccattgcactccagcctggtcaacaagagcgaaactctttatctcaaaaaaaaaaaawaaataaataaataaatgaataaaacagcagatattttaccagtttcatcctttttgggagacatcccacttggagctttctgatttcctactcaaatttgcagtgcttagacagcttgctctgagcttctgctctacagcattgaccttagggccatccattcttcctcccatctttgctctccccttccatcctcctcccttctttttccctcctttcctcttcgtctgtgagtgtgtgtgtgtgtgtgtgtgtgtgtgtctgtttctacacctcccctttctccttccctttttctct

SEQ ID NO: 144609 - DNA, 601 bp, Human
acccactagctccactcattaatcagtgaacttgagaggactgtatcttgttatgtttgtgtttcatactgcatggaatatattaggcactcaggaaatactttaatgaatgttcattctgttcccctcctgattgccataatggcatctaagcctcatttaggcataagagtaattttggtgaaggatgagactttttgacttatttaagtgctaattatcaaagaaagtgggaggcctgcctattggttgttggaatatctttgactaggtaaattctttaaaactttgtaggccaggygcagtagctcacatctgtaatcccagcactttgggaggctgagacgggtagatcatgaggtcaggagatcaagaccattctggctaacatggcgaaatcccgtctctactaaaaatacaaaaatttagctggctgtggtggcgggcgcctgtagtcccagctactcgggaggctgaggcaggagaatggcatgaacctgggaggcagagcttccagtgagctgagattgtgccactgcactgcagcctgggtgacaagagtgagactccgtctcaaaaaaaacattgtaacgggttgatc

SEQ ID NO: 144610 - DNA, 601 bp, Human
ttgagaggactgtatcttgttatgtttgtgtttcatactgcatggaatatattaggcactcaggaaatactttaatgaatgttcattctgttcccctcctgattgccataatggcatctaagcctcatttaggcataagagtaattttggtgaaggatgagactttttgacttatttaagtgctaattatcaaagaaagtgggaggcctgcctattggttgttggaatatctttgactaggtaaattctttaaaactttgtaggccaggtgcagtagctcacatctgtaatcccagcactktgggaggctgagacgggtagatcatgaggtcaggagatcaagaccattctggctaacatggcgaaatcccgtctctactaaaaatacaaaaatttagctggctgtggtggcgggcgcctgtagtcccagctactcgggaggctgaggcaggagaatggcatgaacctgggaggcagagcttccagtgagctgagattgtgccactgcactgcagcctgggtgacaagagtgagactccgtctcaaaaaaaacattgtaacgggttgatcatgccatctcccttgtttaatactctcgttg

SEQ ID NO: 144611 - DNA, 601 bp, Human
ctcaggaaatactttaatgaatgttcattctgttcccctcctgattgccataatggcatctaagcctcatttaggcataagagtaattttggtgaaggatgagactttttgacttatttaagtgctaattatcaaagaaagtgggaggcctgcctattggttgttggaatatctttgactaggtaaattctttaaaactttgtaggccaggtgcagtagctcacatctgtaatcccagcactttgggaggctgagacgggtagatcatgaggtcaggagatcaagaccattctggctaacrtggcgaaatcccgtctctactaaaaatacaaaaatttagctggctgtggtggcgggcgcctgtagtcccagctactcgggaggctgaggcaggagaatggcatgaacctgggaggcagagcttccagtgagctgagattgtgccactgcactgcagcctgggtgacaagagtgagactccgtctcaaaaaaaacattgtaacgggttgatcatgccatctcccttgtttaatactctcgttgataatgctggttgtgcgtggaggataaatgggcaagaagcacatggttttcccttcaa

SEQ ID NO: 144612 - DNA, 601 bp, Human
ctgtggtggcgggcgcctgtagtcccagctactcgggaggctgaggcaggagaatggcatgaacctgggaggcagagcttccagtgagctgagattgtgccactgcactgcagcctgggtgacaagagtgagactccgtctcaaaaaaaacattgtaacgggttgatcatgccatctcccttgtttaatactctcgttgataatgctggttgtgcgtggaggataaatgggcaagaagcacatggttttcccttcaaatctataggtatccagaacaatttattttaaccgataaatttaractaatctttattgaatatttcgttgtggtattaattagtgaaaagggccaaaaggcatgaagagggaaaggatatttgcattgttcataggatagtagccttctaaataccttttttctcagctagacttagaatttgagctgtttttgtgtattgttgggatcataatgtatatttttgatcatcatgttatattgtatggttgcttggttcattcatataaaaattgagcactgaaaaataattgactatatacatgttcttggtaatattagaatatgatgtatctttaaattctc

SEQ ID NO: 144613 - DNA, 601 bp, Human
gccaatatcatatatgcctttaatacatcttaattactattatttgtaatagtgtaagtatgctcaatatagaccacaattagaaaaaaattatgagggatgggggtttatccatttaattctgtctttgtcttttaatgtttggtttcttgagctggctgcagtggctcacgcctgtaatcccagcactttaggaggctgaggtgggaagattgcttgaggccaggagttcgagaccagcctgggcaacatagaccctgtttctacaaaaaacaaaaataaaaaattagctaggtgtggyattgtatgcctgtagtcccagctactctggaggctgaggtaggaggattgcttgagcccagttgttcatgactttggtgagctgtgattgcaccacttcactccaacttgggcaacagagatcctgtctctaaaaatgcatgaacaaaaattttggtagcttgtttttcctcaccaattttaagtcacagtatgtagagtatgattagcttttgttttcaggcatagatgataggtttaagacattaaagcattaaagttctttacacatgttgatttttctcccatactttacatggta

SEQ ID NO: 144614 - DNA, 601 bp, Human
tgtaattttcatttgtaccactgtttaatgagacttttaacttcatttcttccatggaaataattatattttctgtttatgttttatacagaaatagtgaggacaaggttgtagaggggagaaatacacatttttttttcctacctgctgtatttcaggcactggaatttgtattatgtataactgcttttgtgctacagtggaaaagtaggttgcagagagatctgattgcccacaaagcttaaaatatttactgtccggccttttacagaaaaagcttggcaaccctggtttaagtgayatttttcctgttttacatatgatgaaataaatcacacaaatgttaagttccacagaatcacacaaggaataagagggagccaggattcgcactcaatcctgcttggttccaaagcttgttctttttccactacacgtagtaaaatacattactctcatatttacttttattacttgtaaacttttctctggaattgaaatacatcctaaaattgttggtttgtcatagcctaattggtggctctttttctcatggcaaaattaattgatggcctcttaaattggatgaaatatggtattt

SEQ ID NO: 144615 - DNA, 601 bp, Human
tcaatttaatatacacatgcaagagtttctctgaggtatgaatatgagttattctcaaatttagctacttattgaaatcaccctgggaggtttaaacaattgacaactaagtccctccttcagagatagttacttcatttgtccggagtgtagtctgggcagtctgatttttagaaaagcctttcaggagattttaatgggcaaccaaggttcataatcactagtatatagctaggagtggagtttctatgtgccttttcatcattgtaaactagtgtcaaattgttttccaacatgattrtactagtttatactcctaccagtggtttatggatttctacgtcctcctgtgtattatcagacatttaaatttttcctaatcttatgagtatcaaattttcttatctttaattttcctgaatgcaggtaatattgatcttttatagttttatggtccattaatgttctgatttcaccacactccccactactacgtattgcaacacctgttcctctttatgcatttaaattacattctagtcctgaagtcatttgaatatatgactttgacttaatttgaaagggacttaaaaatagctgc

SEQ ID NO: 144616 - DNA, 601 bp, Human
atcttatgagtatcaaattttcttatctttaattttcctgaatgcaggtaatattgatcttttatagttttatggtccattaatgttctgatttcaccacactccccactactacgtattgcaacacctgttcctctttatgcatttaaattacattctagtcctgaagtcatttgaatatatgactttgacttaatttgaaagggacttaaaaatagctgcttgtcaggcatgttcctggtaagaacttgtttggttagaattcctcttatttgttgaaagagccatatattttattctytgactacttttctttggggaagacaaagtatttcttagatttcagactttttatgtgaatcagtttttgaataagctcctaagtaaactaaatatcttgattattgaaaaagagaacagtgtgtacttccacctctcacaagttccccagaactcctattagcgacagtagtagaagatggtatcggggtctttgttgtgatcttctcttttattaaacaagtttgcgtccaaatagctttttttttttttttttttttttttttgagatagagtccgatgggtgacttgtcagttggga

SEQ ID NO: 144617 - DNA, 601 bp, Human
attgttaaagggcagaattaaaatattaaacgatgttctttgtctattaaaagaaaaagagtttcttatatgcctctgtgttactgctttttggcagtgcttcatatgtatggtaatagaggttaatagaagtgtagaataattgaaaacaaactgatgaaaagttttccttgtttttggagatttccttaaaaatttttaattgtgtggctctaatctgtaaccaagtgtttcattaattattctctatatgttaatattatttatatattataatatattaaacgacattataatacartattgttgcttatatatcgagtacctgtatgatttttttagatttaaatttctgcctgagaacaatacaactattaagagaacatcagagtttttgacatataaaaatattcacttataaataattccagactgtttacaatttaaataagatttgtcttaagaaaaagtatccccattctctcataactaattcttctttttatgtttttgattccatttcatccttcctgctacaacaccttacgctgtcagttattcctttatttctcaaatttataatttctccagttaattccta

SEQ ID NO: 144618 - DNA, 601 bp, Human
tccttaaaaatttttaattgtgtggctctaatctgtaaccaagtgtttcattaattattctctatatgttaatattatttatatattataatatattaaacgacattataatacaatattgttgcttatatatcgagtacctgtatgatttttttagatttaaatttctgcctgagaacaatacaactattaagagaacatcagagtttttgacatataaaaatattcacttataaataattccagactgtttacaatttaaataagatttgtcttaagaaaaagtatccccattctctcrtaactaattcttctttttatgtttttgattccatttcatccttcctgctacaacaccttacgctgtcagttattcctttatttctcaaatttataatttctccagttaattcctaccctaattcgaccactgattatttcttttgatcttgctgtgttatatttgattccattctttccctctacacattatcagttgcttagtcctgtgaatttcatctcatctctgtcatctccttttataatttgaaccttaaattatatagtagtaatattctagaaagatttttattctgttttg

SEQ ID NO: 144619 - DNA, 601 bp, Human
tttgaaccttaaattatatagtagtaatattctagaaagatttttattctgttttgttatttaaatgtgtatgtttgtgtttttcagagcattgaatgaaatgtggaaatgtcaaaatctgctccgacatcaagtaaaggatttgcttgacttgattaagcaacccaaagtaagtaagaattttttccttcaatgttttttaaaacacatgtattttaattactatttaccattgctgctatgtgttaaacaattctttctgtttgcaaaagttctgattgtagaagttaggattccttgyttagaaaactctgaatttttaagaaacttattagatagaaagtgataaatgtttatatctgcaaaaggtaatacccaacattacagagagtgtgggtctgtgtactcaaagttttttggtagctttaaaataaaggtgtaacaataactcagcattattgaaagcatagaaaatcgaaagaaattgcactttatgttgccactctaagatgttccctacttttttgtatatgcttgtggttttagaaagtttcaataattatgtaattaaagttaggtatcttgatgtttttacttaata

SEQ ID NO: 144620 - DNA, 601 bp, Human
caataattatgtaattaaagttaggtatcttgatgtttttacttaatatttatgaagattttaatgtactacctagtatttataatgtaatgatggtattcatccattggatgtatcatattttatcttttatcaatcatttagaatgattctagggttttttttttttcattgaaatgctgtatgtagacatgtaaaaggcataattcatctaaaaagcagtgcgcctggtcattttaaattgccttcagggaaaacaagagtattcttttttctttttcagtttagagtgctttttctmaatctcccttccacacatacacttcataggacagaggtcaatggagcagtgttgttttcatctaaggggtgaaaactttcaccttttccctaggcataaattcaccaattgctctacaaatcaaaaaactcacaccatttgagtggtttatagtgaccctctcactatttttttaaaccttcagatcactagtaataagacattttgtaccaccttttttgcctaattgaagctcacatttgagtagtatttttgttttataggttaacaatgacctctttgtgttttattgaacataac

SEQ ID NO: 144621 - DNA, 601 bp, Human
aatataactttgtttttgattctcactgttcctctaaaatttatgtatttagttggagcttcttcattttgcctgttgttaaaaattgggagggtcttagactttcctgctgagtcatacatgaaatcactagatacagtctcaattcagctagaatgttttagttcttttctacagtgtggaattttctttttgcttgtcttaaaataattacccagttatccacagtaaagatggagttctcattcatgtgtgatggttttgaaaaagtaacagaatggaggaggatagcccagcaccrctttgttccccccaaataaaacagcaacaatagaaatcttacatgtttctagacagctgttagatgctttaaattccaaatagttgggaattaattcttgaactttattacgctttaactctcagttcctcttagcaagctcattctcaatagggatggtctttttgtgtatttatttgatttattgctttcagttcaatgtttatttagctcagtactttaaatacacttgctcaatgactttttttgtttctggtttttaaaataacactactctgatgcagtgaataattagcactc

SEQ ID NO: 144622 - DNA, 601 bp, Human
ataggttgctcagtatatatcactgctagatacatgcatgtatatgtaaactctctgggttggtttaatgataaacagggaaatacaggaaaatagttcttaaaggtaaaacttagtgattaatctcttaaattataagagagcaatgtatgcaacaagctcaaggggacagtaataaaattggcattattcaggttgacatttgatgcctttaaatattacaagggattacttagaagtagccattttagactttccttgcatatatgtcccttcacaatgctcctgttttatatttctrgaaaatatatttttatgtgtgaaaattgactgttgaaggtttttcacaatttattttgttaaactaaactgaatttgtacgtaaggattttaaggcaataaaaggaatgaaaaatattgacctattattattttaagaattaaaaaaaattgattttaattgaactttaatttattttaaggaaatttacctgatcctggtaaggctcaggatttcatgaagaaattcacacaggtgttagaagatgatgagaaaataagaaagcagttagaagtacttgttagtccaacatgctcctgc

SEQ ID NO: 144623 - DNA, 601 bp, Human
actataatttgttgagtagtccactaagttacacatttagattttttcctactttttgattactattaagaagaatataattaatatttttacacagtcttgattctttctttaggataaattctaagaagtacaattgcatgggctaacagctcatttttaaagcctttaatatgctttggcaaattgttctccagaactgaattaattttatgctaatcaccagtaatgagagtgaccattttctcacacacaacaatattggtcagtatcattgctggaaacaaaacccaagtaaaarcaaagaaaaacacaattattttgatagtatttatatttgttagtcactagtcatctgaccatttttttctccttgggattattggccattcatatttcttttgtaagttgtgtttataatatttgcctagttttatagaatggtatttatcttactgatttgtgagtttgtcatatggcatttgctaagttgcagataattttctgtcagttttagtttaccctttctttttgtttattatgttctttacataccatagtttctatctttaggtaagtcagtattttcctcatggtgttt

SEQ ID NO: 144624 - DNA, 601 bp, Human
taagaagttgggcaaccccaaacagcctacaaatcctttcctggaaatgatcaagtttctcttggagaggatagcacctgtgcacatagataccgaatctatcaggtatttgtatataaaatactaagttctcattgctgttcattaatgtgtacattcaggaatcagtcattgttgagtgcctgctatatctagctacacatctgtgtgtattgtgtactcctctgtatatactcctctgcatatacctgtatttgtatatgcacacacacacacacagacacacacatatatatatattcactcatctgtacctgtatatttgttgttattcttgttatttatcttaattttaaggattggttcaaattgtgtgagaaattgtcaatctaagcctaattttatctgttaacggtataccagacactctttgtttttgttaacttgtatagtttaggtaatataaataaattttatttatacccttgggaaactaggtgaatctgttgcaaaggaacaaatgatacattttcacagataatttgagaactgaaaatgttgttttttaaaacaactctcatttaaagtttcagctttgata

SEQ ID NO: 144625 - DNA, 601 bp, Human
gagaatggattaatctgctcagattgtatagaaagaagtaaaaagatcatagacagaactttggaaattttttttacagtagagaaattgtagaaatgtaagaagactaggttattgtaatgttttgagttaagatggaggaggttttcagaagtaaagtatattgtggacaaagagactgaaaaccaggaatagatcttggctttaggaatcagaaggtcatagtgatctagaaggtatgtcaaaacataaacaataagaacaagtagcagttagtgctttataatgtgcctggtgttaytctaagaatttatgttttaactaacttctttctccaaggataggaactattattattcccattttacagataaagagcagtaaattgcacatagggtgagtaaccttctcactgctggagtgtggaaaacagcatttaaacctaggaagtctgtctctagagcccacttggttaaccactacactgtacagaaaaattctacttttagtcccctatagtagtcagtgaatgtccatttcatctgactcttcccaacagtgactgttaatcttttcaatatttgtcattttataggtgaat

SEQ ID NO: 144626 - DNA, 601 bp, Human
actgcactccagcctgggtgacaaagtgaaacttcgtctcaaaaataaataaataaataaataaataaataaataaataaataaataaaataacataagcttgtttttattagaagaaagcttgaaaacatcatgtttccttttgatctattgtagttccttttctgatgttctaatgaggttttattgtatgtctgttacctaggattcttacaccttttaggaggaggcctaggtatatttctgactttgacagctgtgcgtgacacacagtaatatttggtaaatggtttggaagtgyttaatgtttcctttatcattttttatttctgtgtatattgttctacttactggactagtgatcagttttagataattaaaaataatttgtcatttatgtgtttgggctcagacctgccatggaaaagatgataaagatattgatagcattaataaagagcaaattgaataacattttgacctcatttgaatgggcaagggaaaagaattgtttttgaaaagaagcatctgaaaatactatagttgttttgcagtagtgttaaaaaccagctatatcaaatttgtatttggttcggatatg

SEQ ID NO: 144627 - DNA, 601 bp, Human
tatggaactgaagtatttaaaatatttgatttatatactgaatatatttcagatacttctcatgaggagaattaactcagctgatactgaattcctgcagtgtgcacacactgttgttgatgaaataactcataataatttcttccaggagataaactatgtatgtagatttaattttttaaattattaaattgggtgagttgattttgaggaaaaataatatagttaagagaatgttgattaaactgtcttcccttgaattcatcaaaataattaaaaagaacctaaagaaaaatgtatytaagtaaagctaccaccaactggacagaattggcaccagatgtgcccttaagactctattgaaagtgagagcactgacaagggatatgtattggcagtgtactgtaagtgtcctattatttgctaatttagagggaggatattgctatatggacacactttaagagaaagaaagaaaacctgattttagctgtactaggactaaaggagaggctttgtggtcatagtatttttctttaggtcaacctgtttaccaggaagagcaaagtttagtgatgaggtaagactaaggaaaatcatg

SEQ ID NO: 144628 - DNA, 601 bp, Human
ttcagatacttctcatgaggagaattaactcagctgatactgaattcctgcagtgtgcacacactgttgttgatgaaataactcataataatttcttccaggagataaactatgtatgtagatttaattttttaaattattaaattgggtgagttgattttgaggaaaaataatatagttaagagaatgttgattaaactgtcttcccttgaattcatcaaaataattaaaaagaacctaaagaaaaatgtatctaagtaaagctaccaccaactggacagaattggcaccagatgtgccmttaagactctattgaaagtgagagcactgacaagggatatgtattggcagtgtactgtaagtgtcctattatttgctaatttagagggaggatattgctatatggacacactttaagagaaagaaagaaaacctgattttagctgtactaggactaaaggagaggctttgtggtcatagtatttttctttaggtcaacctgtttaccaggaagagcaaagtttagtgatgaggtaagactaaggaaaatcatgaaggaaatatctttttaccaactttacgggaacagaagaaaattata

SEQ ID NO: 144629 - DNA, 601 bp, Human
ggtctgaccaaaatttattaggcaggaatttcctcttcctaataagcctaggagcgctatgggagactggagtctgttttagctctgcagcctcaaccataagagacaggcgcacctgggggggctgtttataagcctatacctccaggtgcgtattctctttctcagggatgttccatgctgagaaaaagaattcagcgatatttctcccatttgcttttgaaagaagagaaatacggctctgttatgcctggctcaccggcggtcagagtttaaggttatctctcttattccctgaacrattgttgttatcctgctcttttttcaaggtgcccacatttcatattgctcaaacacacatgctatataatttgtgtagttaacacaattatcacatggtcctgaggcgatatacatcctcctcagctgacaggattaagagattaaagtaaagacaggcataggaaatcacaagagtattgattggggaagtgataagtgtccatgaaatctttacaaattttatgtttagagattgcagtaaagacaggcataagaaattacaagagtattaatttggggaactaataaatgtccatga

SEQ ID NO: 144630 - DNA, 601 bp, Human
gtgggaaaggaagaagctttcatttttcttggaaaatccaggagaatcaaccgaaaaactactcaaaatggggtagccaaaatgagtatgtaaaaatccaaagttttctgtatataaccaacaatcatttacattattatgggagtaaacatcagaagacctagaagtaaagtatacaagaaatttgcaatgctgtaataatggtggatggggggatataatacttaacaaatacattggtcaggaaaaggtacgttacctagtaaataattagcaagcagttttgaaaggaaaatagacygcttactttgattttacatatattccagaagaatcaaagacaaattattgcattaagtgtataacatggatttggtttaagtatataacatgaattaaaatactagtaaccagtatatttttataacttccttgtttgtagaggaagggacacttataccaagtcatgaatgaaatattgatgggttggattattgttattattactattattattttgttgagatagggtcttgctctgttacctagactggagtgcagtggctcaatcatggcccactgcagcctcaacttcctgggc

SEQ ID NO: 144631 - DNA, 601 bp, Human
cagaagacctagaagtaaagtatacaagaaatttgcaatgctgtaataatggtggatggggggatataatacttaacaaatacattggtcaggaaaaggtacgttacctagtaaataattagcaagcagttttgaaaggaaaatagaccgcttactttgattttacatatattccagaagaatcaaagacaaattattgcattaagtgtataacatggatttggtttaagtatataacatgaattaaaatactagtaaccagtatatttttataacttccttgtttgtagaggaagggacmcttataccaagtcatgaatgaaatattgatgggttggattattgttattattactattattattttgttgagatagggtcttgctctgttacctagactggagtgcagtggctcaatcatggcccactgcagcctcaacttcctgggctcaatcagtccccccacctcagcctcccaagttgttgtgtctacaggcatatgccaccatgcttgtctaaattttgtattttttgtagagacagggttttgccatgttgcccacgctggtcttgatctcctgggctcaggtgatctgcctag

SEQ ID NO: 144632 - DNA, 601 bp, Human
ttatttttaaaaaattcatttgttgcaaaaaaatctatgtgttaccccccactccctgccccaccatgtatggtatggttctaggtgtacagtacagttctaggtgtcgaggacattgtaataaagaggacaggctaagtctctctgcccttttattttagtgggggtgaggaaccactatttagataaaagccaaaatcatgaaataagttggaaacacaaatgatatgctggaaaactattttcagtatatattagttagaaaaggttaatacctgcaatgtataaagaccccccccccttttttttttgtttgagacagggtttcactctgtctcccaggctgtagtgtagtggcttgatctcttggctcactgcaacctctgcctcccaggttctagcagtttttgtgtctcagccacccaaatagctgggattacaggcgtgtgccaccacccctggcaatttttttttgtttgtgtttttagtagagactggattttgccatgtgggcggggctggtctctgtctcctggccttaagtaatctgtccgccttggcctcccaaagtgttggaattacaggtgtgagccactgtgcc

SEQ ID NO: 144633 - DNA, 601 bp, Human
acgtggtaatatatgcaaacttaaaatgtgtatagtttttggctctgcactttcaggaacttatcccagagataattagaaaagatgtgcacataatctgtcatatagttcagggttcagtcagagaaacaaactatactaggtataaagtcatgtactgcataatggtgcgttggttaacgatagaccagatgtatatggtagtctcttaagattatgatggagctgcactgcacaggggtacaacttttatctttattttttatttttatttatttatttattttattatttttttttwaaatttttttagtatttattgatcattcttgggtgtttcttggagagggggatttggcagggtcataggacaatagtggagagaaggtcagcagataaacatgtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagaga

SEQ ID NO: 144634 - DNA, 601 bp, Human
aacatgtagtacaagtttgtagtctaggagcaataggtcataccatataggtatgagtaggctataccatctaggtttatgtaagtttactctatgatgttctcacaacaatgaaatcatccagtgatgcatttctcagaatgtatccctattgttaagtgatgtatgactgtattttaaacaaattaatacagatgtttaaaggacaaaagagaaaaatgttgcattggtaattcagggatacaaattggtggaagcagctactacctctagagctggtgggataattgggaagaagtartgttaagaggtggaggagccctgtcagtatcacccaacagactgccaaagtatggcatggcctggctgttgctggggagcagtgaaactactgctcagaacgccttaagaagctctagtgtcttgcagtggaagaaattaataggaaaccagctctttgcagatttacagcttcaggatctctgagcagattatgaaaggataggtttaaagctcagagagagtatgtaaacagccagcacagggatattcatggtattgttgttaaggtgtttttaaaaatttttaaatctaaaatgct

SEQ ID NO: 144635 - DNA, 601 bp, Human
aacagccagcacagggatattcatggtattgttgttaaggtgtttttaaaaatttttaaatctaaaatgcttatcagtatgagattagttttggtatagccatacactatacatacactgagagctatgtgactgttaaaaagaatagtgcttagcaatatttgacaaatgaggttctacacacattgttggttgaaaaaaatgtttccaaatactgtgtattttatatccttacttattaatgtctgtataataatatgtctagagaaattttaggagtgttcaccaaaatgttgacagkattgtttcagggtagtgagatgctgagttttttctttagggtttcatgtatttttcagtttgaatgtatttttcattttctatattggtatgattgttatcaaggaaaaaacttgaacttgaaggtagaaagtcaatttaatgagggaataagaaattctttttaataggaaaagcagtcagcataggtggttatttattttcattgacttagtactgcagaattcttaaaattttttctttatgttcattgtttcagtttgttttcttttaaaataactgagtatgtaaaatattggat

SEQ ID NO: 144636 - DNA, 601 bp, Human
ttatggttgcatagtattccatggtgtatatgtgccacattttctttatccagtctatcagtgatgggcatttggattggttccaagtctttgctattgtgaatagtgctgcagtaaacatatgtgtgcatatgtctttatagtagaatgatttataatcctttgggtatatacctagtaatgggattgctgggtcaagtggtatttctagttccagatccttgaggaatcgcgacactgtcttccacaatggttgaattaatttatgctcccaccaacagtgtaaaaacgttcctatttstccacatcctctccagcatctgttgtttcctgactttttaatgatcgcaattctaactgatgtgagatggtatctcattgtggttttgatttgcatttctctaatgaccagtgatgatgggctttttttcatatgtttgttggccatataaatgtcttcttttgagaagtgtctgttcatcttcacccagtttttgatggagttgtttttttcttgtaaattcgtttaagtttcttgtagattctggatattagccctttgtcagatgaatagagtgcagaaactttctcctgttctgta

SEQ ID NO: 144637 - DNA, 601 bp, Human
attgtgaatagtgctgcagtaaacatatgtgtgcatatgtctttatagtagaatgatttataatcctttgggtatatacctagtaatgggattgctgggtcaagtggtatttctagttccagatccttgaggaatcgcgacactgtcttccacaatggttgaattaatttatgctcccaccaacagtgtaaaaacgttcctatttgtccacatcctctccagcatctgttgtttcctgactttttaatgatcgcaattctaactgatgtgagatggtatctcattgtggttttgatttgcrtttctctaatgaccagtgatgatgggctttttttcatatgtttgttggccatataaatgtcttcttttgagaagtgtctgttcatcttcacccagtttttgatggagttgtttttttcttgtaaattcgtttaagtttcttgtagattctggatattagccctttgtcagatgaatagagtgcagaaactttctcctgttctgtaggctacttactgttcactctgatgataagtttcttttgctctgcagaagctctttagtttaattagatcccatttgtcaattttggcttttgttg

SEQ ID NO: 144638 - DNA, 601 bp, Human
cactcatgatttggctctctgtttgtcttttattggtgtataggaatgcttgtgatttttgcacattgattttgtatcctgagactttgttgaaattgtttctcagcttaaggagtcttttggctgagacgacagggttttctgaatatacaatcgtgttatctgcaaacagtgactatttgacttcctctcttcctacttgaatactctttgtttctttctcttgcctgattgccctggccagaacttccaatactatgttgaataggagtggtgagagagggcatccttgtcttgtgcyggttttcaaagggaatgcttccagcttttgcccattcagtataatattaaagaatgttttacctttttctgtcttgcctgtttttctgtgtttttgttggtctcttcattctccatttttaggcctttacatgttaggaatatatttcttttaatgatacttcacctttggtatcttttgtgagactctactcttagtgtgataagcactgggttggtatcaggcaatgaggaagatatggaagtttcttttgctttgagatgtttgtataatagtttaagagctcctttattcggtatt

SEQ ID NO: 144639 - DNA, 601 bp, Human
acttaatatctttgttttagaaagttggtacttttgtcatattttcatgtattatgttaaagacctgaaggagaaagaaaagtagtatatcctccaaacaccatctttcctgtagatagcagataatttaatttttgtgtatttggggatggcggtattttctgtagtctgtgtttgtatatgagaatggcttcaataaattgatgttaatttataggaaagttttctttttggttgctctccttttcctctcaatagtgatgagagaaacactgatataagttgaatttcagagtagttytttcattttgatattgtatctgctgttttatctttacaagaacctctgtagtcctcctcctatgtagcatttggttggctggcttcctgagaaaaggtttcttagaaatatctggcatttttgaggttccactaatctagggcctggccattaattttgctttttagaaatgattttgttatggaaaattaccaaacttataatctaattgaaaaaactacactatgatatttttgtttataatatgaacaataggctggcaagatgtgcaatggaagtactgagggaagtcttcaagaa

SEQ ID NO: 144640 - DNA, 601 bp, Human
gtcctcctcctatgtagcatttggttggctggcttcctgagaaaaggtttcttagaaatatctggcatttttgaggttccactaatctagggcctggccattaattttgctttttagaaatgattttgttatggaaaattaccaaacttataatctaattgaaaaaactacactatgatatttttgtttataatatgaacaataggctggcaagatgtgcaatggaagtactgagggaagtcttcaagaatagcaagaagtaaactcatttaaatgtatttttgactaaatgaagcctcayattgccctaatttgttgggaaagaacagttttgtattggcctttcaagcctacaattcttggtgttcagtgtgggagaatagagcaccagtttttcattaaaatgtggcattaaaatgtctaatagaaaataaattcacttgtttcaacatcagaaggatgcaaaaaagaatatacggtgaaaagttcccccacccatgtatccccagccacttagtttcctttcccagaggcagagccattgttagtagtttctaaacgtacttttccagagatattttattcatatacaagtaagggc

SEQ ID NO: 144641 - DNA, 601 bp, Human
ctctttaaatcccactggatccttggcatcaagccagccagtgagtagagcctgtggagaagacatattgctcatacctacctcagtgcatatgtggcatacttcattttactcccactctcttgaccagaactcattcatatatcctcacttaactgcacaggaagctgcaagtagagtcatccttatgcccaggaaattgaagtggatattggtgagccctagcagtctctaacacattcatgtatatggtcataaactatatgctatgaagtctgtgtcgaaatgtttctttaccctrcctctaaactgaattgggcaaaactgaaaatgtttgaacctgatgccttctggacatagataacctatagaagtctaaatgtaatcttgagttactacttatactatgtatatttattgaaatttttgtagtttttataatttgaattacaaaataaattacaaaataaattttgtaatttgaaaatgaaatatgtaaacagtttatttgtatatgtgtagagttgaaatatattttcctcccctcattttcagcctctgcataagagcctagatccaagcaacctggaacatctcataa

SEQ ID NO: 144642 - DNA, 601 bp, Human
aactcattcatatatcctcacttaactgcacaggaagctgcaagtagagtcatccttatgcccaggaaattgaagtggatattggtgagccctagcagtctctaacacattcatgtatatggtcataaactatatgctatgaagtctgtgtcgaaatgtttctttaccctacctctaaactgaattgggcaaaactgaaaatgtttgaacctgatgccttctggacatagataacctatagaagtctaaatgtaatcttgagttactacttatactatgtatatttattgaaatttttgtagtttttataatttgaattacaaaataaattacaaaataaattttgtaatttgaaaatgaaatatgtaaacagtttatttgtatatgtgtagagttgaaatatattttcctcccctcattttcagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcgggtaatttatatttttta

SEQ ID NO: 144643 - DNA, 601 bp, Human
ttggtaattctgattttatatccatctttcttgctaaattctaattttgtcaattataaagaatgccagctttgattattttctaatgcttgcatattttatttctgtatatttacttccattttaggtatttatcctttttcatcctaacttaccagtttttgaaagagatatattcacatattctgctgtgatgaagtattcaatcttctgattttaatcatgttggttctggtttattttgatgttattctgctagttgtgtaaatgttcatgaattttatattttatttggtgttgtaagataaaatatatcagtatcccatttaagtccatatcctcttcagtgcttttcatcttgactggtatatttttccatcccataattttcagatttcttatgttgtttgtttttattgtatcttttgtggctttattatttataaatctacctgatagtctctgttgtttctggtagtatctgatagtttcttatttatgtaaggtttttgttttcatttttctttgtatttgtaatagtttatactaatttagttttttcttgtgaattaaatagtgttatctttgagtaattctttca

SEQ ID NO: 144644 - DNA, 601 bp, Human
ggtcaaagtgagtaatgtgcatagatctattgattttaatataatcaccacattgtaatatttgaggtattaaaatttctatttctattggaaagatattaaagtcactcaagtatttacatttattgtatgatgtcttatgtgctgtgagactatagggtaataatgagaaagctgggattttgtggacagctgcacataatctaatttgaggagaaaaaaaggtttgaaagctgtttccctgatggcaaaaggcagtgctagtttttatggactttcctctgttctgtaaagatgatarttcagattttaagcctattcatcttttccatgggatttaataaaactttttatttttaaaaaattcagcctataatttattgaattaggagttttataagattgctcatcattggtatagactcttgatttattaaaaccatctatggcctgtagtgtagacctcatgtcaatccactaccaagatatgaaggccaaaaatacatacattaaatattgttattttctagctgtaatttcttataaaccctttcagtctgtgtgtgtgtgtgtgtgtgtgtgtgtgtgtgtgtgtgtattt

SEQ ID NO: 144645 - DNA, 601 bp, Human
tttcatcatccagttaatatacagccttgttttatgtatgtttctgtttaaagactatttattatatatagttgtctcaactgaactcacagccaacagcactgtaactcatacctgaacaaagcttatctagcacacacattttctctgtaaggaatatcagagccttcttgtgctttggaacgccagacagcagttcatcgctatgcttgtgctttgaaacaccagacagtacttcatcatgaaataacaaaaacatcaaccacaaaactgtgaaaaatgtggcactgaatagacctcmaaaaggacactgtttacgtatgaaagctgaaacaagaaggcacagtgttgccttctttgacattagctgggaatgtgcacatctggctacttacattttttgctgctttgtgtatttactttgcaaatgacccaaaaattgcttcaagtattaattttggtgttacaaataaattttaacgagtatgcagattcctaaatatagaatccacaaataaggaagactgactgtatgtattcagttcctgaaaggaaaacaacagtatcgaaatttatacttttataaagacatgacatagaa

SEQ ID NO: 144646 - DNA, 601 bp, Human
cagcagttcatcgctatgcttgtgctttgaaacaccagacagtacttcatcatgaaataacaaaaacatcaaccacaaaactgtgaaaaatgtggcactgaatagacctcaaaaaggacactgtttacgtatgaaagctgaaacaagaaggcacagtgttgccttctttgacattagctgggaatgtgcacatctggctacttacattttttgctgctttgtgtatttactttgcaaatgacccaaaaattgcttcaagtattaattttggtgttacaaataaattttaacgagtatgcarattcctaaatatagaatccacaaataaggaagactgactgtatgtattcagttcctgaaaggaaaacaacagtatcgaaatttatacttttataaagacatgacatagaactaatttcaggttagaagcattccttattactcagtgagttaagttttcagattataagcagtgaaactttcagattcctattacagttttatggatttcttgttagagtaactttatatttgggctgtaccgctttagaagtctttagcatcattgagaaaagtaaaagggactttcacattagtaaat

SEQ ID NO: 144647 - DNA, 601 bp, Human
gatgcttgtaaaaacaactgcacgtattttacaacctggtgtttgagcccctctaatattttaacccaaatgtacgcttaaaaatcttgttgagcacactctcctttacttaacctcatttcatgtagctgaacagctttttttcttttttgtgccttgtactttgctgcctttaattttctctttactctcccatttccacacatccaacctaaccctttctgcaagtcagtgctcagacacaaccttctttacaaaacttgctctgagtcttttattttatctgcagtcctctgatacrtacaggactatgctttgcgctttagtacatgtactttatttcttgaggctctttaaatgcagtattgtatctgggaggctgctgttatgtatttgaacagaaagtacatttggagaaatttaataaaacaatatgaattttaacataatttaataattacttagatattttagaacttggaattcagttcatgaaagatttactctgtacttctgtgtgctgtacattgttctaagttctggaaatacaaagatgagtaagtcatggttatagcccaaagaagctaacaatctcttagga

SEQ ID NO: 144648 - DNA, 601 bp, Human
gtactttgctgcctttaattttctctttactctcccatttccacacatccaacctaaccctttctgcaagtcagtgctcagacacaaccttctttacaaaacttgctctgagtcttttattttatctgcagtcctctgatacgtacaggactatgctttgcgctttagtacatgtactttatttcttgaggctctttaaatgcagtattgtatctgggaggctgctgttatgtatttgaacagaaagtacatttggagaaatttaataaaacaatatgaattttaacataatttaataattacttagatattttagaacttggaattcagttcatgaaagatttactctgtacttctgtgtgctgtacattgttctaagttctggaaatacaaagatgagtaagtcatggttatagcccaaagaagctaacaatctcttaggagaacagaaaatagagatgtatcaataatacaatgagatacacaaactaattacatggtattaatggtagttttgagatactttgtactagaaaaggctactaaaagtgaatttacttaagctgcagactaaaattaattttatagtcagtagtgaata

SEQ ID NO: 144649 - DNA, 601 bp, Human
tagacatgatttataatcctttgggtatatacccagtaatgggattgctatgtcaaatggtagtcctgttttcagttctttgagaaatcaccaacctgctttccgcaatggctaaactaatttacattctcaccagcattgtattagtgctcccctttctccacagtctcaccagcatctattattttttggctttctaataatggccgttctgactggtatgagatggtatctcgtggttttgatttgcatttcactaatgattaacgatgttgaacattttttcatatgcttgttgtcygtgtgtatatcttcttttgaaaagtgtctatgtcctttgcccactttttaatggagttgtttggtttttgtttgttaatttatttaagtttcttagagattctggatattagacttttgttggatgcatagtttgcaaaaattttctcccattctgtagtttgtctgtttactctgttgatggtttgtttcttttgctgtgcagaagctctttagtttagactacttctgtaaaactagatgtttggtattttgataaactgaaatttaaatgaaatgaaagaagattttaaaataagga

SEQ ID NO: 144650 - DNA, 601 bp, Human
taaagagtaagactttttccatcccattttcatattttctgaaagttattttttctccttaatgctgataattggatctcaattataattagtttattgatgtatttcatttcttaggtgtttaaggttctttatttgctctcttgtctttcttttttcataccatctctttatattacatttttaatgtagtttcccaaaacttaatcataattattatagttatgtttctgtaccagtctggtgttccttttctattgaagtaattcattaaaatttccattccatttcttatcttttycttcttccttctgaaactgtgtagattttcatgtgaggtcaattaatcatcttgcttttactcatgtagtaagcacatttttctttgcaataactatcttcctctgtagaaggagaatggtctaattttaacaatgggccaaattcgtaactggggaactactcctacttattacttaattggtgattctctaactagagtttaaaatatttgtaattctttcaaagattattgcttaaagactgaaaacactgtacatgcctgggtggggaataggaatatagtgatatttagagaaat

SEQ ID NO: 144651 - DNA, 601 bp, Human
atattttctgaaagttattttttctccttaatgctgataattggatctcaattataattagtttattgatgtatttcatttcttaggtgtttaaggttctttatttgctctcttgtctttcttttttcataccatctctttatattacatttttaatgtagtttcccaaaacttaatcataattattatagttatgtttctgtaccagtctggtgttccttttctattgaagtaattcattaaaatttccattccatttcttatcttttccttcttccttctgaaactgtgtagattttcrtgtgaggtcaattaatcatcttgcttttactcatgtagtaagcacatttttctttgcaataactatcttcctctgtagaaggagaatggtctaattttaacaatgggccaaattcgtaactggggaactactcctacttattacttaattggtgattctctaactagagtttaaaatatttgtaattctttcaaagattattgcttaaagactgaaaacactgtacatgcctgggtggggaataggaatatagtgatatttagagaaatctttaagaccagcataattctttaaataagc

SEQ ID NO: 144652 - DNA, 601 bp, Human
tgttaatattagagttggcatgaggttggtttaaccttattacagtagttaaaatcagtgactgaaattttgtgtttcatatgataatttagtttaaataaaaaaactgctgtttgctttgttggcttttgaaccacctgtagatagtgttttaatattcactgactacttctttttctcttggttgtagaatttcagtaacaccaaaaattatctgcctcctgaaatgaaatcatttttcactcctggaaaagtatgttttgagaatcattttaatttttatgtggtagcttattttagmgtgattattggcaaaattgtgttattttgtatttcttcaaaaatttatattttcaagctggaaaatataagaattaacgatcttacatttactagtaagaaataattatatttactagatatacacaagctgaaatacacaaattactttttagcttgtaataaagtcctaggagacctgattcttagacttcttaggttaatatcaagataaaaaaaatcttaaaaggcttttttttttgagacggagtctctgttgcccaggctggagtgcagtggcgcatctcggctcactgcaagc

SEQ ID NO: 144653 - DNA, 601 bp, Human
cattatggaatctttaagttttgaaaacagattaatgttcacatttgtttttatatgcatagaaagtttttttgaagaatatgcaaaatcttaacagtatttatgttaacctagtatagaaagggaggttattttatactttttggtatcatttgaatttatttgtatagtaccacgtacatatataaacttcgtttttttaaaagtgtgtttttgcttttttgttttttttaaattcaacttttattttagatacagagggtacatgtgcaggtttgttacatgggtatattgcatccasatagtgagtatagtacccaataggtcgttttacagcccacatcctcctttctccagctcccccagtagtccgcattgtctgttgtttccatgtgtatacccatgtgtgtttgatgttccctcccatttataagtgagaacatgcagtatttggtttgctgttcctgtgttaatttgctcaggactgtggccttcttgctgtgaagtacatgatttcatccttttttatggctgcgtagtattccatggtatatatgaacttcatttttttaatccagtccattattgatgggtacctagg

SEQ ID NO: 144654 - DNA, 601 bp, Human
tttaattattgtcgtatttgactagtttacttccttattcctctcaattgtgtatattgtatcactgctagataatcctttaaaaatactactgtcgtgatgttatttcattgctcagagatcttaattggcttcccttgtttgctttcaagacaagtataatttcaccctctccttatcatccatttgttattcaacacaaaagtatcctaatttatactttttcaatatagttttctttaaactttctttcaatgtttgaccaatctgttttgttatttttttcttccaaattccgtckgtttagtgggactgtttgcaggggaatgaagtaggtatatttgagaaacctgtttggttggagagtaggaatgagggaaaaattatgagaggaagttgagaggtagtctgattatgtttggacttcgtaaaccatggtaaggagtttggatttgattttaagtgcaactgaaagatttgccagggagtctagcaatctcatttgtggtttttaaaaaaaattgccctgatgatttgtgcagaatgtactatagaggagctagaattgaggtagaaaaagcaattaggagtcagcgaatca

SEQ ID NO: 144655 - DNA, 601 bp, Human
tgcagtagtgagaagggaggagtgagttaaaacaaggagtttgatgtctaactaaccatgagcaatcagttgagaataactcactgcctttcgaccaccctcagatttattttgatgttagatagatcagatgatctttctaatggattagatgtgaacagttagggaaagggacgatttaagggtgtatcctgggctttttacctgaataactggagagatggtggtaccgtttactgagatacagaagccttgaggaagaacaggctctgtttgtatgtatgtgttttggggaagtggraataagaagagtgttcaaataactgttttggctacattaaagatcaggtgcctattagaatttcaagtgaagtgttgagtagacaattggatatgtgagtttagaactcagcgtagctggaccagagattgagatttagagttcaacaacatataaatagttttaaaaactagataaaggtgagaccacccaggacagaggcctggacctttatatgaatgccaactctatgcctggcactgatttaagtgcttggcatacattggtaagtaaaattgattgacacaagattcatgctta

SEQ ID NO: 144656 - DNA, 601 bp, Human
tagataaaggtgagaccacccaggacagaggcctggacctttatatgaatgccaactctatgcctggcactgatttaagtgcttggcatacattggtaagtaaaattgattgacacaagattcatgcttatattctaacaggggaaggcagtcagtacgtaataaatgtaataattatagtgtgttagagggtgttaaatgctacagagagaagaaaaaatagaatagggtaaggaaccagggcaggttgcagtgtagaccaagctaaactgccaacgagaaaagttttaattggttctakgatctgaccccaaaatagaatttaggttttaaaaagacttagaaaaatattagatttaaatttttgatttttaaaattttctcactatattaaattaaatgagcttcattgcttgttgagttggtaccaaatatggtagaatgaaactgattcatttttgaaaagaacgaaattttttccataaatctgtaaagctacactaggaacagaaaaagcttgtaaggttatttgattgtaataacaattacaaatgtctgtattaaaaggcttgatagttctgaaatggatcacagtgaaaat

SEQ ID NO: 144657 - DNA, 601 bp, Human
tgtcctcacatgagaggtgtggggtgggaggaagaagaaaggcacccaagctcactgatgtttcctcttataaggacactaatctcatcatgagggtgccacctcatgacctcatctcaacgaaatacctcccaaaggccccatctccaaatactgtcacattgggattagagcttgaacatacaatttttttctttggtggtgggggccacaattcagtccaaagcaagtaagaaataacacttaaaggacaggtgcaatgacacctgtaatcccagcactttgggaggccgaggcaggyggatcacctgagtttaggagtttgaaaccagcctggccaacacggcaaaaccccatctctgctaaaaatacaaaaattagccacgcatggtggcacatgcctctagtcccagctactcgggaggctgaggcaagagaatcgcttgaacccgggaggcagaggttgcagtgagccaagattgacccactgcactccagcctgggtgacagagcgagactctgtctcaaaaaaaaaaaaaagaaaaaaaaaaaaagctgggtgcagtggctcatgcctgtaatcccagcactttgggaggcc

SEQ ID NO: 144658 - DNA, 601 bp, Human
cacctgagtttaggagtttgaaaccagcctggccaacacggcaaaaccccatctctgctaaaaatacaaaaattagccacgcatggtggcacatgcctctagtcccagctactcgggaggctgaggcaagagaatcgcttgaacccgggaggcagaggttgcagtgagccaagattgacccactgcactccagcctgggtgacagagcgagactctgtctcaaaaaaaaaaaaaagaaaaaaaaaaaaagctgggtgcagtggctcatgcctgtaatcccagcactttgggaggccgaggygggcggatcacaaggtcaggagattgagaccatcctggctaacacggtgaaaccccgtctctactaaaaaaatacaaaaaaaaaaaaaaaaaaaaaaattagccaggcgtggttgcagacacctgtagtcccagctactcgggagaaggctgagacaggagaatggcgtgaacctgggaggcggagcttgcagtgagcagagatggtgccactgcactccagcctgggtgacagagtgagactccatctcaaaaataataaaagataatattaataataaagaaataacacttaaaaata

SEQ ID NO: 144659 - DNA, 601 bp, Human
agccacgcatggtggcacatgcctctagtcccagctactcgggaggctgaggcaagagaatcgcttgaacccgggaggcagaggttgcagtgagccaagattgacccactgcactccagcctgggtgacagagcgagactctgtctcaaaaaaaaaaaaaagaaaaaaaaaaaaagctgggtgcagtggctcatgcctgtaatcccagcactttgggaggccgaggcgggcggatcacaaggtcaggagattgagaccatcctggctaacacggtgaaaccccgtctctactaaaaaaatmcaaaaaaaaaaaaaaaaaaaaaaattagccaggcgtggttgcagacacctgtagtcccagctactcgggagaaggctgagacaggagaatggcgtgaacctgggaggcggagcttgcagtgagcagagatggtgccactgcactccagcctgggtgacagagtgagactccatctcaaaaataataaaagataatattaataataaagaaataacacttaaaaataagcatagaggcatacacaaaagcatagaggaatatagagaaaacccactaacaccgcagtagtcaaagttgaca

SEQ ID NO: 144660 - DNA, 601 bp, Human
ctagtcccagctactcgggaggctgaggcaagagaatcgcttgaacccgggaggcagaggttgcagtgagccaagattgacccactgcactccagcctgggtgacagagcgagactctgtctcaaaaaaaaaaaaaagaaaaaaaaaaaaagctgggtgcagtggctcatgcctgtaatcccagcactttgggaggccgaggcgggcggatcacaaggtcaggagattgagaccatcctggctaacacggtgaaaccccgtctctactaaaaaaatacaaaaaaaaaaaaaaaaaaaaaaattagccaggcgtggttgcagacacctgtagtcccagctactcgggagaaggctgagacaggagaatggcgtgaacctgggaggcggagcttgcagtgagcagagatggtgccactgcactccagcctgggtgacagagtgagactccatctcaaaaataataaaagataatattaataataaagaaataacacttaaaaataagcatagaggcatacacaaaagcatagaggaatatagagaaaacccactaacaccgcagtagtcaaagttgacaaaggacacaatacgaaggatgtaa

SEQ ID NO: 144661 - DNA, 601 bp, Human
gtaccttgattttagggcactgatacccattaagtatactgttgtttatattttacaactctccgtttggtatttctatttgggtttcataatagaaattagaagttagttacacagaataaaatcagcctttggaattgaagtttgagctgaatgagaattcataaaattggtaatacatacttattttgcaaaagtaggtatgtgttacttcctgacttttttgtttttgagacagagtctcactctgtcacccaggctggagtatagtggcgcacgatctgggctcagtgcaacctcygcctcccagattcaagcaattctcctgcctcagcttcccaagtagctgagattacaggccaatgccactgtgcccgactagtttttgtatttttagtgcagacagggttttaccatgttggtcaggctggtctcgaactcttgacctcaagtgatctgcctgctttggcctccaaagtggtgggattacaggcatcagccactgcacccggcccttcttgacttttaaagtaataaataaataactttaccagttaatacaactcagatatttctcttaggaaaaaacataatacattta

SEQ ID NO: 144662 - DNA, 601 bp, Human
aattatataatatagtgcaacaaatataatagatgcttatgtaacttgctgaggagcaaaaggaactaagtaactgagaggtgaagaggcaattccctctttatcttcccacatcgtagggacaatttttattaaccttttaattcccctttcagcaatcctaaggcaatgcttgcatatagtaagagtttaataaatatccattaaataaatgattataggaataaatgaatgaggcagattgtaacatctggcaccaaatgtatttatgcatgcctttaggaacttgtcagctccgcayagtatttatctcacactcacaaagtgcatatgtatcttttattcattatctcaacttagatccactttacaggtatggtagcaagagcaattatgacagcatgctagaggctccctttcccttccatatgctttctcaattcagcaaactgaagagctctatatttaagatgctgtcctggcttcacatggcagaaagggataatgcactggctggagctggggcttcactttctgcctcactcaaaggatgcaggcatatgttttaggcaagggcttcctttgattgttgaaagaggca

SEQ ID NO: 144663 - DNA, 601 bp, Human
gactccgtctcaaaataaaaaataaaaaataaaaataaataaacgcctgtgtagtaatttatttattcaataagcaactgatgagcaaccactgcatttcaggctctgtgctagacatagaaaaaacaaggctcgctgttcaatggggaaaatagacacacaggaattatataatatagtgcaacaaatataatagatgcttatgtaacttgctgaggagcaaaaggaactaagtaactgagaggtgaagaggcaattccctctttatcttcccacatcgtagggacaatttttattaacmttttaattcccctttcagcaatcctaaggcaatgcttgcatatagtaagagtttaataaatatccattaaataaatgattataggaataaatgaatgaggcagattgtaacatctggcaccaaatgtatttatgcatgcctttaggaacttgtcagctccgcacagtatttatctcacactcacaaagtgcatatgtatcttttattcattatctcaacttagatccactttacaggtatggtagcaagagcaattatgacagcatgctagaggctccctttcccttccatatgctttct

SEQ ID NO: 144664 - DNA, 601 bp, Human
catggtgaaaccccgtctctactaaaaatgcaaaaactagctgggcatggtggtacacccctgcaatcccagctatttgggagactgaggtgggagaattgcttgaacctgggaggcagagactgcagtaagccaggatcatgccactgcactccaacctgggtgacagagcaagactccgtctcaaaataaaaaataaaaaataaaaataaataaacgcctgtgtagtaatttatttattcaataagcaactgatgagcaaccactgcatttcaggctctgtgctagacatagaaaaaasaaggctcgctgttcaatggggaaaatagacacacaggaattatataatatagtgcaacaaatataatagatgcttatgtaacttgctgaggagcaaaaggaactaagtaactgagaggtgaagaggcaattccctctttatcttcccacatcgtagggacaatttttattaaccttttaattcccctttcagcaatcctaaggcaatgcttgcatatagtaagagtttaataaatatccattaaataaatgattataggaataaatgaatgaggcagattgtaacatctggcaccaaatg

SEQ ID NO: 144665 - DNA, 601 bp, Human
gataggatggcacgaagtttcatccccacatacaatttaaaatttatgaactgtttatttctggaattttccatccagtattttcaggctgcaactgacctctggtagctgaaacctcagataaggggggacaactacaccgtcttaatcatcactgcacctctagcactggcccagtgccagacacttagcaggtgctcagtcatcacttactgagtcaataaaacctgtgcctatggtctggagctccatgtccatgttctaatgcctgtgtgggctgggtgcagtggctcctgcctgwaatctcagcactttgggaggccgaggtgggcagatcacctgaggtcaggagttcgagaccagcctggccaacatggtgaaaccccgtctctactaaaaatgcaaaaactagctgggcatggtggtacacccctgcaatcccagctatttgggagactgaggtgggagaattgcttgaacctgggaggcagagactgcagtaagccaggatcatgccactgcactccaacctgggtgacagagcaagactccgtctcaaaataaaaaataaaaaataaaaataaataaacgcctgtgtagt

SEQ ID NO: 144666 - DNA, 601 bp, Human
ggttaaaatgggctgggtgcagtggagcatgcctataatcccagcactttcggaggccgaggcgggtggatcacctgaggtcaggagttcatgaccagcctaacatggtgaaaccccgtctctactaaatacaaaaaaattagccgggtgtggtggcacatgtctgtaatccgaggtacttggaaggctgaggcaggagaatggcttgtacctgggaggtggaggttgcagtgagccgagattgtgccattgcactccagcctgggcaacaagagcaaaactccatctcaaaaaaaaaaaatggttaaacaaattttgtgttagatatatttcaccactacttgaaaaaaattaacatatgagaaaccactgaattgtacatttgaaatgggtggttgtatggtatgtgaattatacctcaatagagctttttaaaaaatttagaggctgaaccagtaaatcgcaaaggttccttttactcttgtttatctacaggtctgttactcaggttggcattttgctgttaatcattcagacaagaattattttctttgaagtgaaaagggctatgccttctgtgagaaactaaccagcttctgca

SEQ ID NO: 144667 - DNA, 601 bp, Human
aaggtgggaacaatccaaatatccaacagctaatgaattgattttttaaaatgtggtatagccatacaatgagatatcgttcagtcacaaagatgaactaccgatatatgccacaacacaaactgtgaaaatacttggctaagtgaaataaaacatacacaaaggggcaaatattgcatgaatctagtatatgaggtacttgcaataggcaaattcagagagacagaaagtagatagagcttaccaggggctggcaaagtagggaaatacggagctattgttaaatcagtacggagtttcygtttggggtgatgaaaaaatttttgaaaatagatatggtgatggttgcacaacattatgaatgcacctaatgccatcagattgtacttttttttttttttaatagtcctcaccaggctagagtgcagtggcacaatctcagctcactgcagcctccgactcctggattcaagcgattctcgtgcctcagtctccggagtagctgaattacagacatgcaccaccacgcccagctaacttttgtatttttagtagagacagggtttcaccatgttggccaggctggtctcaaactgctgac

SEQ ID NO: 144668 - DNA, 601 bp, Human
ttctaatgcagggttcgtggaccatactaggaaaccatgggtaaggtatttccttgtgagaaaatggactatgactcctatgactttggtgaaaaagttataaggcaagatgacctttttgtaggtctttgactaaatatgtctatttactcaagaagcagaacaggctgagcacagtggctcacacctgtaatcttagcattttggaaggctgaagtgggaggatcacctgagtccaggggtttgaggccagcctgggcaacatgatgagaccccatcctaccaaaaattaaaaattagytgggcatggtggtgtacacctgtaatcctagctactcagaggctgaggaggatcacttgaacccaggagtttgaagttacagtgagctatgactgtgcccccatactccagcctgggtaacaaaacaaggccctgtctctaaaaaattaaaattaaaaaaagggggactgaaaatagaattaccatataatgtagcacttccactcctaggtatatacccaaaggaattgaaagcagggtgttatttactagagccaaaaggtgggaacaatccaaatatccaacagctaatgaattgat

SEQ ID NO: 144669 - DNA, 601 bp, Human
aatgcagattcctggccccatccttagcaattccgattcaataggtcagtggttgaatgtagccatgtacattttaacatgccccaatggcaattctaatgcagggttcgtggaccatactaggaaaccatgggtaaggtatttccttgtgagaaaatggactatgactcctatgactttggtgaaaaagttataaggcaagatgacctttttgtaggtctttgactaaatatgtctatttactcaagaagcagaacaggctgagcacagtggctcacacctgtaatcttagcattttggraggctgaagtgggaggatcacctgagtccaggggtttgaggccagcctgggcaacatgatgagaccccatcctaccaaaaattaaaaattagctgggcatggtggtgtacacctgtaatcctagctactcagaggctgaggaggatcacttgaacccaggagtttgaagttacagtgagctatgactgtgcccccatactccagcctgggtaacaaaacaaggccctgtctctaaaaaattaaaattaaaaaaagggggactgaaaatagaattaccatataatgtagcacttccactcc

SEQ ID NO: 144670 - DNA, 601 bp, Human
gagaaagctaaaccttctttgaagtgagcttaattttcagcttctatgttgtcacaaattgtacaatggccacggggacgctctatccctgagatacttcaagatacctgaaacgtaattataaccttgtacccaaggcacgctgagaagggcccttctacccaaatgacagtcctgtgactggacagtgatcatggttaggcaaatgggatgcattccgtggataataattcataacacagtaaaaactcatgaggcacaggaaaaactctttatggaggacctcagcacaaaacaaccrattccttcagtatgcatgtctaatgttagttcagaatggtcttgttaacatgcgtggtggaatacaacagcgtaaaaggttggatcaatctgcctttgttgtatcgaattgtccacacaagtagttctcacacttaagtgtacacaaaaattgccagtggagcttgctaaaaatgcagattcctggccccatccttagcaattccgattcaataggtcagtggttgaatgtagccatgtacattttaacatgccccaatggcaattctaatgcagggttcgtggaccatactaggaaacc

SEQ ID NO: 144671 - DNA, 601 bp, Human
acaaggctcttctgaagtgacactgtgagtaccctacagaagaaactggttgttctgagagcctcagtaaagggtcaattcattttccctccgacttttgagttatcattgagttctaatgacttcagggcaagactttcaaatgcagaacctgttctcctagcttttctcatagcagaatagtctgtgatctggcttgcaaaacacagagaaagctaaaccttctttgaagtgagcttaattttcagcttctatgttgtcacaaattgtacaatggccacggggacgctctatccctgasatacttcaagatacctgaaacgtaattataaccttgtacccaaggcacgctgagaagggcccttctacccaaatgacagtcctgtgactggacagtgatcatggttaggcaaatgggatgcattccgtggataataattcataacacagtaaaaactcatgaggcacaggaaaaactctttatggaggacctcagcacaaaacaaccaattccttcagtatgcatgtctaatgttagttcagaatggtcttgttaacatgcgtggtggaatacaacagcgtaaaaggttggatcaatctg

SEQ ID NO: 144672 - DNA, 601 bp, Human
ggcgaccgagcaccagtgctggggctcctcgtaacaaactggtcgaaagtctggaagaaaacaaaccagagaacacatggctactgtcatacctgggctgtgtagttcatgattccaccaggaaacttagttaatgcttttcaccagaaagtcggctgcaagaccaagcatgccgctctgcaatcttttagaacctgtagctctcatgggagctgcttggggctggctcatttcactagcacacctgagatgtagagcccatggtccttgttcatcttccatggctagagcatttataaaygtgtattggtcatgaaggggccagggaaaacatgacatgaacagatgaacataaaaaaactgtcggccctaaagcaagcacagctcaaaggaagctggcaggtcacctcttctttcagaaacatgtgaaagatggcatgttgctgttactgtgcccacttgaatccttgtggcaaaaagtatcattttctaacaaactagagatggaaaacaatagtttgactatgataaaaagcaaatcaataatgctgaataggacattaaattatttaaggaaaaaaaaagcttccacatagagggg

SEQ ID NO: 144673 - DNA, 601 bp, Human
tcggtgaacccatctatgagcacacttcgggaggaagcctggaatgtctccccaactcggttgttcagttcatagtaggcgaccgagcaccagtgctggggctcctcgtaacaaactggtcgaaagtctggaagaaaacaaaccagagaacacatggctactgtcatacctgggctgtgtagttcatgattccaccaggaaacttagttaatgcttttcaccagaaagtcggctgcaagaccaagcatgccgctctgcaatcttttagaacctgtagctctcatgggagctgcttggggcyggctcatttcactagcacacctgagatgtagagcccatggtccttgttcatcttccatggctagagcatttataaatgtgtattggtcatgaaggggccagggaaaacatgacatgaacagatgaacataaaaaaactgtcggccctaaagcaagcacagctcaaaggaagctggcaggtcacctcttctttcagaaacatgtgaaagatggcatgttgctgttactgtgcccacttgaatccttgtggcaaaaagtatcattttctaacaaactagagatggaaaacaatagtttgact

SEQ ID NO: 144674 - DNA, 601 bp, Human
ttgctcttaccctttcctatatgtctcctggtattttctatcgttgagtttctgtttacattagaaagaagtccaagacagaatctgttcctgttatttgaagggtcggtgaacccatctatgagcacacttcgggaggaagcctggaatgtctccccaactcggttgttcagttcatagtaggcgaccgagcaccagtgctggggctcctcgtaacaaactggtcgaaagtctggaagaaaacaaaccagagaacacatggctactgtcatacctgggctgtgtagttcatgattccacmaggaaacttagttaatgcttttcaccagaaagtcggctgcaagaccaagcatgccgctctgcaatcttttagaacctgtagctctcatgggagctgcttggggctggctcatttcactagcacacctgagatgtagagcccatggtccttgttcatcttccatggctagagcatttataaatgtgtattggtcatgaaggggccagggaaaacatgacatgaacagatgaacataaaaaaactgtcggccctaaagcaagcacagctcaaaggaagctggcaggtcacctcttctttcag

SEQ ID NO: 144675 - DNA, 601 bp, Human
cattttgaaggtatgttaggaagaatattagaatgcatcaccaaatggaacaatgaatctcccctggaaatttgaaagaaaaggctcaggctcccttcccgaggtggcttaagtgctggatggagagagaaaaggtcaaatgactgaaggttcttcacatctatgactccatggtatcattcgaagataccaactattccaatagaaaagaaaataatttaaagatcctcagccagaccacacactcagctgggatttgctaccatcactcagaccaatgagatgggcttcaaaagcatcrctggtcagaaaagagaccagtatgacttgtacccaatcagcctgcacacaggagagccccaatcacatgccaaaggcttccagacataaatcagtcattctttctaactacctagctgctaagtctccaaagggaacttcacctgatacaaataatcatctagtcagaattcctgttcttcagaaatgatcctagtttgtaagttttagggaaatgaaaaataatgcataacacttctatttaataatttcatccggctttcttcatatttatcatcttgcttgtcttcacaatccccac

SEQ ID NO: 144676 - DNA, 601 bp, Human
ggttggcacaagatacaggtcataaacaccttgctgatgaaacaggctgcaataaagaagctggccaaaaccaagatggcgatgagagtaacctctggtcattctcactactacactcccaccagtgccatgacaatttacaaatgccatggtgaacatggtaacatcaggaagttaccctatatggtctaaaaaggggaggcatgaataatctacccactgtttagcatataatcaggaaataaccagccaggcacggtggctcacgcctgaaatcccagcactttgggaagccgaggcrggtggattgcctgaggtcgggagtttgagaccagcctgagcaatgtggagaaaccccatctctactaaaaatacaaaattaggcgggcatggtggcacatgcctgtaatctcagctactcaggaggctgaggcaggagaatcgcttgaacccgggaggcagaggttgaggcgagccgagattgtgccattgcactccagcctgggcaacaagagcgaaactccatctcaaaaaaaaaaagaaaaaagaaaaaaaagaaataaccataaaaataggcaaccagtagccctggtggctgctt

SEQ ID NO: 144677 - DNA, 601 bp, Human
ccaaataccacctggacatgcagaccctctgcccaaggagtttgaaacagagtgactccgtcttgagtagaagctgggtaaaataaggctaagacctactgggctgcattcccagacgggtaggcattctaagtcataggatgagataggttggcacaagatacaggtcataaacaccttgctgatgaaacaggctgcaataaagaagctggccaaaaccaagatggcgatgagagtaacctctggtcattctcactactacactcccaccagtgccatgacaatttacaaatgccatggygaacatggtaacatcaggaagttaccctatatggtctaaaaaggggaggcatgaataatctacccactgtttagcatataatcaggaaataaccagccaggcacggtggctcacgcctgaaatcccagcactttgggaagccgaggcgggtggattgcctgaggtcgggagtttgagaccagcctgagcaatgtggagaaaccccatctctactaaaaatacaaaattaggcgggcatggtggcacatgcctgtaatctcagctactcaggaggctgaggcaggagaatcgcttgaaccc

SEQ ID NO: 144678 - DNA, 601 bp, Human
actctacaggatgttttaaaacttgttttcagttaataatatcttgtgaacattttctcaggatattaagtattctgcaacatcaagtttaatgactgtaacagtgtgacattgcatcctatgttaaaatattttttaggatttgctttttttaagatgagaagccttacatgtgttcagaggcagaacaaaaggactattttgagacagggaagtgaaatccattgggaaaggaagcaacccaaataccacctggacatgcagaccctctgcccaaggagtttgaaacagagtgactccrtcttgagtagaagctgggtaaaataaggctaagacctactgggctgcattcccagacgggtaggcattctaagtcataggatgagataggttggcacaagatacaggtcataaacaccttgctgatgaaacaggctgcaataaagaagctggccaaaaccaagatggcgatgagagtaacctctggtcattctcactactacactcccaccagtgccatgacaatttacaaatgccatggtgaacatggtaacatcaggaagttaccctatatggtctaaaaaggggaggcatgaataat

SEQ ID NO: 144679 - DNA, 601 bp, Human
ccactctgcctgggctgcactgtgaggtgtctcccttaccactgctgctgccttccagagcacccttacacaccatgcccaccccatcctcacaggatcaagaaagcccactataggaaatttagaaaatacagacagaaaagaaaaatcagccacaaatccacagcccagaaataatcaaagctaacatctattagttattagctattaacatttttcagtcttttttatgtgtttttgagacagtctcctgcctagttggggctacagatgcaccccgccatactcagctaactttttkgtattttttgtagtgacagggtctcaccatgttgcccacctggtcatgaactcctacgctcaagcaatccacccacctcgacctcccaaagtgctgggattacaggtgtgagccaccatgctcagccatgtgcatttttaagaagaaaattgggatcatactctacaggatgttttaaaacttgttttcagttaataatatcttgtgaacattttctcaggatattaagtattctgcaacatcaagtttaatgactgtaacagtgtgacattgcatcctatgttaaaatattttttagga

SEQ ID NO: 144680 - DNA, 601 bp, Human
ccatactgtcactcaaacacgcagccactctgcctgggctgcactgtgaggtgtctcccttaccactgctgctgccttccagagcacccttacacaccatgcccaccccatcctcacaggatcaagaaagcccactataggaaatttagaaaatacagacagaaaagaaaaatcagccacaaatccacagcccagaaataatcaaagctaacatctattagttattagctattaacatttttcagtcttttttatgtgtttttgagacagtctcctgcctagttggggctacagatgcacsccgccatactcagctaacttttttgtattttttgtagtgacagggtctcaccatgttgcccacctggtcatgaactcctacgctcaagcaatccacccacctcgacctcccaaagtgctgggattacaggtgtgagccaccatgctcagccatgtgcatttttaagaagaaaattgggatcatactctacaggatgttttaaaacttgttttcagttaataatatcttgtgaacattttctcaggatattaagtattctgcaacatcaagtttaatgactgtaacagtgtgacattgcat

SEQ ID NO: 144681 - DNA, 601 bp, Human
agctattttagaagctttaagaaaatatatatatttctgagtgtaataatggtattatttcttatatagttagatataaactccaatagatgggaaaaaggatatgaagcatgagatttgctctaaaatattctagcaaaaatactgtagagcgatagatgaaaaagaacggcacagaatgtgaatctttattgaagccggagatactaagatgaagactcattatattcccctctctgttttcctatttgaaatttcccacaataaaaaagttttaatgggtggtaaaaaaaaatactartaatataaaaatacatttttccagatccacaccagggcctaggtcagaggatggaggcaggtcttccagaggactgtgcctaccgttgtgcactgcacaaccactgcaaaccagggtttgcctcctagtcttcagagctttgtgtaattattacaatcctttcccagcagatggcagtaatttctcttgaggaagaggcaccttttcctaactcacacaaagtcacctctgggctgatagcaaggctggtcctccaagactgcccctgatgaccaagtttctcaggacaacatgataaac

SEQ ID NO: 144682 - DNA, 601 bp, Human
caggggttggttttcaatcctgttcaggtcatctgcaaccacagtccactttggcaaagctaccaatgcagagaagagcctgggcaggtaggcagtcgtccagcatccagagagagaagagcagagccaatgggaccagcatgcggagcccgcccagaaacaccagaaaagggtggaacccagcctcagggtgagggaggccagattctggctagagacaccagcatctgaggaggagtcaagtaggccaacaatgttatttgcatccatttggtaggccagaatagtagctttaaacgcyagtgtcagattcaagatcaccacagagtagagcagtggttcttaaaccttagcttgcactaagaccacttgcagggcttattaaaacagatcactacttcagcaggtccagggtgaggccgggtgacctgcacttttttttttttttttttttgagatggagttaccctcttgtcacccaggctggagatggggtggcgcgatctcggctcactgcaacctctgcctcccgggttcaagcgattctcctgcatcagcctcccgagtagctgggattacaggcgcctgccaccacacctgg

SEQ ID NO: 144683 - DNA, 601 bp, Human
acagaactcacagcttccagggctgctcagggcctcgtgtgcatgactctgaatctaggaaacgttactgacatagctgctgggagtttctttgtcaggtcctaagtagcacttgaggcagttctgcattatatgtgattacatcccaccatatttattgtttccttttcccttaataaaattttagaaaagaacaattttgagtagtatgtatcccaaccacatcactctgaagaaactgagccagggtcgcacagctaaagcacagccctggatatccagtccacgactgtcctgtcaytgcctctcctcttcctcagtcagagactggctccccttctccgcttccctcagccttcctctccctcctctatctcatcgctgttacccactctcctgaatggccttgggccctaaccccagggcctaggtggtggtgccagggggcagaaggatggtcctaactggctgggagagttacttggctggaccctcacgatcataaagagaaccccaggccagggcaaaatgcaaacaccgcctcttacaacaacccctgtgggctccaaaggggaaagacctgccttgtgagggtgggcga

SEQ ID NO: 144684 - DNA, 601 bp, Human
tcatttgcgagtactttgcaacagacaaaatagcaggtgatgaaactgaaggctttcacttccatatacaaacccagttgtctttccttcccactaagaaacttccttggttctccagccttcatagcaaccttaataagattcgatatgagaaattcaacaaatattcatcaacagaacatatactgctctctgaattaatcacacccgtttctattccaaattgtttatacctttataacactacttagtttattatcttgtattagaaccaaccctgcctatttttgtagcttattcwtaaatattatctcctccatgtgcctgtatgctttctaagagtaaggagagtatcttactgaattcagataaattcaccaacattcactgagtgataacagtgcttggcaattggaaggatggaaaaaatctctgttgcactagtcctgtaaaattactgttgttactttatcatctgcattaaaaacaatcaaatagccaccttgtttttcctcaaaagtaatgtgtaacaattttcatataattgctaaacaagacagtttatactcaaagaggaactcctcctaaaaacaatagaatt

SEQ ID NO: 144685 - DNA, 601 bp, Human
ttcaagcagctgttttttaaaattggaaactatattgttcttactttttaaataattactaaagtgataataaaaacataatttgagtatagaaaaattatttgtcatggtaattttaaagtgctaataaaatttactttgaaaaaaatgcctggaacaagccatgctgattccctggatggaatcatggcagtaagaaaactgtcacacataccccgatactttgataagcccatattttgaaatactagactcatttgcgagtactttgcaacagacaaaatagcaggtgatgaaactgaaggctttcacttccatatacaaacccagttgtctttccttcccactaagaaacttccttggttctccagccttcatagcaaccttaataagattcgatatgagaaattcaacaaatattcatcaacagaacatatactgctctctgaattaatcacacccgtttctattccaaattgtttatacctttataacactacttagtttattatcttgtattagaaccaaccctgcctatttttgtagcttattcataaatattatctcctccatgtgcctgtatgctttctaagagtaagga

SEQ ID NO: 144686 - DNA, 601 bp, Human
tctgatccatcagcccagtggtagctacagctgctcatctcaaatgttaaaaaaaaatgatctatagttatatttactatgtatttattttaaaagttcctgcagtattaggaacagtttgtcttctgtgtcaattgtgtagctttatgaatgtaaatgctgcctatctgagaaatgtatctagttattaggaaaatcagatttctatataagcttatatttaatcagagtgaaataattacctatgagatattggcatttcatcctaattttaaaaacacagacccggaaaaaaaaaaaactgtatgattcaaatgatgccctctgccgtttctaaagcaacagaacatttgaaaagatttcgaagttatttgttaatataactttataatatatgctttcaaaacactaaatttgaatgaaactgctttgtcaccatgaaagagaaataatttcaagcagctgttttttaaaattggaaactatattgttcttactttttaaataattactaaagtgataataaaaacataatttgagtatagaaaaattatttgtcatggtaattttaaagtgctaataaaatttactttgaaaaaaa

SEQ ID NO: 144687 - DNA, 601 bp, Human
tttttgtatttttagtagagatggggttttgccatgttggccaggctagtcttgaactcctgacctcaagcaatccacccaccttagcctcccaaagtgctgggattacaggcatgagccaccacgcccggctcttctcagtttaaactcaaacctttggtgttctcatccacacttagggagttaaatacggtccctttgcagacaattcccaaatttgtatttcaagcccaaacctctctccccgaatccagactcttatatcgaactggctactcagcaactccacttgaatgcaacrgacatctcaattacacctgcgtcttctccatcttgattgaaggcaactaacttcatcttcctctttttctcccacgcctgatccgccttcacaattcagaatccttccacttctcacagctgtactggatccctccaggtgggggcgactctcacctgactattactatagcctcctaagtggtttccctacttgcaaccttgcctgtataatatctatcctccacacagcaggcagggcgatcctttaagaatagaagttagatcatgaaaatgctctgctctgatccctgcaaaagct

SEQ ID NO: 144688 - DNA, 601 bp, Human
gacctgcatccacatacttggcctttctacctcttaccacagattaattatttgtgtttccaaataagctggtccacccattaatgcactctcagacctgccttcccagagacatcattccagcaaatcttccccttctctcctgcaatcttttgcgtctactatatcattcccgtcaacatatgaacacactgaaatgtcttccaccttcaagatacttctccaccccccaccagctactgccctatgtttttatcccatttctggcaaaaaccctcagaagagtcatccatactagccrtctcaatttgtctccttccattctctcttaaatccattctgatcatcatctcaccccagccgccaacaaaacttttcttgtcaagatcaaaaaaggccttcatattgttaaaatgaatgatcagctctcagcctttgtgttatgtgggcagcatttgatttagttcatcacatcctctcatcaatgcactgtcttttctcggcttccaaagcaccacacttcttggtcttattactacctcactggttggtctttctcagttttctttgctgattctgtcccttctgtcccatctttaaa

SEQ ID NO: 144689 - DNA, 601 bp, Human
tgtcttgcacaaaatggttactgcagaccagtgactggacctgaaagtggtaaagacagaactggaaggcgctcttggtttttcagggctcattatcaaagcttgcttattctctctctctctctctctagttcaactggcaatttcccttttatcaccattcaaaggagagacagttaaaattttttttttaatttgcatatttttctctatatgttatatatcaatgaaaggatatttaaaaatgaagggagatcacagccaagtaaatcagttctgtgactgggagcagtgattctcygtagagttttttaaaacttggatttcaacacaaccatgctgcctgatcacattttactttcatgactgagaacctcaagtggacctgtgatgtccccggcagtcacaacccaccccccagtcccttctctcatgtccccctcctaggtgatcgctcctccccactaaaacctgcaacccctttttccctgtccatacctgcaactgatatttattttgtattttaatgagaaaaatgaatacatcagaaataagtttccacaggacctgcatccacatacttggcctttctacctcttac

SEQ ID NO: 144690 - DNA, 601 bp, Human
agtccttggccatgatggggcccgggctggagctggagctggagctgggctgggctgggctgaggttgctctgagggctggggctggggcagaggtgcagattcacgtggaggttgatggtgggatggaacgcagggtcggaggggttcggggtggtggcctgggtaggatctgaggttggcagggcgtttgggatgaggtttgaaatcccgctgggtcctttcccttctcaggagaccgcttgggccttgacctggccaggagacccctccccacgctcatggacccgaccacccacagyttcccatggggtcctccccatccctgaaccaaggcctccttgttcccaagcatcctcgtcccagttgcctccccagcctcagttacctgtgaaaggtgtggagagcggacacctggctcccgcaggcaaccctggccttggccaaggaggggttaaagccaggagaactggggcaggtggagctcacaggggagaggagagtggaggaggggctggtccgggcaaggcctgcactggagggtctgagtgtccaagctctaacctggcacctcctggcctgggactttggacagtaaacag

SEQ ID NO: 144691 - DNA, 601 bp, Human
tggatatcttgaaagtccttggccatgatggggcccgggctggagctggagctggagctgggctgggctgggctgaggttgctctgagggctggggctggggcagaggtgcagattcacgtggaggttgatggtgggatggaacgcagggtcggaggggttcggggtggtggcctgggtaggatctgaggttggcagggcgtttgggatgaggtttgaaatcccgctgggtcctttcccttctcaggagaccgcttgggccttgacctggccaggagacccctccccacgctcatggaccmgaccacccacagcttcccatggggtcctccccatccctgaaccaaggcctccttgttcccaagcatcctcgtcccagttgcctccccagcctcagttacctgtgaaaggtgtggagagcggacacctggctcccgcaggcaaccctggccttggccaaggaggggttaaagccaggagaactggggcaggtggagctcacaggggagaggagagtggaggaggggctggtccgggcaaggcctgcactggagggtctgagtgtccaagctctaacctggcacctcctggcctgggacttt

SEQ ID NO: 144692 - DNA, 601 bp, Human
cataacacactcacaacatacacacacaacacacacactcgcacaacatacacacacgcacaacatacacaacactcacacaacacacaaacatacatacactcacacaatacacacacacaacacacacacaacatacacaacgtacacacacacaacatacacacactcatacacaacatcacactacacacaacatacacacaacatacacacactcacatacacaacatacactcgcacaacatacacacatgcacaagatacacacacaacacacaacatacactcacacacaagwtacacacaacatatactcacacaacatacacacacaacacactctcacacacaacataccctctcacatacacgacatacacacacacatatgcacgctctcgcgcacatatacacacacacaacattcactcacacacacacacacagagtcccagctgaatctgcattcctcatatgcacatacgtgcacacgcacatacggggcacatgtgttcttgggttgggaggagaagggcaggcagttatcttccagatctccccacacctctggcacatgcctttcctggggtcctggggt

SEQ ID NO: 144693 - DNA, 601 bp, Human
gcccagctaaccaatccccttcctaagctccaagcccctgctcctcctgcctccatggaacccggctccaccaccagcacccacacacctgacactcctccattcctggctcttgcccttctgcctagcactgctcagatctctctcaccttaaaatcttttcccaccagcctgggcaacatagcaagaccccatttctctaaaaaattttttttaatttgccaggcacagtggtgcacacctgtaagtcctaactacttgggaggctgaggtgggaggatggcttgagcccaggagttcraggttgcagtgagctatgatcctgccactacactcctgtctctaaaaaaaaaatgtccaagatacttaggtccttcagtcaagatttattacagaaggatccagggaagggtcttgggagatgagaggagcagggatcttccaggatctctctgtgctcacgtcccccacccatcccaactcaccccacctctacacacacacacacacacacatacaatcacatacacacactaacacacacactcacgcaacacactcacacacacaacatacataacacactcacaacatacacaca

SEQ ID NO: 144694 - DNA, 601 bp, Human
caccgcctggtgggaagtccagccagccccctacagagagaggagatgctactggtgttcctgagtggtcctcgggagggacctcctatccctcctgtcccctgccctgccctgcccagcaccggccctccctcggttggccagcctcaggaatgaggagtccctcattccagcccagctaaccaatccccttcctaagctccaagcccctgctcctcctgcctccatggaacccggctccaccaccagcacccacacacctgacactcctccattcctggctcttgcccttctgcctagmactgctcagatctctctcaccttaaaatcttttcccaccagcctgggcaacatagcaagaccccatttctctaaaaaattttttttaatttgccaggcacagtggtgcacacctgtaagtcctaactacttgggaggctgaggtgggaggatggcttgagcccaggagttcaaggttgcagtgagctatgatcctgccactacactcctgtctctaaaaaaaaaatgtccaagatacttaggtccttcagtcaagatttattacagaaggatccagggaagggtcttgggagatgagagg

SEQ ID NO: 144695 - DNA, 601 bp, Human
tggagatcacagtcgtagctacccgattggattgctcggataattagatgagttaaaatatgtaatgtgcttcttaggcaaaagtttgaacataaaagacagggtctgcccaagatgggaagagttcttctctccccagaaacaatcaaaacaaaaacagacaactatagaacatggcagctttcaagactctggacatcaggcaaggaggagtaaagatccctgagggataagaagcaaacaacaggaaccctccgatcaccccagcttactgtttggagagagtctgcaggttacaggmcaggaaagggaagtccaggcagagcccaagagactccccacgttgaggagatggagctgagagtccgaggagaccaaaacaattaagagttcaaacgatcaaactgactctaagttgcttaactgcatcccagagcaaagctcaagaacatttagaggaatacaaaaatatccagcacccaacaaggtgaaattgacaatgtctggcagccaatcaaagattacaaggcatgcaatgaaacgggaaaacacaatgcataacgaggaggttcataaatatcaaaagagatccagaactgac

SEQ ID NO: 144696 - DNA, 601 bp, Human
ccagcattcaatttctccatgcttccattttctcgtgtgtaaaatggagatcacagtcgtagctacccgattggattgctcggataattagatgagttaaaatatgtaatgtgcttcttaggcaaaagtttgaacataaaagacagggtctgcccaagatgggaagagttcttctctccccagaaacaatcaaaacaaaaacagacaactatagaacatggcagctttcaagactctggacatcaggcaaggaggagtaaagatccctgagggataagaagcaaacaacaggaaccctccratcaccccagcttactgtttggagagagtctgcaggttacaggacaggaaagggaagtccaggcagagcccaagagactccccacgttgaggagatggagctgagagtccgaggagaccaaaacaattaagagttcaaacgatcaaactgactctaagttgcttaactgcatcccagagcaaagctcaagaacatttagaggaatacaaaaatatccagcacccaacaaggtgaaattgacaatgtctggcagccaatcaaagattacaaggcatgcaatgaaacgggaaaacacaatgc

SEQ ID NO: 144697 - DNA, 601 bp, Human
acactcatgaccacgctctgctgtacccactctcacatgtgcatatgcatgctaatgcacacattcatactccctcccacacacacacacctgacacacccacacacgtacactcacacacccacgtcttcctgcacacagagctgggctccctctctgctgcctccagacccagagcagctccagttgtcccagccctgagctcctctctttgcagcatccacctgcaaacagaacaccttctaggccttggaccctgactctgtggacttccttgtcttctcattcctatcaccccccracccagcaggaccacatcctggggaggctcagtcaggggcccagaatcttcctccccaggtcacttcctgccactgtcctgagtcagacactgcccctgtaagtgactgtccataactcttcatctttttcacaccagtgacttccaccttccccactgcagccacactcaggaccccatttgacccagggaggcctctgacacctccactgcccactcccgctctgagcacagccccaccctccctctcactgcccccaccccttcctccaaggcctttgcattcctctccatccagaa

SEQ ID NO: 144698 - DNA, 601 bp, Human
ttaaaatactttgaagttcagccagacgcggtggttcacgcctgtaatcccaccactttgggaggcggaggtgggcggatcatgaggtcaggagttccagaccagcctggctaagacggtgaaaccccgtctctactaaaaatacaaaaaaattagccgggcatggtggcacgtgcctgtaatcccagcactttgggaggccgaggcaggagaatggcgtgaacccagaaggcggagcttgcagtgagccgagatcgtgccactgcactccagcttgggcgacagagcgagactccatctcaaaaaaaaaaaaaaaatggataaaataagcctgatccagcctcccagagcaggccttccaagggcttcctcctgcctgtgggaagcgtggcctcacctgctcctcccaggagttgatgaccaccaggtgtgcgttctccagctggcagtacttctccgcctcagcccaggccttcccggagtgagagaaccagtagcagctgccttggtgctccacccagttgacggggcagcaggtcctttgggagcctgaggggacagggggcagggagatgagatccagccggaggggcaggcacac

SEQ ID NO: 144699 - DNA, 601 bp, Human
aactactgtggcattaaaatactttgaagttcagccagacgcggtggttcacgcctgtaatcccaccactttgggaggcggaggtgggcggatcatgaggtcaggagttccagaccagcctggctaagacggtgaaaccccgtctctactaaaaatacaaaaaaattagccgggcatggtggcacgtgcctgtaatcccagcactttgggaggccgaggcaggagaatggcgtgaacccagaaggcggagcttgcagtgagccgagatcgtgccactgcactccagcttgggcgacagagygagactccatctcaaaaaaaaaaaaaaaatggataaaataagcctgatccagcctcccagagcaggccttccaagggcttcctcctgcctgtgggaagcgtggcctcacctgctcctcccaggagttgatgaccaccaggtgtgcgttctccagctggcagtacttctccgcctcagcccaggccttcccggagtgagagaaccagtagcagctgccttggtgctccacccagttgacggggcagcaggtcctttgggagcctgaggggacagggggcagggagatgagatccagccgga

SEQ ID NO: 144700 - DNA, 601 bp, Human
cactgtcacccgggctggagtataatggcgcagtctcagctcaccacaacctctgcctcccgggttcaagtgattctcctgcctcagcctcctgagtagctgggattacaggcacccgccaccatgcccggctaatttttgtatgtttagtacagatagggtttcaccattttagccaggctggtctcgaactcctgacttcatgatccgcccacctcggcctcccaaagtgctgggattacaggcgtgagccactgcacccggcctaaatcagcatttttaagggcgagatccaggagtygatatattttttttaactcttgaagagattgcaatgtacagtcaagactgagaatcattaatttaaaacagagattcaaaaaggtaagaaacaaaaggatggacagagatacagcaagcaaatgcaagtgacaaaaaaatcaaggaccgtggtatttatatatcagataaattcaaggcaaaaagcattaactgggacacacgttggcttcatagtgacgaaagcaccgtccaccacgaagttgtagtggtcatgagcttattgtgtgccaaatcacagagcactgagatcttaggttga

SEQ ID NO: 144701 - DNA, 601 bp, Human
gagtcagaatctcgcactgtcacccgggctggagtataatggcgcagtctcagctcaccacaacctctgcctcccgggttcaagtgattctcctgcctcagcctcctgagtagctgggattacaggcacccgccaccatgcccggctaatttttgtatgtttagtacagatagggtttcaccattttagccaggctggtctcgaactcctgacttcatgatccgcccacctcggcctcccaaagtgctgggattacaggcgtgagccactgcacccggcctaaatcagcatttttaagggygagatccaggagtcgatatattttttttaactcttgaagagattgcaatgtacagtcaagactgagaatcattaatttaaaacagagattcaaaaaggtaagaaacaaaaggatggacagagatacagcaagcaaatgcaagtgacaaaaaaatcaaggaccgtggtatttatatatcagataaattcaaggcaaaaagcattaactgggacacacgttggcttcatagtgacgaaagcaccgtccaccacgaagttgtagtggtcatgagcttattgtgtgccaaatcacagagcactg

SEQ ID NO: 144702 - DNA, 601 bp, Human
aaaaaacctatataggagaaataccttaagcttagctgccctgtgctgcccctcagggaatggtccaggatgaagccaagattaatttaaattagcattttttttttttttttgagtcagaatctcgcactgtcacccgggctggagtataatggcgcagtctcagctcaccacaacctctgcctcccgggttcaagtgattctcctgcctcagcctcctgagtagctgggattacaggcacccgccaccatgcccggctaatttttgtatgtttagtacagatagggtttcaccattttrgccaggctggtctcgaactcctgacttcatgatccgcccacctcggcctcccaaagtgctgggattacaggcgtgagccactgcacccggcctaaatcagcatttttaagggcgagatccaggagtcgatatattttttttaactcttgaagagattgcaatgtacagtcaagactgagaatcattaatttaaaacagagattcaaaaaggtaagaaacaaaaggatggacagagatacagcaagcaaatgcaagtgacaaaaaaatcaaggaccgtggtatttatatatcagataaatt

SEQ ID NO: 144703 - DNA, 601 bp, Human
aaacaaaaaacctatataggagaaataccttaagcttagctgccctgtgctgcccctcagggaatggtccaggatgaagccaagattaatttaaattagcattttttttttttttttgagtcagaatctcgcactgtcacccgggctggagtataatggcgcagtctcagctcaccacaacctctgcctcccgggttcaagtgattctcctgcctcagcctcctgagtagctgggattacaggcacccgccaccatgcccggctaatttttgtatgtttagtacagatagggtttcaccaytttagccaggctggtctcgaactcctgacttcatgatccgcccacctcggcctcccaaagtgctgggattacaggcgtgagccactgcacccggcctaaatcagcatttttaagggcgagatccaggagtcgatatattttttttaactcttgaagagattgcaatgtacagtcaagactgagaatcattaatttaaaacagagattcaaaaaggtaagaaacaaaaggatggacagagatacagcaagcaaatgcaagtgacaaaaaaatcaaggaccgtggtatttatatatcagata

SEQ ID NO: 144704 - DNA, 601 bp, Human
aaaaatgcaaaaaactacccaggtatggtggtgtgcacctgtagtcccagctacttgggaggctgaggtgggagaatccgttgagcccgggaggcacaggttacagtgagctgagatcatgccactgcactccaacctgggcgatagagccagatcttgtatcaaaaacaaaacaaaacaaaaaacctatataggagaaataccttaagcttagctgccctgtgctgcccctcagggaatggtccaggatgaagccaagattaatttaaattagcattttttttttttttttgagtcagartctcgcactgtcacccgggctggagtataatggcgcagtctcagctcaccacaacctctgcctcccgggttcaagtgattctcctgcctcagcctcctgagtagctgggattacaggcacccgccaccatgcccggctaatttttgtatgtttagtacagatagggtttcaccattttagccaggctggtctcgaactcctgacttcatgatccgcccacctcggcctcccaaagtgctgggattacaggcgtgagccactgcacccggcctaaatcagcatttttaagggcgagatcca

SEQ ID NO: 144705 - DNA, 601 bp, Human
gtggtggctcacacctgtaatcccagcacttcaggaggccaaggcgggcggatcacgaggtcaggagttcaagaccagcctgaccaacatggtgaaaccctgtctctactaaaaaatataaaagttagccaggcacgatggcgggtgcctgtaatctcagctactcgggatactaagacaggagaattgcttgaacctgggaggcagaggttgcagtgagccaagatcgcgccattacactccagcctgggcgacagagcaagactccatctcaaaaaaaaaaaaaattttttttttttttcagatacaacacttaaggaacctaggaaaggaaagactcagacacatgggaataagaggtatcctggtctcctcacctttcctatggaagttatacaaacttttagttttcaaagccaataattttcagcctattatttaaagttatacaagtaatcactggaataactctaaataaactacatagtttccaaaataccataaagaagaaaacaaaaagaacacctctcacatagcaattgtaagaaaattaagaagcatgtaaagcagaaaaaagaaaggactagggttaaacatatct

SEQ ID NO: 144706 - DNA, 601 bp, Human
agtctccatttcaaaaaataaaaataaacaaaaaatttcagataaaacacttgaggggccgggcgtggtggctcacacctgtaatcccagcacttcaggaggccaaggcgggcggatcacgaggtcaggagttcaagaccagcctgaccaacatggtgaaaccctgtctctactaaaaaatataaaagttagccaggcacgatggcgggtgcctgtaatctcagctactcgggatactaagacaggagaattgcttgaacctgggaggcagaggttgcagtgagccaagatcgcgccattrcactccagcctgggcgacagagcaagactccatctcaaaaaaaaaaaaaattttttttttttttcagatacaacacttaaggaacctaggaaaggaaagactcagacacatgggaataagaggtatcctggtctcctcacctttcctatggaagttatacaaacttttagttttcaaagccaataattttcagcctattatttaaagttatacaagtaatcactggaataactctaaataaactacatagtttccaaaataccataaagaagaaaacaaaaagaacacctctcacatagc

SEQ ID NO: 144707 - DNA, 601 bp, Human
ggctgaggcaggagaatcgcttgaacctgggaggcggaggttgtagtgagccaagatcgtgccattgcactccagcctggtcaaaaagagcaaaactctgtcttaaaaaaaaaaaaaaaaaaaaaagccaggcgtagtggctcatgcctgtaatcctagcactttgggaaggccaggcgggaggatcacctgaggtcaggagttcaagaccagcctggccaacatggtgaaaccttgtctctactaaaaatataaatattagccaggcatggtggcaggcacctgtaatcctagctactcrggagactgaggcaggagaattgcttgaaccgggaggcagagcttgcaatgagtcgagatcgtgtcactgcactccagcctgggcgaaagagcaagtctccatttcaaaaaataaaaataaacaaaaaatttcagataaaacacttgaggggccgggcgtggtggctcacacctgtaatcccagcacttcaggaggccaaggcgggcggatcacgaggtcaggagttcaagaccagcctgaccaacatggtgaaaccctgtctctactaaaaaatataaaagttagccaggcacgatggcg

SEQ ID NO: 144708 - DNA, 601 bp, Human
agagaggtgaaaaatagactttgaaaagaagccttgtttcggaatatgaggggatgttggagaacagtttcttttttattattattatactttaagttttagggtacatgtgcacaacgtgcaggtttgttacatatgtatacatgtgccatgttggtgtgctgcacccattaactcgtcatttaacattaggtatatctcctaatgctctccctccccgctcccaagaacagtttctttacatgcttcaaaaattttaaaaagaatgacataaaacatgaaagaagatataaaaaaaaaagagaacatgataaggaaaggaaatgaaaagtttgagctacatactaaaaaaaaaagcccaggtgtggtggctcacgcctgtaatcccagcactatgggaggccaaggcaggtgaatcacctgagatcgggaattggagaccagcctgaccaacacggagaaacctcatctccactaaaaatacaaaattagccaggcgtgttggcgcatgcctgtaatcccagctacttgggaggctgaggcaggagaatcgcttgaacctgggaggcggaggttgtagtgagccaagatcgtgccattg

SEQ ID NO: 144709 - DNA, 601 bp, Human
cgccgtgttaaagactgagaggaggaatcaaatcatgccagatgatcagagaagacagtccgggagaattcattccccctttcctgggtgaaccataggaaagaaagcactgtgcccattcacaaaagtaatggagaaaatcatcatggaacttatgcccccaaaaagaaagaggaagatgaggcagatgaaaaatgaactgtgatatcaaaaagagaggtgaaaaatagactttgaaaagaagccttgtttcggaatatgaggggatgttggagaacagtttcttttttattattattawactttaagttttagggtacatgtgcacaacgtgcaggtttgttacatatgtatacatgtgccatgttggtgtgctgcacccattaactcgtcatttaacattaggtatatctcctaatgctctccctccccgctcccaagaacagtttctttacatgcttcaaaaattttaaaaagaatgacataaaacatgaaagaagatataaaaaaaaaagagaacatgataaggaaaggaaatgaaaagtttgagctacatactaaaaaaaaaagcccaggtgtggtggctcacgcctgtaatccc

SEQ ID NO: 144710 - DNA, 601 bp, Human
aaccaggccacacagagattcaagcatttgtttcttctttcctacgccattgaagaggctgacgattataataattacaatgaattacagaaggaggtgggatctcagtcctccagggtcagggactcttaaactacctcctttctctctttgctcagctcttccccatacccctgtctcagtgtttcttcctttcctcaaaatcctcaacagagaagccagagctgggcaggtgtggggtatgggttagccagaggtgtgctggggtcaggccacctcgccggtggcattccgccttttytcacacacccagcggtacacctgcaggcagaagtcatcgttccagcggccatccggctggacttcaacacagtcttcacttccacccagctcgtgcccgtgccaattatctggctgagtgacagcccagttcctaaggaggcaagagaaaactcggactctgccacggtggtgagaaagcgacttacccatcctcctcctcttcatgaccattttccttgaaggccgagagtggagctggggtgtgccctgctacccagtctggggagaacccaaccgcagagaaagatgtttcctatgc

SEQ ID NO: 144711 - DNA, 601 bp, Human
ttctcacactcagacacacaccccctctcattcccacacacacaccatctcattctcacacacacacacctcattctcacacacagactcacacacactccatctcattctcacactcacagacatacacactccctctcattctcacatccacacaaggctctcatacacacacccaaaacacactccccctcattctcacacacagactcacacacacacacactccctctcattctcacacacatccacacacactcacactttctcacacacatccacacattctcactctctttcwcacacacacacacacacacacactccctctctgaccttcactcaggtccttctgctgtttctccagctgggactctagcgacttcatctttcttcccacattgcctcctgcgggagaggctcgctcagcgttcccgacagccccccagccccagccccagccccagccccgccccagcgccctcaccctgggtgctcaagcccttgacctgggcctccgtgctcgctgtgaagttgctgaacgtctctctcaggccccgcagctcctcctgcagctgggagtctggccaggacagcgtgc

SEQ ID NO: 144712 - DNA, 601 bp, Human
tcacaaacacacacacactcacagacacacacaccccatctcattctcacactcactcacacaccccatctcattctcacactcacagactcacactcagacacaaacacccctcattctcacactctcacactcacagacacacacaccccatctcattcttacactcagactcacacacacctcattatcacactcacagacacactccgtcattctcacactctcacacacactccctctcattcccacagactgtctcacacacactctatctcattctcacactcagacacacacyccctctcattcccacacacacaccatctcattctcacacacacacacctcattctcacacacagactcacacacactccatctcattctcacactcacagacatacacactccctctcattctcacatccacacaaggctctcatacacacacccaaaacacactccccctcattctcacacacagactcacacacacacacactccctctcattctcacacacatccacacacactcacactttctcacacacatccacacattctcactctctttcacacacacacacacacacacac

SEQ ID NO: 144713 - DNA, 601 bp, Human
ttcacagggcctatgtggtgctggacaaatttctgaggagagagaaggcgggtggtgatctctccgaggccagccagcctcccagaccctccgggtcctcacctgctcctcccaggacgtgaccaccaccaggtgcgcgtcctccagccggcagtagttgtcggcgtcagcccaggccttcccggagcgagagaaccagtagcagctgcgctcgtgctccacccagttgaccgggcagcaggtcctttctgagcctgagcgggagaaacggggcgcaggggctaagcgctgcccagagaakgggggaggcagagagcgggccgggctggcctccttaccattgccctggagcgccgccatctgacagctcaggctccgcaggtcagacacgaactgcttcacgtggagcagcaggctggagtgatctggggagaccgggcggaggggagcgggaggagatgcggaaaccacggggagggaaacgggaaacgaggtcagccctacatcctcctgctgggacccgaacacccgtcgcattgccacaaacagcagcggagttggcctgagagacccccatacacacacacacacacactcctac

SEQ ID NO: 144714 - DNA, 601 bp, Human
tcgcattttaaattcccagttgctaacctcttatgttacctggtgccacttctgcatttccctgtacctatcctctacaacctgcttagaaatctattttgtaccttcccttctctgtttaatcctcagtaacctcctccttcatgcccagtctcagctgatcactttgtatcttattttcctaaaaatatagaagcagcagaagagaatctccacatgtccctgtgtgccatataatctgccatctacatcctgttatgtgactgctatgtccctgctgtcatgcgaggtgccccccccsccccgcgccatgcgtacaatatactcgtgtcttcttgcttcttcaaggatgttactctagccacttttctttctctcatgagttttttcttttctactgggccaaatctgtaagcatacaaatatattgccattttcccatcttaaaaacctttcaactaaacgctccctctgagtattacaaccctggaatctggaccacagggaagaagttgactttgtaaaatcaccttgaccagtccctttttcagctagaaatggtgacgaattttctttgttagttttccaatatcaaggaaat

SEQ ID NO: 144715 - DNA, 601 bp, Human
tctgccatctacatcctgttatgtgactgctatgtccctgctgtcatgcgaggtgcccccccccccccgcgccatgcgtacaatatactcgtgtcttcttgcttcttcaaggatgttactctagccacttttctttctctcatgagttttttcttttctactgggccaaatctgtaagcatacaaatatattgccattttcccatcttaaaaacctttcaactaaacgctccctctgagtattacaaccctggaatctggaccacagggaagaagttgactttgtaaaatcaccttgaccrgtccctttttcagctagaaatggtgacgaattttctttgttagttttccaatatcaaggaaataggtctaggagctgtttgcattatgtcgattaaagtaatttaagtgcttaaagaaatttaagtaatgggacagaagctatcccatttaaagccacatatcttgagagtttgtcgtatcttgacatatataatgttgcctttcccactaacatgtaagctccatccaggtgttgatttaggttgtcatgttcactgttgtgtgtccattactttgaacagacctgggcctggccagga

SEQ ID NO: 144716 - DNA, 601 bp, Human
tctaatcttatgagaaaatattattaactctactttttaaatgtctagaactattttgctcttcatggtttacaattacttccctggttcaaatccctattgtgtctcacttagaattttcaagttttgtaattgattggcttacttactctccacctgtgcacagccagaatcatccttttaagaaatgaaaagattatgccactcctttgcccaaaattccagtggctcctgtctctgaataaaagccaattcttagatcagccttggcaagtgaacaaaaacaaaataatagtaatgraaactaatccttaattggcctatggtaagtgcttcatgattggcctcttttttctttctgtcctcatggcctatatgactgtctcactctgctctgtttgctcctactgtgtcttttctagtttgtttcagtcttcttccacagactagaatataaactccatcaaggtagttctttttaaacattttgttcactgctaaattctgggcacgagaaaagcttctagcacatagtagatactcagtaaatatttgtttattaaatatatgtcccagcctatggacacagtatctatgtagc

SEQ ID NO: 144717 - DNA, 601 bp, Human
ggcttacttactctccacctgtgcacagccagaatcatccttttaagaaatgaaaagattatgccactcctttgcccaaaattccagtggctcctgtctctgaataaaagccaattcttagatcagccttggcaagtgaacaaaaacaaaataatagtaatgaaaactaatccttaattggcctatggtaagtgcttcatgattggcctcttttttctttctgtcctcatggcctatatgactgtctcactctgctctgtttgctcctactgtgtcttttctagtttgtttcagtcttctyccacagactagaatataaactccatcaaggtagttctttttaaacattttgttcactgctaaattctgggcacgagaaaagcttctagcacatagtagatactcagtaaatatttgtttattaaatatatgtcccagcctatggacacagtatctatgtagcaagagtcaaacctggcagtaacttggagctgtggttgtagcaagagtcaaacttcgcagtaacttggttatctggttacagtaacttatgattgtgactctttgttgtctttgtgatttccccccaattactaccata

SEQ ID NO: 144718 - DNA, 601 bp, Human; identical to SEQ ID NO: 29102

SEQ ID NO: 144719 - DNA, 601 bp, Human
ggatggtgtatatatcattatgttcaattctacagtacagtggttgttaatatgtcattgaatgagctctagccatggagatctgagtcacttctcttgggattgctaggtggtagatctagcagaaaattaagccaaactaaacactgtgcatgatggctttttgattttaatattgatagatgagggaaatttttaatgtgattttcatgttggtattttgggataggcctacaaatcatattcctcttatagtctactgtttttctggtatcttataaggaaagacttgctggagaawccatccaatttatattgtgagttgggattgacatttgaaatacgatgaggacttcagcctgggcagagtgtgtacttttcttagtttgaacttaccctactgtgccacagtaatggctgtggctctgacacctccaactccatcttttttgttaccccaacatattacatggtgctaggtgatgcagagaataaaacaatgttgaatgcatatgttaccttcaaagagctccaagcctgtagggaaaataacagaactgcagtttgaggtataggaaagatacctgcccaaagagaaata

SEQ ID NO: 144720 - DNA, 601 bp, Human
gcctgggcagagtgtgtacttttcttagtttgaacttaccctactgtgccacagtaatggctgtggctctgacacctccaactccatcttttttgttaccccaacatattacatggtgctaggtgatgcagagaataaaacaatgttgaatgcatatgttaccttcaaagagctccaagcctgtagggaaaataacagaactgcagtttgaggtataggaaagatacctgcccaaagagaaatacaacctctatgctaggagaggcattcacaggcaggtaggggcacatctggtggaagsgttcagcaaaggcttcgtggaagagttaagattggcttgaaggatggacaaggtcttatcaggcagagacatgagaggagggatcttggaaaacagcaagtgtgaggaggggagaggcttgggacgtgtgttcagggaacagtaagtcctccagtttgcctggtgtgtattcagggaacatgtaggggatggagaatgtgaaattgagatgttggctggggacagaatgaatgtcagggtgagaaacctgcagtttctttggtacaccatgggactcttgagggatttggggcagccatg

SEQ ID NO: 144721 - DNA, 601 bp, Human
ctccatctcgtcagctccactttggggaagtatagaatgagagagactgcaaagcccctagaaggatgtctagtaacccgggctctgtctggaggacgtcctacagcgagaaagattttgactatcacatcataatgtgcatgtctctgaggagaagaatatatttatattcattatcacacaggcctttgtactgtgtaattatttgctgaatgtttaaattaaatgctgcttttccagctgggtgtgcttgtagtcccagctactcttgaggctgaggcgacaggattgcttgaggccygcagttgaactgaaaagccagcctgccagcctgagcaacatagtgagaccccatctcttaaaaaaaaaaaaaaaagaaagaaatgctgcttttctggctaaattatcaccttagaagcgattgtttttgaatcaggaagtagactctttaaatattaggctgtggatattctggccacagctgtgttttgcgcagatgtttctttagttatgaaaggaggacagcattccatgattgaaatgtcaaccttctgagatgctggtggagaaaatttaatgaggtggcctcatgaggtaaggc

SEQ ID NO: 144722 - DNA, 601 bp, Human
acccgggctctgtctggaggacgtcctacagcgagaaagattttgactatcacatcataatgtgcatgtctctgaggagaagaatatatttatattcattatcacacaggcctttgtactgtgtaattatttgctgaatgtttaaattaaatgctgcttttccagctgggtgtgcttgtagtcccagctactcttgaggctgaggcgacaggattgcttgaggcctgcagttgaactgaaaagccagcctgccagcctgagcaacatagtgagaccccatctcttaaaaaaaaaaaaaaaagaaagaaatgctgcttttctggctaaattatcaccttagaagcgattgtttttgaatcaggaagtagactctttaaatattaggctgtggatattctggccacagctgtgttttgcgcagatgtttctttagttatgaaaggaggacagcattccatgattgaaatgtcaaccttctgagatgctggtggagaaaatttaatgaggtggcctcatgaggtaaggctattaaaagtgaacgtttgaattatctgcttgattttttaaaacagaacttattactataaaggcctgggcagct

SEQ ID NO: 144723 - DNA, 601 bp, Human
tcagaaaactgtttactttctaaaagatggtagtttatagtttcttcccccctttttcttctcttcatccaaaccttggaaaagtaatattgttcagggctgctttttttcaccttcttctttttttttttttttttgagttggagtttccttctgttgccaggctggagtgcagtggtgcgatctcagctcactgtaacctccgcctcctgggttcaaccgattctcgtgcctcagcctcctgagtagctgggattacaggcgcgcaccaccacacccagctatttttttttttttttttgtatttttagtagagacgaggtttcaccatgttggccgggtggtcttgatctcctgacctcgtgatctgcctgcctcggcctcccaaagtgctaggattacaggcatgagccactgtgcctagcctttttcaccttctgttttgaacacatgacagccagtgttatgatgtagtatatgttaagaggaagtagatatatctgtgtacattcatagttagttctttttttttttttgaaacagggtcttgctctgtcacccagactggagtgcagtggggcaatctcggctcactgcaacc

SEQ ID NO: 144724 - DNA, 601 bp, Human
tatacaagaaacttagtatttagatgggatagattttgatgcagaacactgtactaatgctttggagatatgtatttgtaaagaaggaagtagaaacacatgcagtacaggataatacatgaccaaagctgcaaatgtatgtgttaggagttcaagaaaggaagagattattgctacccagggtgataagcactgagctagtttttgaagggtgtataatagcaaagagtacattttatgatctctgtgaggaccagtactacctgtttttgctcaccattatgtcccaacacctagcacygtgcctggcatagatatggggctcaagaaattttagttgaatgaatgaatgagtgagtaagtgaatgaggaagaaaggaaagaaaaagatttcaggcagagtcctgagaaaaggcacaagaggtgtttgggaatagcaagattctgttagaggaggtgtaataatatttgaatggagaggagtcacaggtcacagcagcagtcacttagttggggactggattgtggaaaactgtttggatgtcagtaaattgtgcttgcttgtaaatggcagagagtgaccagggctctactttaggac

SEQ ID NO: 144725 - DNA, 601 bp, Human
caggtgtgacgtttacgtagtgggtggggaaggctgatcaccccaccctaatcttattatgcaaatggactttccactcggccagtgccgtcttgtctgctcctcactgtacatgtggctggcaaaaagagaagatggagctgccattttgaacatgcctagtcccaggtagtagtattcctactggcacaactgccgacattcacctgtgcaagtttccagcttgcttgtttacgtgtgcagctctcttttacaggctgctgtttgttaaaagagaaaatgattttagggctgcttttcrttaaaaggaaacccttaccgagggctcccgaaccctcagtacctgcctaagtaatttctttttaactcgtatatcaaaaacatctggtaaatgatcacaattatttgttgttgacagtgaattcctttataagaaataatttgtgtaaactataaatttgaataagatatttcctttattgttaatttaattttttggtcttaaatattttcacatcctagtgacaaattgaagaatttgccagtttagacttctctttttttttttttataaaatttaattttcttttgagaactggaa

SEQ ID NO: 144726 - DNA, 601 bp, Human
ctaatcttattatgcaaatggactttccactcggccagtgccgtcttgtctgctcctcactgtacatgtggctggcaaaaagagaagatggagctgccattttgaacatgcctagtcccaggtagtagtattcctactggcacaactgccgacattcacctgtgcaagtttccagcttgcttgtttacgtgtgcagctctcttttacaggctgctgtttgttaaaagagaaaatgattttagggctgcttttcattaaaaggaaacccttaccgagggctcccgaaccctcagtacctgcmtaagtaatttctttttaactcgtatatcaaaaacatctggtaaatgatcacaattatttgttgttgacagtgaattcctttataagaaataatttgtgtaaactataaatttgaataagatatttcctttattgttaatttaattttttggtcttaaatattttcacatcctagtgacaaattgaagaatttgccagtttagacttctctttttttttttttataaaatttaattttcttttgagaactggaaaaggtagtttatttcaaatttggtccccatgattgatgtactttagt

SEQ ID NO: 144727 - DNA, 601 bp, Human
aaaagagaaaatgattttagggctgcttttcattaaaaggaaacccttaccgagggctcccgaaccctcagtacctgcctaagtaatttctttttaactcgtatatcaaaaacatctggtaaatgatcacaattatttgttgttgacagtgaattcctttataagaaataatttgtgtaaactataaatttgaataagatatttcctttattgttaatttaattttttggtcttaaatattttcacatcctagtgacaaattgaagaatttgccagtttagacttctctttttttttttttataaaatttaattttcttttgagaactggaaaaggtagtttatttcaaatttggtccccatgattgatgtactttagtaatgcatttattcagttttgtgtatctggatatgtggcatttcagtgagacagcttctacagagaattggaaaattacattctgaaatatcaaagttttataatttgaataatttacggaaacctttctaaaatgaatatacatttctgccttcttaaagaatttactggccaggcatagtggctcacgcttctaattccacgctttgggaggccaaggtgg

SEQ ID NO: 144728 - DNA, 601 bp, Human
ttgtatttgatttactttctcctgtgttattgtagtatgccaattttatttcctggtgtttggtgaaataggttcatatgtgaaccatattgctttcaaaagtacatgtggctaagccaatctgattgttagaaattgtacatctttgaatttgagtttgaagttggattgtaatggttagtatgaaactggaatttgatgacgaattcttttttaaaaaatttcaacttttattttagattcaggggtatatgtgcaggtttgtatacaagcatattttgtgatgctaaggtttggggtrtaaatgatcctgtcacccaggtagtgagcatagttcccaatagttagttttgcaaccctttactcccttcttccctccccacttcagtagtccttcatgtctattgttgccatctttttgtccgtgagtagtcaattgtgtagttcccacttataaatgagaacatgcggtatttggttttctattcctgcattaattcttttaggataatagcctccagcttcatccatgttgctgcaaagatagaacgatttattttcttttggatatatacccagtaatgggattgctgggttgaat

SEQ ID NO: 144729 - DNA, 601 bp, Human
tgatagtttattttgctgttcagaagctctttagtttaattaggtcccacttgtcaatgtttgctttttgaggacttagtcataaattctttcctgaggccgatatttagaatggtgtttcctaggttttcttctaaaaatttttttttttttttgagacacctaagttggagtgctgtggcataatcatggctaactgcagccttgaccttctgggctcaagtgatcctcctgcctcagcctcccaagtagctaggactatagatgtatgccaccacacctggctaattaaaaaaaaaawttttttttttggagacagggtctcattttgtcacccaggctggagtgtagtggcaccatcagaaatcactgcagcctcgacctcccgggctcaagcaattctcctgcctcagcctcccaagtacctgggactacaggcatgcactaccacacccagctaatttttgtaatttttaggagatggggttttgctatgttgcccaggccggtcttgaactcctgggggtcaagcgatcggcctgccttagcctctcaaagtgttgggattataggcatgagccactgcacccagcctaaagtt

SEQ ID NO: 144730 - DNA, 601 bp, Human
cggtgtttggttttttgttcttgcgatagtttactgagaatgatgatttccaatttcatccatgtccctacaaaggacatgaactcatcattttttatggctgcatagtattccatggttgtatatgtgccacattttcttaatccagtctatcattgttggacatttgggttggttccaagtctttgctattgtgaatagagccgcaataaacgtacgtgtgcatgtgtctttatagcagcatgatttatagtcctttgggtatatacccagtaatgggatggctgggtcaaatggtatwtctagttctagatccctgagaaatcaccacactgacttccacaatggttgaactagtttacagtcccaccaacagtgtaaaagtgttcctgtttctctacatcctctccagcacctgttgtttcctgactttttaatgatcgccattctaactggtgtgagatggtatctcattgtagttttgatttgcatttctctgatgcatctctgtgttcttctcatgaagcctgtgtaaagggacagctaaatttggtgccacctgtaatataaatttcaaaatattaccaacctgcctaatagg

SEQ ID NO: 144731 - DNA, 601 bp, Human
ggaaccaacccaaatgcccatcaatgatagactggattaagaaaatgtggcacgtatacaccatggaatactatgcagccataaaaaatgatgagttcatgtcctttgtagggacatggataaagctggaaaccatcattctgagcaaactatcacaaggacaaaaaatcaaacaccgcatgttctcactcataggtgggaactgaacaatgagaacacttggacatgggaaggggaacatcacacaccagggcctgcctgtcatggggtggggggatgggggagggatagcattgggagmtatacctaatgtaaatgctgagttaataggtgcaacacaccaacatggcacatgtatacatatgtaacaaatgtgcacgttgtgcacatgtaccctagaacttaaagtatatatatatatataaagtacaggtgtgagatgaaaaggatctggacttctgttggcaaaataggaagagaaagggaaaggatgaattatagtagtagcttgtttgatatatcagaattaaatatttatttgttggcctactgtgattgagagatttaatgcctgagtgactgggagaagcaaagtgttttt

SEQ ID NO: 144732 - DNA, 601 bp, Human
agtctgggagacgttatgtgtctgattaaactggacccctctggtgccattcctattgctttggataatggtggaatgtcacaagtgagcaataaatgcgagctgttgttgcggttattatagagggctggctatgtccacttcagtttagaaagttcagaagggtatttgctttgtaatccccgcactttgagaggtcggggtgagcagatcacttgaggtcaggagttcaagaccagcctggccaacatggtgaaaccccatctctactaaaaatacaaaaattagccaggcgtggtgwcacctgcctgtagtcccagctactcaggaggctgaggcatgagaattgcttgaacctgggaagtggaggttgcagtgagccaagatcatgccactgtattccagcctgggtgacagagtgagatagtatttaaaaaaaaaaaaaagaagagtatttgttccagtttcaagatagaaatctaaaacataaggtggatagtggctggctgcagattgtgatttgtaatgggtcatgtgctgtgctgctacagagctggcaaatagtccagaggtctcagtattctttctgtgaccctctcta

SEQ ID NO: 144733 - DNA, 601 bp, Human
catcagtgatgaaagaacagcactataacttgtccctttcagcaagtagatttgtaaaataaatacagtttcacattattaaccaatagcagtagtttgtcataaaacctaaattcttagtagaaaagagcatcaaaaatgataatccagacttgaagatagactgttgatattttcttccccacaggtattttagggaattaggaaatgtaaatagggagaggctgggagccataagagcgtcgagtccctatgctcagtctgactcatgtttattgagagcctggcctgtgtaaggcaktatttagatatttgcaattcagagatgataggagatgcttaggtctgaagagcctttatttcctttttggtaaatcaaacataacttattgatggggaacaaataagtggcaaaaccaaccaaccacccaacagacaatgagacaatgaaataaaacagaaaaaggcaatgttcaggcagtcagtagttccaaattgagaaagcaaagaatcaagtgtcagcaccattggttgtaacctttacatccctaggtaacttcaatgcatcaactcaactgagctgaattaaatgctgtgcctt

SEQ ID NO: 144734 - DNA, 601 bp, Human
gagtgacttttcaagggcctcattctaaggaccttgagggaagagggcaccagctactagacctcaaactctgccccatcaacccaaaagctctaggggaaaaagcccagcagtattgctggaaaagctgtcagctattgcagggtgcaggctgagaagagtggcagactgtcagccaggctgtgggctggggccttgcttgtagcactgaggtgcccagccctgcccaccttttgtcccttgatgtagctgcaataaacccttggcctaccccttgtggcagcattctttcttgctctgyagatagcatggtatagtacaaggaatagtgtctaagagtcagaaaacatgtttttcatcttgaagggctctgtgatgatgcactttatctctctcagctttatttagtttccttatccgcaaaatgagagggttggatgtaatgacccctacatttcctttcagttcttaggatactgagagtatttgtagtgccagccaggctattgcttttattttaagagcatacatgaaaagctggcagttagcatgaaggttcagtgaagttctggtaagctgaatattttttaccttacattga

SEQ ID NO: 144735 - DNA, 601 bp, Human
atcaagcggtggcacacgactgtaatcccagcactttgggaggctgaggcgggcggatcacaaggtcaagagacggagaccatcctgaccaacatgtctctactaaaaatacaaaaattagctgggcgtggtgatgcgagcctgtagtcccagctactcgggaggctgaggcaggagaatcgcttgaacccaggagtgggaggttgcagtgagccaagattgcgccactgcactccagcctggctacccagcgagactctgttccccctccccaccgcaaaaaaaaatatatatatatattgcagtgcatccacctcaacctctccagccaccaaacctgtgcctgccattctggggacctcaggtttgccctactcttctcatttctttacccctttttccctcccttgcatcttctctctcttctttccttacttatttatttatttatttattgagactgagtcttgctctgccccacaggctgcagtgcactggtgcgattgtagaccattgtatcctcagactcctgtgctcaagcgatcctcctgcctcagccctccctagaaggtgggactgcaggtgtgtgccaccacagcca

SEQ ID NO: 144736 - DNA, 601 bp, Human
actctgtgacaaaatatgtcttctgatggagaagtttccaccactttaaagcaaccaaaaggggaaaaagcagtcctagcatggtggaagaagtgctgagtacagcatgagcttgtcttacacactagttacagtcttgagaagcagtgtgaagtgattattcttgaactggtcatgtcccaattgatttttctaattttgtaactgtattccccagagggctttttgacacaaacccttaatacacacggaactaaaaattggcagtggatccttaaagagaattttatgcctttcttcrtattgtttgtatgtatttacttgttgacagtcttgtaagatagtcaataatatccattatacatatatctcagttaaaatttacatatattaaatgttgctagttggataagtgtccgttttctgggggaatcttctctggatacaaaagacctttaccttcggagcagccatgtaacttacatgaggcaagctaggtaggtaggtatattttatcaaacagaagtctttaagagtgaaggtgttcctgttcctaaaatgtggaatcggccctctgttaagtggcattgactgactaata

SEQ ID NO: 144737 - DNA, 601 bp, Human
attgtgaatagtgctgcagtgaatgcacatgtgcatgtgtctttatgacagaatgatttatattcctttaggtatatactcagtaatacgattgctgggttgaatggtatttctgtttttaggtctttgaggaatcaccacactgctttccacaatggttgaactaatttacactgccactaacagtgtataagtgttcccttttctctgcagcctcaccagcatctgttatattttttgactttttaataaaaaccactctgactggtgtgagatggtgtctcattgtggttttgatttrcatttctctaatgatcagtgatactgagctttttttcttatgcttgttgactgcatgtatgtcgtcttttgaaaggtgtctgctcatgtcctttgcccacataatgaggttttgctacatgtgatatatagtgatcagaacggatccaggcaatcagcatatcaatcatctgacacatttataatttctttatgttggggacattcaatatcctccttctagctatttgaaaccatatattactgttaactgtagtcatcctacagtggtatggaacactagaacttaccctatctatta

SEQ ID NO: 144738 - DNA, 601 bp, Human
acttaagaaactaacacacttacttaattattttagttttaattttgaaaatagtgtcttctactacattttattttagatatatgattttaatgataatagtgaatatattatcatgtttggactagcttaggaaacttaaaatcctaagattttgtctttgggaaaatatttccagaagtcaaaatattatccttggcaaggcacaatggctcatgcctgtaatcccaacactttggaaggccaaggcggtaggattgcctgagcccaggagttcgagaccagcgtgggcaacatagtagaccccatctctactttaaacaacaacaacagaaaacaaaacaaaacaaaaaaccgcatattatcttttacagataaatgtttggagtataatgtatttgcaatttaaagactttctataattgctaacaggtgttaagaggatttaaacatccagtcctggtctgttacagtggatctgcatcaccatcttcattacaaagttatggttccttgccttgtaaacttgatccaattcagtcctgggtttaaataacatacttttttttcattttctttcttcatttggaaagttttatga

SEQ ID NO: 144739 - DNA, 601 bp, Human
tattttagatatatgattttaatgataatagtgaatatattatcatgtttggactagcttaggaaacttaaaatcctaagattttgtctttgggaaaatatttccagaagtcaaaatattatccttggcaaggcacaatggctcatgcctgtaatcccaacactttggaaggccaaggcggtaggattgcctgagcccaggagttcgagaccagcgtgggcaacatagtagaccccatctctactttaaacaacaacaacagaaaacaaaacaaaacaaaaaaccgcatattatcttttayagataaatgtttggagtataatgtatttgcaatttaaagactttctataattgctaacaggtgttaagaggatttaaacatccagtcctggtctgttacagtggatctgcatcaccatcttcattacaaagttatggttccttgccttgtaaacttgatccaattcagtcctgggtttaaataacatacttttttttcattttctttcttcatttggaaagttttatgaaatgaagctcatgatatacccagaagtaagcagtgaaactcagcaccaggagtttttaacatgaaaccatt

SEQ ID NO: 144740 - DNA, 601 bp, Human
caaaatattatccttggcaaggcacaatggctcatgcctgtaatcccaacactttggaaggccaaggcggtaggattgcctgagcccaggagttcgagaccagcgtgggcaacatagtagaccccatctctactttaaacaacaacaacagaaaacaaaacaaaacaaaaaaccgcatattatcttttacagataaatgtttggagtataatgtatttgcaatttaaagactttctataattgctaacaggtgttaagaggatttaaacatccagtcctggtctgttacagtggatctgcrtcaccatcttcattacaaagttatggttccttgccttgtaaacttgatccaattcagtcctgggtttaaataacatacttttttttcattttctttcttcatttggaaagttttatgaaatgaagctcatgatatacccagaagtaagcagtgaaactcagcaccaggagtttttaacatgaaaccattcagtttgggagtatgtattattcaagtgatattctggagtgagtctgtttttgcgttttatataaggactaccttttgatgatgaatgataaatgttctacagggttatat

SEQ ID NO: 144741 - DNA, 601 bp, Human
aaagactgtctcactttagagctgtgatcccaaggaaacggaggaggtggcatctaaacactgcgatgatgcaaggtaggctcaggttgagtctggtcacttcataggccattcccagccccctttagagtccttgaagtcagtgtctttaagctccataatggagatttcagactatctctgtgccctcgtatatgtgcaggttcctgtgcaaattgtaagcgttaagtaaatatatatgctgattgaattacagtcatctgtggtgatttgtgctctgttccacctcctgctggctgcrttgtatcccatgttggaagtggctgagtgtggcttcagaatagacacagaggaagtgggagagtgaatatttggatgagggagtatgccttgactaaatactttctataagcaaatacaaatcatatgacctagagcttttattttttaaaatcagtctattgctttctcttgaagcacatcattggtgaattgactctatttggcttgatgctttcatacaactgggctgagaaagttcattttacccctcttttgggcattcccactatagttgtagtgatatagtcttttaaaatct

SEQ ID NO: 144742 - DNA, 601 bp, Human
atggagatttcagactatctctgtgccctcgtatatgtgcaggttcctgtgcaaattgtaagcgttaagtaaatatatatgctgattgaattacagtcatctgtggtgatttgtgctctgttccacctcctgctggctgcgttgtatcccatgttggaagtggctgagtgtggcttcagaatagacacagaggaagtgggagagtgaatatttggatgagggagtatgccttgactaaatactttctataagcaaatacaaatcatatgacctagagcttttattttttaaaatcagtctrttgctttctcttgaagcacatcattggtgaattgactctatttggcttgatgctttcatacaactgggctgagaaagttcattttacccctcttttgggcattcccactatagttgtagtgatatagtcttttaaaatctcattcaccaattattaattaagctgaattaacccttttgggtagatgcattcttatccttatatgtttaaagtagctgttcattaaacataggttttttgctgagcatctatctgacaggaggcatctgaaggtttataaaggtatgggaagcttggtta

SEQ ID NO: 144743 - DNA, 601 bp, Human
tttagaagatgctttgaaattaatttcattcagaaaatatttttatgattctgctgagagaaggcaaaaatatttttagaaatattagaatatctggcaacaaattttcgagcattaaatatggattttatttttagaaagagtacacatttgacattgcataactaatttacttacttcacatttaaaaaacagatttgtgtatgtctgtgaaaaagacaatgtgttgatagtagaactataaggtagaaagttcctctttctccttctgatccttcccctgcccttttcctcaaatgtgactacaaactgttaacagtttgaagtcccctaagttttaaaatcaaatggaatgaaatggcatttaggaacttggaagagtggaaaccttttttccagacctatgctaccaactgagtttatattttcaggcagatatgatgaaattgctgtgggctttggagtcagcccactgttcgaattctgttttcatcctagagcaacaacgcgagtttggaaagttccttacctttcttactaaatgtcacttttcttctgagctttaatctagcctagtctgtctctctcctctctctctttt

SEQ ID NO: 144744 - DNA, 601 bp, Human
agcaacaacgcgagtttggaaagttccttacctttcttactaaatgtcacttttcttctgagctttaatctagcctagtctgtctctctcctctctctctttttaataagcagacatgtctaagaagatctggcataagaatatgtgacatattttgtcctggaaaaatcgaatttggtattttaatgacccagcatgcattcatgcagtaatgcactcactcatcaggagaacatttccccactttgcccaaatacctaccttcaggttgtgaaaggtcaacctgtaaaagatgccccargaatcttcctggaatttagatggcctctgttgggtttcactttgcacttattaataattgagcactgggataaaaataaaaacaaagggtctcatcttgcagtgtgagaacatgggccatgtgtgctaagtcatgcaggtaagatgaggagcaaagccctgtggggtagccaatctaaagaagcattccatgtgggctggtgcctccctcttgcagaatgactccctccaaattaaagggaattaacgtaattgctcctggggaggaaaatgcatttttgcttttcaaaggttgttgtct

SEQ ID NO: 144745 - DNA, 601 bp, Human
atagttgaatttctggcttgtgtgacagcagtgagtgttgtgatgtcacttgtgagtcagtctcaggatgttctgttgaattggagggtaggtgtgtcaaaaactgtattcacttttactgagaatagccaatgtgttgattaagagtgactttaggtgaaaatcaggggaaaggggtgtttttcatctaccttaattctttgagtcatccattttcagtgttggcttggcagttagccttcaagggaacaagaggcctttcagttctggggtcagactcagcagagtttgaattgacaawctaggtatgaatctttttaggttctcttcctttcagtgtactactaaattatagtgtatactattgagcaaacaaagtcgtattaatctcagcttgtctaaaaccccaggagaccagtgacccttagtggaatgtccagattgttttcatggcagtcagtggcagtggttttcaaatctacattgttggtgctcacaaaacagtatttgtgaaaatttaaagtcccgcaaaacattgaaaagataaccaatctaaattgtacaattcttatttaagatgtctcttgtgcttttaaattca

SEQ ID NO: 144746 - DNA, 601 bp, Human
aagctgtgaacattcgatgtcttatccctttagttttttcctaaagcttggagaagaggctagaatttacaggtgtttctcaaagttatgttgatcctcaaacttatctgcatacgtggggagctttaaaaaactactgatccctagattctgtgcccagaaattttgctgtaattggtcaagggtgaagtcagagttattgggattttgaaaaactgcatatatgatgccaatatgtgtggtcaaggttgagaactcctgctctgtaagatgtaccatggcaaaatatatatatatataacaagtatatttatatatatattatatatatatcaagtatatttatatatatattatatatatatcaagtgtgtatatatatatatcaagtaaatttaaaactctccatcttggagatttacaaagcaaatttctgttttaaagattctgaatggttctgagtaatgaagtaacctgtttagctctgtataacccagaattttctttcttctttttgtttttttgagatggaggtttcactttgttgcccagggtgggcttgaactcttgggctcaaatcctgtgtagttgggatcacagg

SEQ ID NO: 144747 - DNA, 601 bp, Human
aggggctgaggctggaggatcacttgagcccaggaggtggaggctgcagtgagccaagatcataccactgcactccagcctgggtgacagagtgagaccctgtttcaaagaaaaaaaaatctccttttagtggggttcggtagatgcatgggttcaatcttccatctttatcttctctctttctcccccagagaatacataacatgttcttgtgtcccttcactgttatagtattttcctgtgactacgtatgagccacatgccacgattaagccatttctttcttgtccagtctttgggrcagattttgagaacctgttggcactatgtggctgtcatgaggattaaatgcgctatgcatataaattacctgacacagtaggtgctcaaaaaaggcatgccgtttccttctctcaatctggaggatatgactaaattctattgcattccttattagatttcaatttgtaaacttctctgtgccttttcagcctgtggtgactgacttgcctagttctgtcggatggcatgttaactttccctcccaactttggaggcctgcagatttgaccaccgggtcaccagagctctccttttagtc

SEQ ID NO: 144748 - DNA, 601 bp, Human; identical to SEQ ID NO: 28418

SEQ ID NO: 144749 - DNA, 601 bp, Human
ccatctcctgttacttcactgtacgtactctgtgttccagctcctcaaactgcttagttactgtttcttgaatatccctgttgcttggctgaggttgctttttcccagattcccatccttttaacctcccgctcctccatttcgtttgtgttaaaatcctgcacagattacatctcacctctggagtactcttcttccctgccttcaatttcatgtgttacaatttgtactttccatttttcttatatcatggctatttgtgtacaagcctaattttccttattaggttgcaaattccctrtggatggaattatgaccaaatagaaaaacatatactttgttcttggatagaaagacttaacatcataaagctgctacttttcccaaaattaatacatttaatgcaatttatgaaaaaaacccaaagagagttttttttaataccataaaagcattttagtagtgacaaagtaagattcccctctaaaatccccaagttagaaacaaagggaatatgtacttataagaaagaaggtcagataacttgtagtacatctgaatcactgaatgttatgcagtcattttaaaaaatgaattgagc

SEQ ID NO: 144750 - DNA, 601 bp, Human
attgtcttgatagaagttagagccacatttggcctgcaggcctgatgacagaggcacctgttactgccttgacaacagtcaccgcacagggcttccttttgttttttcatcatggcatatggagaaaatgataatatttgctcaacaccctgtgatgatagctcatagctgttggcaagtggcctggggactctggctgctccagtctgcccaggcagctccattctggtcacactggctaggaagctttgttttacagaaataatgatgtgcagatgaacatttcttatttgaaagtcargtagccacaccatgctccttatggcctcattctcatagcttttcagttcatttgttgaacagatattaaatgcctcatgtttgctccatatatttgctaggcccaatgtttctttttctttttttgttttttaggaggctaccagtaatatcatctctccatgtgtagggttaaagcctttgctcttgtcacctggtaccatagaatccatgtattcttgtgcctcattctgcagaagttgccatatttgagtcttgcttcaagcccctacttttatgcttatcaatttagttgtgatac

SEQ ID NO: 144751 - DNA, 601 bp, Human
tatatttgctaggcccaatgtttctttttctttttttgttttttaggaggctaccagtaatatcatctctccatgtgtagggttaaagcctttgctcttgtcacctggtaccatagaatccatgtattcttgtgcctcattctgcagaagttgccatatttgagtcttgcttcaagcccctacttttatgcttatcaatttagttgtgatacaaaatttctcactgatccatgacaggctgaaatgtggactattttgttcctgagatattcaagcaattcacaggttatcattattgctrtcttcacctaaagggtgctcttttggggaaagaccatttctattctagaaagtgatttcacattattttagccacattacaatgtagcgcatctgggaactgtttgtgaaaaagcatgggttcattctggatgcctgggattgagtctttcttggatcttgggcctcttcgatcaagacttcacattactatcagggtgtaggttttaaaaattaagtctgattatatcattcccctgttttatcatttccccttcatgggctccacactgactaaaggtgtggaggaaatgcagactcc

SEQ ID NO: 144752 - DNA, 601 bp, Human; identical to SEQ ID NO: 28419

SEQ ID NO: 144753 - DNA, 601 bp, Human; identical to SEQ ID NO: 28420

SEQ ID NO: 144754 - DNA, 601 bp, Human; identical to SEQ ID NO: 28421

SEQ ID NO: 144755 - DNA, 601 bp, Human; identical to SEQ ID NO: 28422

SEQ ID NO: 144756 - DNA, 601 bp, Human; identical to SEQ ID NO: 28423

SEQ ID NO: 144757 - DNA, 601 bp, Human; identical to SEQ ID NO: 28424

SEQ ID NO: 144758 - DNA, 601 bp, Human
cactcagtgattttggtaagattgctgctctcctgacaactaactaactaaactgctaatgtaggtacaacttatgaatatacccaagaagttaccacagaagaaaaaaggaggagaactgagttttagttctggctctccactaactagctttatgaccattatttagaagaatacttatgtattcactcattcatttattcccacagccattcattcattaactttttgtccagcctcagcccaagagagagagatttaacctgtaggacacaatcctttcttcttagaatgttagaaygtatctcaatgtactcattaataaaacaagaagatgaagttagtactggttgatctaagtccagctctaaaatactatctattagtgatatcttttactgaaatttcatttttttttctttttatgctgggttgactctattttattttaattttaattttttattttttgtagagacgggggcctcactatgttgcccaggctggttttgaactcctgggctcaagcaatcctcccaccttgacttcccaaagtgcagggattacgggtgtgagccactatgcctggctgatggctctc

SEQ ID NO: 144759 - DNA, 601 bp, Human
ttcatttttttttctttttatgctgggttgactctattttattttaattttaattttttattttttgtagagacgggggcctcactatgttgcccaggctggttttgaactcctgggctcaagcaatcctcccaccttgacttcccaaagtgcagggattacgggtgtgagccactatgcctggctgatggctctcttttgaatagcattcttttccatataattatttatttccaatttaaatataattattcctttccagttttaatgatcatgatcatgtgtgaattcgtaaagaaaygatcatgaatttcataggaagatgccataagtaaactcttagcatctgaaatgattaagaggatttgagcctgctgagggattacttactttagttgccagtcctagaggtaataactgattaagaagtgctgaaaaatgagtggttatactttagcttaaaagaatgatgcagatgtctaatgaatgcattagaaaaaatatccaaggacaggatcattacaaagacagggatttctctctttttacccgtgaggtacaaataagataattctgttattttggagctttattcttgatc

SEQ ID NO: 144760 - DNA, 601 bp, Human
ctcactatgttgcccaggctggttttgaactcctgggctcaagcaatcctcccaccttgacttcccaaagtgcagggattacgggtgtgagccactatgcctggctgatggctctcttttgaatagcattcttttccatataattatttatttccaatttaaatataattattcctttccagttttaatgatcatgatcatgtgtgaattcgtaaagaaatgatcatgaatttcataggaagatgccataagtaaactcttagcatctgaaatgattaagaggatttgagcctgctgaggrattacttactttagttgccagtcctagaggtaataactgattaagaagtgctgaaaaatgagtggttatactttagcttaaaagaatgatgcagatgtctaatgaatgcattagaaaaaatatccaaggacaggatcattacaaagacagggatttctctctttttacccgtgaggtacaaataagataattctgttattttggagctttattcttgatcagattctcattgtcttcctctatttctctgttttgcattttatgtgcctgtagcctggagctttgtgccatgtatctgcc

SEQ ID NO: 144761 - DNA, 601 bp, Human
ggaaattaatacatctgctttgtatagatagcaaatatgtacagcaggagatgcagatcctagtgatgaacatgcatattctgaacttctcttattcatcatactttctaatttggagtatttaattccaaatactccaaattagaaagtatgatgaataagagcatatagaggagtcgtgtgacttaagtgttatttaaggaagcttgagttgcaacaatgtgtaagatgaattgggtggatggagattggaatcagagaggctaaaaaggaggctattatcatccatctcagagagacraggacttatcaaaagaggatagaagttggactgaagatttagagatgggtaccagggacatttcaagaaaaaagaaaaaaacaaggctttgaagactaactaatgatcagagagatgaagagtatgaagtcaatgatgacgcaaaagcatgaataagtaacgtgttcattaagcaagaaataagagggtaaaaacgttttctgttaggttttcacctgtcaaaaatgactgaacaagttaaagtgattgtattcttttaaaggtgaaaagtcaatcagtgctttttagagaatgttaatt

SEQ ID NO: 144762 - DNA, 601 bp, Human
ctttagaagtataaaggtggagtcaggctgcttttacaacttggttgattctatttattgaacatttgctgtgtgaatgttcccctgaccttgggtatcattatctatctgtgatagataacctatatcacagatagatagatctatctgtgacagataacctatatcacagatagatctatctgtgacctcggggatcatcatctgttaaagctttcattcattataaagggatcattgagggactagtgtggggctcccacggggattttcagctcacggagatcctttatttatgggkctcaatatggcattgtttttgttttacatttccttctgagacagagagaactcacataaagcctaaatctggctcttgcaggaagttttggctctgtaaagcagagcttccattttgaatgaggttatctttatgaagcacagtattatggttgaactctttttcattcttaaatccataaatcaaaaattcccctgttctactttattacaatagatgttttcatcagcttctactgagttggatattttcagaattctaactttgttgcaagccttccattgtcttcagtgcttctca

SEQ ID NO: 144763 - DNA, 601 bp, Human
gtgccatttttcattcccaccaacaatgcacgaggggtccagtttctctgtatccttaccatgaatggtttttgtttattttgttttgtgtgctctgaataaaactatatgaaaaaggttagagatgggggaaaaggtattgtaagcagtaagaaagtaagcagtgatatattaggcttagttatgaagtttgcattttggcatgacactccaatgatctagcttctgattgtagggttctatacctaaactagatttagttagttgaatcttttggagaattcccttcctcagttttttscttctagcttcattttctagtatgtttcacaattaactgccttcccttatgctttcagaaattctctaaacatcttcctagtgaatcttccacttgtaccacagcatttgaagaactccttgaatacctgttgccttcccgccccctgcatcttggttactgcttcccatctgtcttcctttgatagcaaggtagaccattttgttagcccacttctttaggccaggaactgtctctgtttccataatagctctgggctggtggaatagaaggtacacaaaacagattggtactcaagtc

SEQ ID NO: 144764 - DNA, 601 bp, Human
acaggagacatacctgaggtagaggtcaaaccatctggccaagatcttgggtacatggtgaggtggtcatttgaacttctgtgctctggctccaaagtttgtgccctcagccaccctcccgggaggcctctcactatactctgctaactctctatgaggtcttcattgtggctttagtaaattatgtacagtaattttgagcaaaactgtaaccattccttactaataaacttcttctggaattacaacggtttttacattttgtctttctactctagggctatagtccaatattagcatrccaatcagtagatgctcttgacttagtgatattaattagatacaggtgctgctaatattcagccaagttcatacaaattgacaatcaagtagacaagaatgtagtgttttaattacatctttgagacattgtgatttataaaatccatcaagtactcataagcagggtacatcttagaaaaatctatgaagtaaaaattaaatctctaatgtcctgctttttaagcacctttctttcccccattatgacagtgaagaccagttctaatctgaatgccattgggatccaccagaggttatt

SEQ ID NO: 144765 - DNA, 601 bp, Human
tgagacattgtgatttataaaatccatcaagtactcataagcagggtacatcttagaaaaatctatgaagtaaaaattaaatctctaatgtcctgctttttaagcacctttctttcccccattatgacagtgaagaccagttctaatctgaatgccattgggatccaccagaggttattaagcaggggagtgacagcacacagaatcatggtgctgagagatcactctggctatggtgtcatatagggctgagggtggaaggccagggagttggtgatggggaggtccaggttttaaaggwcccaaccagtggcagtgaatggggcagccagaagagagatgtgggcagctctgataaattcaaactttttattgatcagaagcagcttattataaagatgacatctttgcctttccccagcacttacatctcataggttcaacatctgagagctgaaaagaactctagagatgacccagccacctttcctagccaatttattaaaatctgctaaaaattccattctcatctttatcttccagttcttggacttctatttttactcatttctatttaaactgtctatttatgtcatttttc

SEQ ID NO: 144766 - DNA, 601 bp, Human
ttttctattaggactcttccatctttattccctagtgtgctatattctatctcatagatcttttcttaatgagactttccacagcctttcctatagcttactgtgccacgattttgtttaggttttggtcagcaattactttatctagctgaaatctgtggacacgattgtgcatagagaaaacaactggtggaataaaatatttattcttcatgttgttgtttgttctttcactaggtcatcactcatgttttttttttttaattgtacttcttttggtacaatattttagtttactaartgatattactaaaatatcattttcttgccttcatgtagggcagcccagtatccaaaaggaagagagttgctgcttaatcctccaaagggcagtggggcatctgagagcagacccctttcctgtgggggacaaagataggagggtcttccctggactaggtagggttcttcattgttgccagcatcagccaagtggttttgtttcttttcagcagattccagggaatctgcctctcctggactagcttaggacaagagagagtctgctctggcattttgtagggagatgggctggagccta

SEQ ID NO: 144767 - DNA, 601 bp, Human
tccctctcccgagtcttgacctccaattcattctcacagtgatcaatgggaggaaatatatgcaatatatgcaaatgaggggggtcgtgtgggtgtaaagaactcttacaaatcaccaaaatactatgtgcacaaataaaacaatatgggaaccctcctggctggtaaacataaaaaaattctacttccctagaaatggaagagacacaaatttaaatgatgagatgctatttatgcctatcaaatgtattaaaaatgtatgcagtattgacaaacgtttagggaatacaaagctcttaarcattgctagttggaatttacaatggtacagccttttggagggcaatttgatcatatgtggaagatgactttaaaaggaattccacttctatgaatttgtcttaaggcaataataagtcttcataaaccatgtatatataagagtatgtttgttgaggctgtttatagtgatgaaagacagagaacagcctaacctaggctatcggttaaataataaaattaggcatatctagacaatggaattttatggagccataaaacgacagagatttaaaaaaatttgccctgaaaaacttccact

SEQ ID NO: 144768 - DNA, 601 bp, Human
cagcctagtgaagctaagctcaccttctcaggtgcaccatcccactggcaagcctagctgtcagaccttcctgatttctgttcttgcaggcttcctttgatggtaataagttcctcccccattggggttgtatggatagaactgaatggtaaaactgatttctggagattttttagaagtgcaacttgagactctaagagaatcctctgtcatgaagactccatgatcctgtgactgttgagctggtattcttgcacaggacgacctttcctgggatcttgggctgcgtcacttgcacccrttctttaagggattgcctctaggaagcttttgtccttattctttctttcccactggccttgtgctttgcatttctttatttcttttttaaactcagagatgtgatggtgaggtttgatctttttactgtggaacccaacataggtggccgggattgaggaggtattgcgatgagaaatgactcaaatgtgacttgatggaagtacatttttcatcaaacaagagttctagttttaaataggggaggggactattacggctgggagggattttagcaaatccaagcactttgatttttcag

SEQ ID NO: 144769 - DNA, 601 bp, Human
ttgcaggcttcctttgatggtaataagttcctcccccattggggttgtatggatagaactgaatggtaaaactgatttctggagattttttagaagtgcaacttgagactctaagagaatcctctgtcatgaagactccatgatcctgtgactgttgagctggtattcttgcacaggacgacctttcctgggatcttgggctgcgtcacttgcacccattctttaagggattgcctctaggaagcttttgtccttattctttctttcccactggccttgtgctttgcatttctttatttcytttttaaactcagagatgtgatggtgaggtttgatctttttactgtggaacccaacataggtggccgggattgaggaggtattgcgatgagaaatgactcaaatgtgacttgatggaagtacatttttcatcaaacaagagttctagttttaaataggggaggggactattacggctgggagggattttagcaaatccaagcactttgatttttcagttgaggaaaaaaggcaaaatacagtcttcactggtgcaatgacagtgtgctatggcatatattttagaaagaacattgcatct

SEQ ID NO: 144770 - DNA, 601 bp, Human
aaaactgatttctggagattttttagaagtgcaacttgagactctaagagaatcctctgtcatgaagactccatgatcctgtgactgttgagctggtattcttgcacaggacgacctttcctgggatcttgggctgcgtcacttgcacccattctttaagggattgcctctaggaagcttttgtccttattctttctttcccactggccttgtgctttgcatttctttatttcttttttaaactcagagatgtgatggtgaggtttgatctttttactgtggaacccaacataggtggccrggattgaggaggtattgcgatgagaaatgactcaaatgtgacttgatggaagtacatttttcatcaaacaagagttctagttttaaataggggaggggactattacggctgggagggattttagcaaatccaagcactttgatttttcagttgaggaaaaaaggcaaaatacagtcttcactggtgcaatgacagtgtgctatggcatatattttagaaagaacattgcatcttgggacaagaaatctaattttgaagtcacacaaaggtcattaagagcttatgggagcttgggcaata

SEQ ID NO: 144771 - DNA, 601 bp, Human; identical to SEQ ID NO: 28425

SEQ ID NO: 144772 - DNA, 601 bp, Human; identical to SEQ ID NO: 28426

SEQ ID NO: 144773 - DNA, 601 bp, Human
gcctctaggggtattgagatctataggaatgtgagtttcgacttgagaggaacaaggacaaataggaaggagaaatcaatcctatgtattaaggaaatatgaagcatggtacatatacatacagtgttgcaacactgatcgtactcagggcatgaacaagccctgggtgtcttggaaggctctggcctggtgtcgcttcacacttgctattcttgaaacatttcctcagccgtcatctagggagtgcctgcttctgtagagaagaggggaggaggaaaggtgctggtggcagtgtgctgcrtatggcccactcagcaaaacaggagccccatggttcattcttaatgatatctactttctttagttgacagtttagaaaccatgaggatgggccaggctcagtggctcatgcctataatcccaggactttgggaggccaaggctggtggatcacctgaggtcaggagttcgagaccagcctggccaacatggtgaaaccccgtctctacaaaaaatacaaaattagctgggcgtggtggcgcgcacctgtaatcccagctaccataaggcaggagaatcccttagaacctgggaggtggaa

SEQ ID NO: 144774 - DNA, 601 bp, Human
tgtgtcccaactattcaactcaatacataaacgaaaagtgtggctaatattaaataaaactttattaacaaaaataggtggtgggttgcatttggatagtgagctgcagtttgccaacccctgctttaaagcattgccagataagagatatagatttcaacatcttatttccctgttcagaaatgaccagtggtcccttagtgctagaacataaatactgactttctttgttgagctttcaggccctctgtactgcatttctgtagtattgtatctttgcaccagcatttaccttgcttaytctcttgttttcttctcccacagtgttcatgcctactgctagtctttaggaagccctttcttggaagccccctgctctccttaccaatttctcatctttaaataaagacatatattacctcccatgtcttctgtgaagctctccccagtaagtggaatccaccctataattaatactttattttatcatgtatgctattatatacatgaacatctatatttgtttacatattgtctgtgtatgtaagaattgtctccaaatttaaacttcttttgcagacatttcaaaaagttcttttat

SEQ ID NO: 144775 - DNA, 601 bp, Human
acaggacatttggaggggataaaacatccaaactatatcaatattcatttattaattcatattaatattgttaaatattaactaggtgttaatatttattacagttaaaggtactagctttctatcctcttgttgtatatttatgttgctgtggtttttcatccttcctctttgttgtggcattgctttagatttgatgtaagttttcagctaagggatactaactacatatcaagaacatgagctcaatctcagtattgaaccacatctttggccttcattcaacattgcgattttttttcccttcccaaggggacctgagaatgctacttgacaaagcatcaaattgttatgaggtcagcatggttcggatgatgcctttaaatatgcatataaactgtttatatgtttgcagtatttgtagatatatgtaactataatttaagtttccagtgttaaatagtagtttatgttaattttctgtataaagcctgtcagctgtttttgactgtacatttgaaaagacttgaaaacataaaacttgctttaagtgataaggttgatcagaaatatataataggtaaggattaatttatatttt

SEQ ID NO: 144776 - DNA, 601 bp, Human
tttggtaaatgacgcaggctctccttgatagtgaatgtctaaacaactcaaaggttgatatatgtgggagagaactgtttttatcagtttagaagtagatatttttctctcttgggcagactgttgtgagtccttcagccttctgttatgaaaaagcagtagactgtaagagaaaatcatgaagtctcaatttgaaagtgagcaaaataaggttgacccattctatctcattttcccttatttactctttaagtacacattacttactctctggtagctcctgaatctttatggttaagargggaaaggctgtgttcccatttcctattaggaacctcgtttccatgctctcctgtcttttgaaaacatcatccaaggatactcatatcgttttgtcctcatcactgttatcacctcccttcatccctggaagacttttgcttctactttttagctgcctgggcactgccaacattctggacaactgtaacatttttctaatcattatcatcatccactgtttcttgaataccttctatgtgcctggcatggtattaggtactttatatccattatcttatttatttaacctgctatttac

SEQ ID NO: 144777 - DNA, 601 bp, Human
tagaagtagatatttttctctcttgggcagactgttgtgagtccttcagccttctgttatgaaaaagcagtagactgtaagagaaaatcatgaagtctcaatttgaaagtgagcaaaataaggttgacccattctatctcattttcccttatttactctttaagtacacattacttactctctggtagctcctgaatctttatggttaagaagggaaaggctgtgttcccatttcctattaggaacctcgtttccatgctctcctgtcttttgaaaacatcatccaaggatactcatatckttttgtcctcatcactgttatcacctcccttcatccctggaagacttttgcttctactttttagctgcctgggcactgccaacattctggacaactgtaacatttttctaatcattatcatcatccactgtttcttgaataccttctatgtgcctggcatggtattaggtactttatatccattatcttatttatttaacctgctatttacagatggggaaatcaagactcagaatggcaataacttgcccaaggtgtcacagtgatcttattttaaactttcttaacctcagttatctt

SEQ ID NO: 144778 - DNA, 601 bp, Human
ttgggcagactgttgtgagtccttcagccttctgttatgaaaaagcagtagactgtaagagaaaatcatgaagtctcaatttgaaagtgagcaaaataaggttgacccattctatctcattttcccttatttactctttaagtacacattacttactctctggtagctcctgaatctttatggttaagaagggaaaggctgtgttcccatttcctattaggaacctcgtttccatgctctcctgtcttttgaaaacatcatccaaggatactcatatcgttttgtcctcatcactgttatyacctcccttcatccctggaagacttttgcttctactttttagctgcctgggcactgccaacattctggacaactgtaacatttttctaatcattatcatcatccactgtttcttgaataccttctatgtgcctggcatggtattaggtactttatatccattatcttatttatttaacctgctatttacagatggggaaatcaagactcagaatggcaataacttgcccaaggtgtcacagtgatcttattttaaactttcttaacctcagttatctttatttttgttcacttgaaaatt

SEQ ID NO: 144779 - DNA, 601 bp, Human
accttctatgtgcctggcatggtattaggtactttatatccattatcttatttatttaacctgctatttacagatggggaaatcaagactcagaatggcaataacttgcccaaggtgtcacagtgatcttattttaaactttcttaacctcagttatctttatttttgttcacttgaaaattcattgaataaaccttcttattgcttagcacattgcttctgacatcttgaatcctgccagcctcctttaaacatttccccctcctcctaactctgctccatgacctctttctgaccctgyctgtttccccagccatctcagttcacctctttccttctacagcctgcatagtcatttttgcttcctttttccaacattctcactgctacttggacattctgtaaccacttgattaccagcctccaaaattagatcaattcaaccatctgttgtatctgttcctcatctctctcctgtgagcactgttggagaaaatcctataactttgccaattggctccatctcaaatgtgtttctaatttacccggcccttcagtgctcctaattagttgttttatccctttttggctccttttctct

SEQ ID NO: 144780 - DNA, 601 bp, Human
aaattagatcaattcaaccatctgttgtatctgttcctcatctctctcctgtgagcactgttggagaaaatcctataactttgccaattggctccatctcaaatgtgtttctaatttacccggcccttcagtgctcctaattagttgttttatccctttttggctccttttctcttccccacctggctgttccaaaactttttaacatttttcaccaacacaaccccttcctgatctccagagccagctgaccctgctttgagatctgctaagaacatagaatttatcagaagtaatttcytctaacttccctcttctctgtctcaaagtttatctgcatctggactcatccatttcttccttcccttttaattccaaagaaactctactgttttccaatgataactctacctacctgtactgttctttccagaatctttcatgaagttgccctaaccacttccttctccttttgtatcttcagcctcttaccctccgtttgcaggtctcctcaactgcaaatgtgcacatccaagttggtaggctggtgggggctggggaggagtcttcccttggccctgtcttcctctcacagtttctc

SEQ ID NO: 144781 - DNA, 601 bp, Human
tttttttttgagacggagttttgctgtgtcacccaggctggagtgcaatggagtgatctgagctcgctgcagtttccgcctcccgggttcaagtgattctcctgcctcaacctcccgagtagctgggattacaggaatgtgccaccatgccctgctaatcttttgtagttttagtggtgatggagtttcgccatgttggccaggctggccttgaactcctaacctcagatgatccacccgcctcggcctcccaaagtgctgggattacaggtgtgagccactgtggcccccttagtgcatytgtattaagatttttattttagattgaaaatgaaaggaagttaatttgttacaaaatactgatgtcagaataatttgctgaaccctttttactgatctttcatttcacttttctttataccatataaagaaaccatggaacatgttttgttttgaggactttggtattgtatttttatcctctagtgcttaatagatacaacttatgttcagtaattatttgttgaatgaattgaactggtgggacagaaggtcaattcgttggccaaatggtgtcatcatttgtttgcagaggcctgca

SEQ ID NO: 144782 - DNA, 601 bp, Human; identical to SEQ ID NO: 28427

SEQ ID NO: 144783 - DNA, 601 bp, Human
taggaggccgaggtaggcagatcacgaggtcaagagatgaagaccatcctggccaacacggtgaaaccccgtctctactaaaaatacaaaaattagctaggcatggtggcatgtgcctgtagtcccagctactcaggaagctgaggaaggagaatcacttgaacctgggaggcggaggttgcagtgacctgagattgcaccactgcactccagcccggcaacagagtgagactccatctcaaaaaaacaaaaaaaagagagaaaaaatgacacacacacacacacacacacacacacacayatatatataaagaagtgacaatattatgacaaacatttcattaaaaataaataattgttatctagatatgatatgccattgacagaccagtaaaatacatccagtaaaaggaatgttgagacaaggaagtatgactccacctggtaaccatattttgaatattacacattaacaacgagattattttctgtaaggctgtccaaaatgaatcctccttctatgtagattgaaaagacaacagcataacttcaaaagactgactatgcagccataaaaaagaatgagttcatgtcctttgca

SEQ ID NO: 144784 - DNA, 601 bp, Human
tttaaattgtaagaactatataccaaagcaaaagtattatgtgggtgtctcaattcaattgtgataagtaaaattagaatatcaaattgttttgaaattataacagctaaaatgctttcgggcatgatgagttctggttaattttagagcatcaaatgaaggaatacctgaagtaaaggcaatctatccaatacaaatcaagtaaaggaaatgtcatattagtcaaaaatgtcataaaaatatttttgaaatgagaagcatacctataaaaagaagagaaaagccaggtgcggtggctcaygtctgtaatcccagtattttaggaggccgaggtaggcagatcacgaggtcaagagatgaagaccatcctggccaacacggtgaaaccccgtctctactaaaaatacaaaaattagctaggcatggtggcatgtgcctgtagtcccagctactcaggaagctgaggaaggagaatcacttgaacctgggaggcggaggttgcagtgacctgagattgcaccactgcactccagcccggcaacagagtgagactccatctcaaaaaaacaaaaaaaagagagaaaaaatgacacacacacac

SEQ ID NO: 144785 - DNA, 601 bp, Human
cgaagtgctcaaggtcaataaagcacatccatttcatgcacccccacatgagatactaagaaaggcacaacatcacttctgaggagttctttccaaaaatgcataacctcaatctaatcatgagaaaatatcaaagtcaaattgagggacattctacaaaatactgacagtagtcttcatactgtccaggtcatgaaagacaaagaaggtagaagaaagcatcagattggaggtcattaagggttaagcgtaataagggatcctggcttggatcctagaacagaaaaagggcattattagraaaactgatgaaattagataagacttataatttagatcagggattgattgactctggcctgctgctgcctgttttttaattaaagttttattggaagacagccaagatcattcacttatattgtctatggctgttttctccaatggcagagctgagtagttaggacagagactgtaaggcctgcaaagcctaaaatatttgctatgccaggatcagcattaggtgaggcaagcaggacacctaggtctaaggaaatatcctctctctctccctctccctctctctctctctctctctgtc

SEQ ID NO: 144786 - DNA, 601 bp, Human
ggaaatgttcaataaatacttgatcatagactgacagatgttcttcaagtaacataactatagtgtaataggagctttctgaaaattatggctaattcattaagagtgaattgattccagtgatggaaattcatatgatgcaaaatgtgctgcagaaaagagaagatttggctgggcacagtggcttacgcctgtaatcccaacactttgagaggccgaggtaggcagatcacctgaggtcaggagtctgagaccggcctgaccaacatggtgaaaccccatctctactaaatacaaaaawttagctgggtgtggtggcgcatgcctgtaatcccagctactcggggggctgaggcaggagaattgcttgaacccgggaggcgaaggttgcagtgagcccagattgcgtcattgcactccagcctgggcaacaagagtgaaactccatctcaaaaaaaaaaaaaaaagaaaagaaagaaaagaagattcattttaatactgatttaattgatatatattattttaattcactcagtttaaaactagatttttcccacaaaattccagatattagcaatatccctgaaataaatgagagatc

SEQ ID NO: 144787 - DNA, 601 bp, Human
cactagcatcatgtctcacctttttgttttgttttgttttgttccccaccctatgtcacttctagtactggcccaacaggaaatgttcaataaatacttgatcatagactgacagatgttcttcaagtaacataactatagtgtaataggagctttctgaaaattatggctaattcattaagagtgaattgattccagtgatggaaattcatatgatgcaaaatgtgctgcagaaaagagaagatttggctgggcacagtggcttacgcctgtaatcccaacactttgagaggccgaggtrggcagatcacctgaggtcaggagtctgagaccggcctgaccaacatggtgaaaccccatctctactaaatacaaaaatttagctgggtgtggtggcgcatgcctgtaatcccagctactcggggggctgaggcaggagaattgcttgaacccgggaggcgaaggttgcagtgagcccagattgcgtcattgcactccagcctgggcaacaagagtgaaactccatctcaaaaaaaaaaaaaaaagaaaagaaagaaaagaagattcattttaatactgatttaattgatatatattattt

SEQ ID NO: 144788 - DNA, 601 bp, Human
cgcttaagcctgggaggcagaggttgcagtgagctgagatcgcaccattgcactccagtctgggccacagggtgagaatctgtctcaaaaatacatacatacgtacatacatatacacatatgcatttacttatttatatacatatacagatatagcatatatgcacagataattaacatgtataagtcatactccaaaatgttaaacatgtaggttaacatttttatttgtgctttctttgtattccacatttccttattgaacatatattaattttagaacttaaattttaaaacttaraaacttatcttttccatattctgctagcaaaatatttttgtctaagcaaggaaatactccagtgtgccatggagactaatccaattcccacttggatgaatcttctccaagatttcctagccatacaaatgccctgtctctcccacagtgcattaaaattatggccatctagtaaggccatttcaagccccatctctttctgaagtctattcagatattctttctttaatttctgctgcacttatagacagtacagagcacaatacttaattgttctcaaattgtttcctgtgtattagc

SEQ ID NO: 144789 - DNA, 601 bp, Human
cataaggaatgtcttcacttttacaatcaaagtcaggctgtattagataggcatatgtataaaacccagactaataactattattttctttgttaaacttctgagaacaccttcgaataataggaaaagatgacttcctgttaggaactgtaattaactatgtgtttcctcttcctgggtgctgtctttaaccatcagtcaccataacctgcttatataacaaataaaactgagatctagacttgtttttaaattttaaagtgttaaatattctattttctctctctctctctctctatatatatatatatacacacatatatatgaagagcctttaatttatttcctagcctttgattcaacaattccaattctaggaatttgtctaaggagataatcagaggtaagaaaagaatagctgtaagaaggtccaagaataaaatataaattttaaacaaaaacctatgatagagcaagagcaccatcaactcagacagacatcgccactttaaattccagttccctttctagtctcatgcatttcaaggaaatcacttctgttcgaactacaagcagccagaaagagcagacagtaaaacac

SEQ ID NO: 144790 - DNA, 601 bp, Human
tcataaggaatgtcttcacttttacaatcaaagtcaggctgtattagataggcatatgtataaaacccagactaataactattattttctttgttaaacttctgagaacaccttcgaataataggaaaagatgacttcctgttaggaactgtaattaactatgtgtttcctcttcctgggtgctgtctttaaccatcagtcaccataacctgcttatataacaaataaaactgagatctagacttgtttttaaattttaaagtgttaaatattctattttctctctctctctctctctatmtatatatatatacacacatatatatgaagagcctttaatttatttcctagcctttgattcaacaattccaattctaggaatttgtctaaggagataatcagaggtaagaaaagaatagctgtaagaaggtccaagaataaaatataaattttaaacaaaaacctatgatagagcaagagcaccatcaactcagacagacatcgccactttaaattccagttccctttctagtctcatgcatttcaaggaaatcacttctgttcgaactacaagcagccagaaagagcagacagtaaaaca

SEQ ID NO: 144791 - DNA, 601 bp, Human
tctcataaggaatgtcttcacttttacaatcaaagtcaggctgtattagataggcatatgtataaaacccagactaataactattattttctttgttaaacttctgagaacaccttcgaataataggaaaagatgacttcctgttaggaactgtaattaactatgtgtttcctcttcctgggtgctgtctttaaccatcagtcaccataacctgcttatataacaaataaaactgagatctagacttgtttttaaattttaaagtgttaaatattctattttctctctctctctctctctmtatatatatatatacacacatatatatgaagagcctttaatttatttcctagcctttgattcaacaattccaattctaggaatttgtctaaggagataatcagaggtaagaaaagaatagctgtaagaaggtccaagaataaaatataaattttaaacaaaaacctatgatagagcaagagcaccatcaactcagacagacatcgccactttaaattccagttccctttctagtctcatgcatttcaaggaaatcacttctgttcgaactacaagcagccagaaagagcagacagtaaaa

SEQ ID NO: 144792 - DNA, 601 bp, Human
gcactccagcctagacaacaagagtgaaactccatctcaaaaaaaaaaaaaatgtactggtatttagtacatggaagcaaatgtgtcaaaatggttgattctcagtttgtttacatgcgtgactgttattttcttctttatattttctaggttttaccaatttcacattttaaaaattaagaaagtctatatctttctttcattatttttcatagctttactatcatgaagtttattacaaagcttccatagagctggctctatgtaaactggtaaagtgggttagtttatcttgaacacwttgtatttatcttctggcctccctactccatgtgaccactgccaagtgcagtccattggagctgacacccccgatgtcaaggtccactaaatcctgccttcctgacccaagtccagtaggctgcaaaactgcctaccctgttgtcttgtaaacatacaaaaaattttcaactctactcataatcaaataaatcaaaatatccaaaggattgtaacgaccagtgttactgagagtgcgaagaaattaacattcatgctctgctggcgaggatgtaaataggtatagactttcttgaaaaaa

SEQ ID NO: 144793 - DNA, 601 bp, Human
atatctaatgatatatattatatatatcattatatataagatatctaatgatatatattatatatatcactatatataagatatctaatgatatatataatatatatcattatatatctgatatctaatgatatataatatatatcattagatatcagatatataatgatatatataatatatatcatatataagatatctaatgatatatattatatctattatatctattatatatgtctaatgatatctattatatgtcattatatatgatatataatatatatatcatgatatatataatatatatcatgatttatatatatcatgatatattatatatatatctcttagggcttttaaatagataaaattatacctatatatcaaaggtagaaagttttgggggtttatcgttgctgttgttttatttttaattcctatcccactagaaaacattctgggctgggtgcggtggctcacgcctgtaatccctgcactttgggaggctgaggtgggtggatcacttgaggtcaggagttcgagaccagcctggccaacatggtgaaaccctgtctctactaaaaatacaaaaattagg

SEQ ID NO: 144794 - DNA, 601 bp, Human
tgctgagcttacgggcatgagtcaccatgcctggcctaaagatgcacttttaatgcatatatatatatgcatatatatatataagatgcttatatatatgcatatatatcatatatatctcacatatatatcttatatacatcattatatataagatatctaataatatatataatatatatcatctaatgatatatataagatatctaatgatatatattatatatatcattatatataagatatctaatgatatatattatatatatcattatatataagatatctaatgatatatatwatatatatcactatatataagatatctaatgatatatataatatatatcattatatatctgatatctaatgatatataatatatatcattagatatcagatatataatgatatatataatatatatcatatataagatatctaatgatatatattatatctattatatctattatatatgtctaatgatatctattatatgtcattatatatgatatataatatatatatcatgatatatataatatatatcatgatttatatatatcatgatatattatatatatatctcttagggctt

SEQ ID NO: 144795 - DNA, 601 bp, Human
tatcatgaattattaagacttggctttattaattgtaattgcaattacagcagcaggaaacaatagtggttatgtggctctagaatctgactgcttggttttattttattttatttatttatttatttatttttatttttgagacagagtctcactctgtcacccagtctggagtgcagtggcgtgatctccgctcactgcaacctccacctcctggcttcaagtgattctcctgcctcagcctcccaagtagctgggattacaggtgcccaccaccacgcctggctaatttttgtatttytagtagagatgggggtttcaccatgttggccaggctggtctcgaactcctaacctcaggtgatccacccgcctcagcctcccaaagtgctggaattataggcgtgagccaccgtacctgggaagacggcttggtttgaaatcccagttctgctacaaggctttaggcaaattacataacgtccatgtgtctaggtttactcatctttacatcagatgaataatataagtagcgcacttaacacaaaacctgatcataataagaactcaataatagtggctattattaaatataagtggtt

SEQ ID NO: 144796 - DNA, 601 bp, Human
tcaatgatttgatttgatttcacttacccatctaattcctattatcatgaattattaagacttggctttattaattgtaattgcaattacagcagcaggaaacaatagtggttatgtggctctagaatctgactgcttggttttattttattttatttatttatttatttatttttatttttgagacagagtctcactctgtcacccagtctggagtgcagtggcgtgatctccgctcactgcaacctccacctcctggcttcaagtgattctcctgcctcagcctcccaagtagctgggrttacaggtgcccaccaccacgcctggctaatttttgtatttttagtagagatgggggtttcaccatgttggccaggctggtctcgaactcctaacctcaggtgatccacccgcctcagcctcccaaagtgctggaattataggcgtgagccaccgtacctgggaagacggcttggtttgaaatcccagttctgctacaaggctttaggcaaattacataacgtccatgtgtctaggtttactcatctttacatcagatgaataatataagtagcgcacttaacacaaaacctgatcataa

SEQ ID NO: 144797 - DNA, 601 bp, Human
cagtccagacgtggtggctcacgcctgtaatccttgcactttgggaggctgaggtgggcagatcacaaggttaggagttcgaggccagcctagccaacacggtgaaaccccgtctctactaaaaatacaaaaattagccagacatggtggcaggcacctgtaatcccagctactcaggaggctgaggcaggagaatcgcttgaacctgggaggcagaggttgcagtgagccaagatcacaccactgcactccagcctgggtgacagagcaagagtctgtcttaaaaaaaaaaaaaaaaaaatatttaaatacccaaaatgatcaggtaggtttctcctagtaatatataaaatatccaaattcttcaaagatgcttagccaccattactcaaggataactgtctctgaattataagttataatttataaattatctattataaagctccttcttcctgtcttttggtctttttcttttatattaagaatttcaaaattaaatgaaaaagaacataattcaaacctgataattttgttaccaattaggagcttcattagagattttgactgggaaaacagaaactccagcccaaactaaaat

SEQ ID NO: 144798 - DNA, 601 bp, Human
ccttatatttctattttgactttttcctctaagaaataataaaattcagaaagcatccaataaacgctcctattgaaatagtcgttgtgatgacaatttaactacttaatttaaatgatggcccaagatacctatgagctcaaaatatttaaatatccagtccagacgtggtggctcacgcctgtaatccttgcactttgggaggctgaggtgggcagatcacaaggttaggagttcgaggccagcctagccaacacggtgaaaccccgtctctactaaaaatacaaaaattagccagacrtggtggcaggcacctgtaatcccagctactcaggaggctgaggcaggagaatcgcttgaacctgggaggcagaggttgcagtgagccaagatcacaccactgcactccagcctgggtgacagagcaagagtctgtcttaaaaaaaaaaaaaaaaaaatatttaaatacccaaaatgatcaggtaggtttctcctagtaatatataaaatatccaaattcttcaaagatgcttagccaccattactcaaggataactgtctctgaattataagttataatttataaattatctattataaa

SEQ ID NO: 144799 - DNA, 601 bp, Human
gaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgacgtacagggtgctcttgttagatgggacacatgggacttcccaactgatggtcagctgag

SEQ ID NO: 144800 - DNA, 601 bp, Human
caggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgacgtacaggg

SEQ ID NO: 144801 - DNA, 601 bp, Human
aggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaagaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgacgtaca

SEQ ID NO: 144802 - DNA, 601 bp, Human
gaggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgacgtac

SEQ ID NO: 144803 - DNA, 601 bp, Human
gccgaggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaagaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgacg

SEQ ID NO: 144804 - DNA, 601 bp, Human
ggccgaggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgac

SEQ ID NO: 144805 - DNA, 601 bp, Human
ggaggccgaggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaagaaggaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcct

SEQ ID NO: 144806 - DNA, 601 bp, Human
gggaggccgaggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaggaaggaaggaaggaaggaaggaaggaaggaaggaaggaaggaaggaaggaaggaaggggaaggaaggaaggaaggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcc

SEQ ID NO: 144807 - DNA, 601 bp, Human
tgtattaatgaaaactgagtaaacggatgcttaaatagattaaaaaacaacctctacccaaaggttgaatcatatatcaaatgcatgcctgcctagagaagatattgatgtctgtgtaccttttcattttaaacaatatttacacagtccactgtttctctgaacaagacgccttgaggcagcccatacatgaaaacccccatcactatggcaactagaaatggcaataattacacagtgattcatcatgtatcctgaataaaaattgtttgtcagggacagagaaacaactcacagtcaygcttcactgaaaagaacccagttaaagaataacctggggtggtggtggtttttaagtgtttatcaaatttttataatttttttttttttgagacacaatttcactcttgctacccaggctggagtgcagtggcgcgatctcggctcactgcaacatctgctcccgggttcatgcgattctcctgtctcagcctcccaagtagctgggattacaggcatgtgccaccacgcccggctaattttgtatttttagtaaagacagagtttcaccatgttggtcaggctggtctcaagttcctga

SEQ ID NO: 144808 - DNA, 601 bp, Human
ttgtgccactgcactccagttcgggcgatagagcaagactccatccccccaaaaaaataaaaaataaaaaaagagattttgaaatagtctggccaggcacagcagcttatccctgtaatcccagcactttgggaggccaaggaaggcagactacttgagtccaggagtttgagaccagcctgggcaacatggcaaaaccccgtctgtactaaaaatacaaaaaaattactcaggtgtggtggcgcacatgtgtggtcccagctacttgggaggctgaggtgggagaactgcttgagcctggaggttgaggccagcagtgaaccaagatcgcaccactgcactccagcctgggagacagagcgagatcctgtctcatatatatatttgaaatattttcatcagtaaccttaatcatccaagtgtgtaaagatccacataaacgttcagaaagttgtattaatgaaaactgagtaaacggatgcttaaatagattaaaaaacaacctctacccaaaggttgaatcatatatcaaatgcatgcctgcctagagaagatattgatgtctgtgtaccttttcattttaaacaatatttacacagtc

SEQ ID NO: 144809 - DNA, 601 bp, Human
gatgtcaaaatatgctttgaaaaaatctggaagaaaatataccaactgttaatagtggttctctatcagggaaagataaaagcaaactttttcttccaacattatttattaattatgttatttttattatatggggaaaaacagtaaagactataaagtaaaaaaaaaattgagacattaaaagatgttagttaacaaaggacaaattgctccccttcttctaatatccaaatgtccttgaagtttgcacatcagtaacaaaaataccattccacaggttcttagtctgaagtttactttcttttttttttttttttttgaggcagagtctctctctatagcccaggctggagcactgtgacacaacctcagctcactgcaaccaccgcctcctgggttcaagtgattttcctgcctcagcctccacagtagctgggattacaggcacccgccaccacactcagctaattttttgtacttttagtagagacgaggtttcaccatgttggctaggcttgtctcaaactcctgacctcatgtgatctgcccaccttggcctcccaaagtgctgggattataggtgtgagccatcacaccggcc

SEQ ID NO: 144810 - DNA, 601 bp, Human
tataatatttttaaaaaattgaacaaaagaaggaactacacaatattgtcaaaagaagctaaagaagatctaaataaatgaaaagacatcccacgttcataaagatttactattgctaaaatgataataccccccaaactgatctgcagattcaacataatctctatcaaaatcccagttgccttttttgcagaaattgacaatctagtcctaaaatctgtttgcaaatacaagggacccagaattgccaaaaaaaaaaaaaactcttgaaaaaaataagagcaaagttggagaattcacrcttctgaatttcaaaacttatactacaaagctacagtagtgaaaacagtgtggtactaacataaggatagacatacttataaatggaatagaattgagaatccagaaacaaacccttacatttacagtcaattgatttcaacaagagtgccaagacaatttaatgaagaaaaaaaatagtcttttcaacaaatggtgctaggataactaaatatcaatatataaaaagcatgaatttagatttctaccttaagctataaacaaatattgactcaaatggatcacagatccaaatgtaagg

SEQ ID NO: 144811 - DNA, 601 bp, Human
tctgtctcaaaagaaaaaaaaaaaagcttcaagaagaatataatatttttaaaaaattgaacaaaagaaggaactacacaatattgtcaaaagaagctaaagaagatctaaataaatgaaaagacatcccacgttcataaagatttactattgctaaaatgataataccccccaaactgatctgcagattcaacataatctctatcaaaatcccagttgccttttttgcagaaattgacaatctagtcctaaaatctgtttgcaaatacaagggacccagaattgccaaaaaaaaaaaaaactcttgaaaaaaataagagcaaagttggagaattcacacttctgaatttcaaaacttatactacaaagctacagtagtgaaaacagtgtggtactaacataaggatagacatacttataaatggaatagaattgagaatccagaaacaaacccttacatttacagtcaattgatttcaacaagagtgccaagacaatttaatgaagaaaaaaaatagtcttttcaacaaatggtgctaggataactaaatatcaatatataaaaagcatgaatttagatttctaccttaagctataaaca

SEQ ID NO: 144812 - DNA, 601 bp, Human
gtgatgggtgcgctaaaatttcagacttcaccaccatacaattcatccatgtgtctaaaaaccacttgtattagtccatttcacactgctgtaaagaactacctgagactcagtaatttatgacgaaaagaggtttaattgactcacagttcctcaggcttaacagaaagcatgactgggaggcctcaggaaacttacaatcatggcggaaggtgaaggggaagaaagggccttcttctcatggtggcaggaaagagagagaaggtagaactgccacatacttttaaaccatcagatctcrtgagaactcactatcatgagaaaagcaagggggaaatctgcccccatgatccaatcacctcccatcaggaccctcatccaattcaacatgagatttgggcaggacacaaatccaaaccatatcaacacttgtaccccaaaagctattgaaaattttttgaagtttttaatttaaaaaaatgtggcacccctgaggctgtggctcgtttgaggaattctcccaaaggaaattcccaagatatgatcctgtgtgtgatgctacaaaagtacaccgtgatttgtcctgccttgtgggtatagg

SEQ ID NO: 144813 - DNA, 601 bp, Human
ttcattgacctgggtgaggtcttaaaatatttttaccaattaaactagcaggaggaacttctagaaaacaaaaagaaataaataagtaggtagtaaagtgacagacttagtgtagggaaaaaataccagttcagttgcatcactcctggatgatagaaatgtggtggatatatacaccatggaatattactcagccctaaaaaagagcaaaataatatcttttgcagcaacttagatggacctggaggccattgttctaagtgaagtaacttaggaatggaaaaccaaatattgtatgttytccattataaatgggagctaagctacggatacacaaaagcatacagagtggtataatataatggactttggagactcaaagtgggaggctgggacggagagtgaaggataaaaaactacataatgggtacaatgtatactactcaggtgatgggtgcgctaaaatttcagacttcaccaccatacaattcatccatgtgtctaaaaaccacttgtattagtccatttcacactgctgtaaagaactacctgagactcagtaatttatgacgaaaagaggtttaattgactcacagttcct

SEQ ID NO: 144814 - DNA, 601 bp, Human
ctacctctattaccacaactcaagactagaaggaaacatagcctttaacaccctaaaattataaatattctagctctctgccctaatcaaatcaaagaagtcatttattcccaccttcaacctatctcttcccaactacaaagaagtgtcatcctgaatcctcttctccaaatataaccagtccaaaggctaatcaaccccaagatccaagaaccaccccataaagcagtcattgccaccaataaatgtaaccagctctcaccctaacaagaaaaagaaaagaggctgggcacagtggctyatgcttgtaatcccagcactttgggaagccaaggtgggtggatcatttgaggcaaggagttcgagaccatccttggccaacaaggtgaaaccacgtctctactaaaaatacaaaaattagctggtcgtggtggtgcacacctgtaatcccagctactcaggaggctgaggcgggagaattgcttgaacccaggaggtggaggttgcagtgagccgagatcgcaccattgcactccagcctgggcaacagagcaagactcggtctcaaaaaaaaaaaaaaagaaaaagaaatgggaaggaa

SEQ ID NO: 144815 - DNA, 601 bp, Human
ccaggcatcatggcaggcgcctgtagtcccagctactggggaatctgaggcacaagaatcacttgaacccaggaggcagaggttgcaatgagctgagattatgccactgcactccagcctagatgacagagtgagactccatctcaaaaaagaaaaaaaattaaattcaattcaataaggcattatcataggatagggcaatgccttggaacactgactgaagtcaacctgccttggttcagacccctttcccttcccatacaagctgtatggctttaagcaaattattcaacctcctggyctttggttttctcatctataaaatgagaataatattgatatcagcctcacaagcttgtagtgagaataagttaatatatataaaattaatattaaatgagataataaatgtaaactaatatatgtaaagagtgttcctgcacatagtaaacattcaatcaatgttagctagcattatgtcagtaaagccaaagacactgagaattgtctcaaggtttcccttctgaggaataccttctagtttcggtgtcaatgctaagtgtcttttaagatgataaaccaatctttaaacttggcactg

SEQ ID NO: 144816 - DNA, 601 bp, Human
caggctggagtacagtggtgcaatcgcagctcactgcagcctcaacatccccccccacacacacacccgggctcaagtaacgggattacaggcacgcaccaccactcctggctaattttcatatttttttttagagatggtttcaccatgttgcccaggctggtctcaaactcccggcctcaagcaatccgcccacctcaccctccctaattgctaggactacaggtgtgagccactgcgcctggacaattaagttatttactcctcaaaaaaaaaaattttatgaggtagacactaataytttgaccattatataactaagaagacatagatgcagaggggttaactagcttgtccaaggtcatacaactcatcagtgaaaagctgagcccacattcttaaccactgcgtaacacagagaaatgtgtacagtataaccccattctttacttttaaagctctcataagtgcacatatacacacctgtgttagcatagagaatagtggaaggaaacacacctgagtgtcagccttggttacttcaagaaacagaagcagagaaggttggcaacctggctatatatgattctttgaatttttt

SEQ ID NO: 144817 - DNA, 601 bp, Human
ataatatttcttaaatgctgacattataaaaatttacgctgcagtaaaatgaaatcataaataatcatgcaacagcactttgatatatccaactccagctttaaggcactagtcagaaaagccaataatcttttaaacagcataaagaaaatacttgtaaatgcaacctttggcagaatttcataattctccaacaacagctttttagaacaatgattcccagttggatgcaatggctcatgtctgtaatcttagcactttgggaggccaaagtgggcagatcacctgaggtcaggagttytaaaccagcctgggcaacatggtgaaaccccatctctactaaaaatatgaaaattagccaggtgtggtggcgggtgcctgtaatcccagctacttgggaggctgaggcaggagaatctcttgaacccaggaggtggaggttgcagtgagccgagacagtgccactgcactccagcctgggcaacaagagcaaaactctgtttcaaaaaaaaaaaaaagaacaatgattcccatcccctccacttcattctttttttttttttttttttttttttttttttttttgacacggagacacagg

SEQ ID NO: 144818 - DNA, 601 bp, Human
ctactagaagtatgaattagcaaaacccctctggcaggcaatttggcaatatttatcaaactcgttaaaatgtataaacctttgccaggcgcagtggctcacgcctgtaatcccagcactttgggaggccaaggcgggcggatcacgaggtcaggagatcaagaccatcctggctaacacggtgaaaccccgtctctactaaaaatacaaaaaattagccgggcgtggtggcgggcgcctgtactcccagctactcgggaggctgaggcaggagaatggcgtgaacccggcatgcggaggytgcagtgagccgagatagcgccactgcactcaggcctgggcgacagagcgagattctgtctcagaaaaaaaaaaaaaaaaagtataaacctttgacccaataattttactccttgaaatgtatcctaaggaaataataatggatgcacccaacgatttaactctaaggatgtttataatgataccatttataaattttttttgcaaaccaagaaacattctaaactttagcaaatgaaagctggttaaaaggttttgatatcgtcattaacaatatcttaatatttaccattatagaaaa

SEQ ID NO: 144819 - DNA, 601 bp, Human
tcttatgaacacgaattacaatttatatggatgataagacctcacatgcttaaatacttaataagaggaaatacatagatgcctctggtggtggggaatttgacaattcacatgcaaagaaatttgaaacaaattacacagttttcaaaaacctttcaaaagttaaaagtcaatggcaaaaggatcgcttgaaatacaagtactataattgaattccatggtaataagatttttttttagttataataaacaacattgttgaaaaccagaggaaaagaaggtaattttccttccctactasaagtatgaattagcaaaacccctctggcaggcaatttggcaatatttatcaaactcgttaaaatgtataaacctttgccaggcgcagtggctcacgcctgtaatcccagcactttgggaggccaaggcgggcggatcacgaggtcaggagatcaagaccatcctggctaacacggtgaaaccccgtctctactaaaaatacaaaaaattagccgggcgtggtggcgggcgcctgtactcccagctactcgggaggctgaggcaggagaatggcgtgaacccggcatgcggaggttgcagt

SEQ ID NO: 144820 - DNA, 601 bp, Human; identical to SEQ ID NO: 40470

SEQ ID NO: 144821 - DNA, 601 bp, Human; identical to SEQ ID NO: 40471

SEQ ID NO: 144822 - DNA, 601 bp, Human; identical to SEQ ID NO: 40472

SEQ ID NO: 144823 - DNA, 601 bp, Human; identical to SEQ ID NO: 40473

SEQ ID NO: 144824 - DNA, 601 bp, Human; identical to SEQ ID NO: 40474

SEQ ID NO: 144825 - DNA, 601 bp, Human; identical to SEQ ID NO: 40470

SEQ ID NO: 144826 - DNA, 601 bp, Human; identical to SEQ ID NO: 40471

SEQ ID NO: 144827 - DNA, 601 bp, Human; identical to SEQ ID NO: 40472

SEQ ID NO: 144828 - DNA, 601 bp, Human; identical to SEQ ID NO: 40473

SEQ ID NO: 144829 - DNA, 601 bp, Human; identical to SEQ ID NO: 40474

SEQ ID NO: 144830 - DNA, 584 bp, Human
aagcaggatcatacttgtgggtcctcaggaactcccccagcaagcccttctccttcatggtctcacggatagacttaaatttcttcaggggcactctacagaaaggttgcatatgaggcaaggccctccctccttcctctcttcccactcctctctttctctctctccttctcttaactgcatgcttcaacctccctgccactctgtttgttcccccttgtctgtgtgtgtctttttctctctctcagccttttgctctctgtctctgtctgtctgtctctgtgtgtgtgtgtgtgtgtgygcgcgcgcgtgtttcttcctccctttgcctcttcccctctttcttacaaagctcttctcagcacttgctctaagattcagaaaaccattcatttcaccatgcatgcactcctcacctcatctcaagggtcctcctatctccctggccctttgctgtcaaatatcccatagattcctccccaggaaaggaagagggactttaggctttacccttttcaggatatgtactttttttttttgagacgcagtttcacttttgtcacccaggctagagtgcaatggca

SEQ ID NO: 144831 - DNA, 601 bp, Human
gttttcttgtttgtttgtttgcttgtttgagacagagtctcgccctgtcaccaggctggaatgcagtggcgcaatctcagctcacagcaacctctgctcccctggttctagcgattctcctgcctcagcctcccgagtagctgggactgcaggcgcgtgccaccacgctcagctaattttttgtacttttaatagagacagggtttcaccatgttggccaggatggtctctatctcttgacctcatgatctgcccgccttggccttccaaagtgctgggattacaggcgtgagccaccgtrgccagccacctctgcctcttgacaggtgttgcaggagccacctctcctgcgtagccttccttgactgccacagctcacctcctcacccgtctccttcttctctgagctccccaggccttatgcttcttaaggaaaaggaccatgtccctcttgttcagtatggtgccccagtgcctagcacatggtggccaccagtgagtgttgggggagtgactgaatggacctgtcttgtcctgccttcctgtcctgcacaccagaacactagcattccaccgtgtttcaggagagtccatctaactg

SEQ ID NO: 144832 - DNA, 601 bp, Human; identical to SEQ ID NO: 81827

SEQ ID NO: 144833 - DNA, 601 bp, Human; identical to SEQ ID NO: 81828

SEQ ID NO: 144834 - DNA, 601 bp, Human; identical to SEQ ID NO: 81829

SEQ ID NO: 144835 - DNA, 601 bp, Human; identical to SEQ ID NO: 81830

SEQ ID NO: 144836 - DNA, 601 bp, Human; identical to SEQ ID NO: 81831

SEQ ID NO: 144837 - DNA, 601 bp, Human; identical to SEQ ID NO: 81832

SEQ ID NO: 144838 - DNA, 601 bp, Human; identical to SEQ ID NO: 81833

SEQ ID NO: 144839 - DNA, 601 bp, Human; identical to SEQ ID NO: 81834

SEQ ID NO: 144840 - DNA, 601 bp, Human; identical to SEQ ID NO: 81835

SEQ ID NO: 144841 - DNA, 601 bp, Human; identical to SEQ ID NO: 81836

SEQ ID NO: 144842 - DNA, 601 bp, Human; identical to SEQ ID NO: 81837

SEQ ID NO: 144843 - DNA, 601 bp, Human; identical to SEQ ID NO: 81838

SEQ ID NO: 144844 - DNA, 601 bp, Human; identical to SEQ ID NO: 81839

SEQ ID NO: 144845 - DNA, 601 bp, Human; identical to SEQ ID NO: 81840

SEQ ID NO: 144846 - DNA, 601 bp, Human; identical to SEQ ID NO: 81841

SEQ ID NO: 144847 - DNA, 601 bp, Human; identical to SEQ ID NO: 81842

SEQ ID NO: 144848 - DNA, 601 bp, Human; identical to SEQ ID NO: 81843

SEQ ID NO: 144849 - DNA, 601 bp, Human; identical to SEQ ID NO: 81844

SEQ ID NO: 144850 - DNA, 601 bp, Human; identical to SEQ ID NO: 81845

SEQ ID NO: 144851 - DNA, 601 bp, Human; identical to SEQ ID NO: 81846

SEQ ID NO: 144852 - DNA, 601 bp, Human
ctgtagaaaaatttcctaaccatcttctataacacacatatagttcaacaaatggtagccagtattttaatcatcattaatctatctactttgaaataattaaatattaacggttaaaactttaactgtttccctcctttgggagtgaagaaatgcaagtcaatctcatttttagtttaaaatgtgaataagtgaccaccaaattttattgcagatgtgctttaaatatttggcaaattttaatatttttctgctggatctgtaggttggacttctgggaattcagatgttgtggacacaygattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaggtatctttttttttaatttagtgtactaactaataatgaacagctaagaattgtatatgttgcctaacttacatgaactttccatttacttggtcctttttcataa

SEQ ID NO: 144853 - DNA, 601 bp, Human
tttttccatgtacaattattagaacaacctgatatacagcaagaactcaataaatatattaactattcttcttttcttctccacctcctccttaccatcttaacagatggttgaaagtagctggccgagagcatccccatggccttgagtcctgtgttacagagcattccctgtgggtggggccagactgtgttacctgaaagtaactcaagatgatgaatacaaactgtgctttaggtgggaagccagtccttaactagaggaggaagcaagatcataaccaaacaacaaacaacaatarcaaaaagcaggactgtaaatagcaaggaatatggaggcctggtcagatggagatctgaacattgtatagtagccacgagtccattttttagtgtcagttgaatgacctggaagtgggcctactggatttaagagcagtgaaggggaccacttgccacttcctgtgttgattcctctgaatgggcaggactggtgtttcaccagtttcactggaaagtcacgaagctcctcagaatgtggttatgatggaatggaattcctaagtttgcttacctggtttctgtctctttgaacagaccag

SEQ ID NO: 144854 - DNA, 601 bp, Human
tacaattattagaacaacctgatatacagcaagaactcaataaatatattaactattcttcttttcttctccacctcctccttaccatcttaacagatggttgaaagtagctggccgagagcatccccatggccttgagtcctgtgttacagagcattccctgtgggtggggccagactgtgttacctgaaagtaactcaagatgatgaatacaaactgtgctttaggtgggaagccagtccttaactagaggaggaagcaagatcataaccaaacaacaaacaacaatagcaaaaagcargactgtaaatagcaaggaatatggaggcctggtcagatggagatctgaacattgtatagtagccacgagtccattttttagtgtcagttgaatgacctggaagtgggcctactggatttaagagcagtgaaggggaccacttgccacttcctgtgttgattcctctgaatgggcaggactggtgtttcaccagtttcactggaaagtcacgaagctcctcagaatgtggttatgatggaatggaattcctaagtttgcttacctggtttctgtctctttgaacagaccaggtactagagc

SEQ ID NO: 144855 - DNA, 601 bp, Human
ttcttcttttcttctccacctcctccttaccatcttaacagatggttgaaagtagctggccgagagcatccccatggccttgagtcctgtgttacagagcattccctgtgggtggggccagactgtgttacctgaaagtaactcaagatgatgaatacaaactgtgctttaggtgggaagccagtccttaactagaggaggaagcaagatcataaccaaacaacaaacaacaatagcaaaaagcaggactgtaaatagcaaggaatatggaggcctggtcagatggagatctgaacattgyatagtagccacgagtccattttttagtgtcagttgaatgacctggaagtgggcctactggatttaagagcagtgaaggggaccacttgccacttcctgtgttgattcctctgaatgggcaggactggtgtttcaccagtttcactggaaagtcacgaagctcctcagaatgtggttatgatggaatggaattcctaagtttgcttacctggtttctgtctctttgaacagaccaggtactagagcttgcatccatggctatgagagcccagtacctcttgcctcacttgtatatgctgat

SEQ ID NO: 144856 - DNA, 601 bp, Human
ggcttggctatagtgctggtgcagggagacatgggcatatataaccatgtgtttccctgcttaatccctttagtggcttccgactgctatgaagacaattcctaaaccccttcccatggccctgtgaaccctcaactctcatgctttctctagatcccgggatgcccctagctgtactgaccttttttcaattccttgaagatgccaatcagatcttctagacatttgcctatagcacttactcttcccacaccctcatgatcccttttgttccccgctcctggtggccctggctaattcytactatttatctgggttttagttgagatgttttcttcctctgagtgcccctctcagatatcctggagtagttaggtcctcctgctccatatattcatgagccctgaatttcggtggtggtgccctttgtactttattgcaatgatttgtttcactgtttgccttttgcccttttctgtaagctctggaagcctggaaccatctctgtctttgtttgcctagcacagtgtcaagcataggaagaaactcaataaatatttgttaataagaatcagttcatcaaagagtgaattttaaaaac

SEQ ID NO: 144857 - DNA, 601 bp, Human
attttaaaaactgcccacatgcttatgttttatgctattgcaattcagtatataatttttttgtattttatgtttttaaggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagataggtaggaaacccagttttcgttttttattttgtaattttaaaatgtgcwtaacattatttatagttgaatttgaaatattaacaaaagcagatttctgtcatgctgggtagatgctagctcattaaagtcagcctaacaatgaaataaccacttaaatatacatgtgcattgaatttttatgaagtagaaaaagataaaagaataaaagcaagcttgaatgttgactgtgagtgatttaatggtgaattttagattgcaagatggaaaaatattcctagaatcccaaaagaagttaaaattgcaaagaaggaaggtcccttggagatcatttaatttagtctttttttc

SEQ ID NO: 144858 - DNA, 601 bp, Human
attctttccattatatgacactaggcaattactaggtcttttttatcccatgacacccagttaagtatgctgtgcatagaaaacattcaataaatgttgttagaattgacttaaattgcgttctttaatattaagtgctgctgttactttaagtagggctgcctccaggtgaaattatatcaaatcacatcttcagcctccttttgatttattgaacctatcccttttatatgcccagtgccatagcaacataaatttgtcagtgttttctcttctattggtgtttacatattaagcatcrtgtctcatgaagctttactaagatctttactaagttttacttagatccaaaacaaatacaacagaagctggatcatggatacaaagagatttattatattagtattctttgcacttttctaaatgagcgaattatttcatagtgaaactatttatttacagtggtgtgctggagctgacttgcatcagcctgtggtgcttacctggtttctttttttgttttgagacagagtcttgctctgtcgcccaggctggagtgcagtggcgcgatcttggctcactgcaacctccacctctacct

SEQ ID NO: 144859 - DNA, 601 bp, Human
ggctcactgcaacctccacctctacctcacaagtagctgggactacaggcgcatgccaccacgcctggctaatttttgtgttttttaaatagagacagggtttcaccgtattggccaggctggtcttgaactcctgacctcatgatccgcccgcctcagcttcccaaagtgttgggattacaggcgtgagccaccatgcccagccttacctggtttctgtctatgtgcattttgccccgactttgtgatatcacattggtagcttgccattgaccacagtggaagaatttatacaatagawattggcaaacatgaaaaccaggtttttttttttttttttttttttctggagagccagttgttaaacatttgccagcacaatactgctcatttggttctcctgactgtaatgggaggaaggcctgagggttttaagtcagggttgaggagttttgaaattagtctcaagaaatctttgggctcactgtagtacttttaatgaatatcaagtaccctaaccttgtttgttcacttcttttatgtgggctactcagactctaaaataaataggcccattccaatcacattggatttttgcttg

SEQ ID NO: 144860 - DNA, 601 bp, Human
acaggcgtgagccaccatgcccagccttacctggtttctgtctatgtgcattttgccccgactttgtgatatcacattggtagcttgccattgaccacagtggaagaatttatacaatagaaattggcaaacatgaaaaccaggtttttttttttttttttttttttctggagagccagttgttaaacatttgccagcacaatactgctcatttggttctcctgactgtaatgggaggaaggcctgagggttttaagtcagggttgaggagttttgaaattagtctcaagaaatctttggrctcactgtagtacttttaatgaatatcaagtaccctaaccttgtttgttcacttcttttatgtgggctactcagactctaaaataaataggcccattccaatcacattggatttttgcttgcgccatcctgtaacgtgtcatcccatactcacaatgctttattggatgaacatttgcagatgctatatcacgttagctcaggccttgggcatgaacatgggaggtgctcccgcaggacctgctggcactggcaaaacagaaaccacaaaagacatgggaaggtgtttgggaaaatatgt

SEQ ID NO: 144861 - DNA, 601 bp, Human
aggacctgctggcactggcaaaacagaaaccacaaaagacatgggaaggtgtttgggaaaatatgtggtcgtgttcaattgctcagatcaaatggatttcagaggcctaggaaggattttcaaaggcaagtgtcaaataatgtagattattttaggtgaatttatttttattgccttttaatgttattttctgatataaatccaaagtgacgtgatctcatataatctacattagtatgggttgatccgtatgatattgccatttttctaggtcaaaaatggctggatatcaacagtttcrtatggttcaatactattgctagtgttatagtctatgcatggaatgtgtgttagattacgaaaatggaatcaatctataattgcctgaaataatagtagagaggatcaaaatagcaaacaggggacacatgtggcttccctcccacagaaatgaaagaattttagaaagcatagcaacactggaaaataagaagggggtggccatcagcagatggaaaattttgagaaaatcctgaaaggtacgtagaacatgttttcagatggacagagaaaaaaatatttgaagacacatcaacctcag

SEQ ID NO: 144862 - DNA, 601 bp, Human
tcaaaggcaagtgtcaaataatgtagattattttaggtgaatttatttttattgccttttaatgttattttctgatataaatccaaagtgacgtgatctcatataatctacattagtatgggttgatccgtatgatattgccatttttctaggtcaaaaatggctggatatcaacagtttcatatggttcaatactattgctagtgttatagtctatgcatggaatgtgtgttagattacgaaaatggaatcaatctataattgcctgaaataatagtagagaggatcaaaatagcaaacrggggacacatgtggcttccctcccacagaaatgaaagaattttagaaagcatagcaacactggaaaataagaagggggtggccatcagcagatggaaaattttgagaaaatcctgaaaggtacgtagaacatgttttcagatggacagagaaaaaaatatttgaagacacatcaacctcagagctcagtacttggcgatcttctcttttctatctacatgcattctcttggtgatcttatgtaggtccaaactttaaatgccatctgtatgatgactccagaattatatctctagctcgg

SEQ ID NO: 144863 - DNA, 601 bp, Human
gaagggggtggccatcagcagatggaaaattttgagaaaatcctgaaaggtacgtagaacatgttttcagatggacagagaaaaaaatatttgaagacacatcaacctcagagctcagtacttggcgatcttctcttttctatctacatgcattctcttggtgatcttatgtaggtccaaactttaaatgccatctgtatgatgactccagaattatatctctagctcggacttcttgaaactctagattcattacgtacaactgttgatttagcatgtccacttaaatgtctagcaggtscagattcactatgtttaaaaccaaactcccggccgggcacggctcacgcttgtaatcccagcactttgggaggccgaggcaggcggatcatgaggtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctacc

SEQ ID NO: 144864 - DNA, 601 bp, Human
tcagagctcagtacttggcgatcttctcttttctatctacatgcattctcttggtgatcttatgtaggtccaaactttaaatgccatctgtatgatgactccagaattatatctctagctcggacttcttgaaactctagattcattacgtacaactgttgatttagcatgtccacttaaatgtctagcaggtgcagattcactatgtttaaaaccaaactcccggccgggcacggctcacgcttgtaatcccagcactttgggaggccgaggcaggcggatcatgaggtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaac

SEQ ID NO: 144865 - DNA, 601 bp, Human
tctcttttctatctacatgcattctcttggtgatcttatgtaggtccaaactttaaatgccatctgtatgatgactccagaattatatctctagctcggacttcttgaaactctagattcattacgtacaactgttgatttagcatgtccacttaaatgtctagcaggtgcagattcactatgtttaaaaccaaactcccggccgggcacggctcacgcttgtaatcccagcactttgggaggccgaggcaggcggatcatgaggtcgggagttcaaccatcctggccaacatggtgaaaycccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaacaaccatccccaaacaacttcgacc

SEQ ID NO: 144866 - DNA, 601 bp, Human
ttatatctctagctcggacttcttgaaactctagattcattacgtacaactgttgatttagcatgtccacttaaatgtctagcaggtgcagattcactatgtttaaaaccaaactcccggccgggcacggctcacgcttgtaatcccagcactttgggaggccgaggcaggcggatcatgaggtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaacaaccatccccaaacaacttcgacctatcctttactccgctctttctcttatactcagatccaatctgtcagcaaacactgttggttctactttcaaaataccccca

SEQ ID NO: 144867 - DNA, 601 bp, Human
gtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaacaaccatccccaaacaacttcgacctatcctttactccgctctttctcttatactcagatccaatctgtcagcaaacactgttggttctactttcaaaatacccccaaaatttgtactttcatcttagcagtgtactgtttccattgttttgatgaaaatatacaaataattaaacctctctttatcactggaattaaatatgtatttatcaacagccagatatgaaactttacataatcccgtttcaatgtataatggtttgggagcactggagaaatgattgttatc

SEQ ID NO: 144868 - DNA, 601 bp, Human
atgccaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatggtgagaaaaaaggctttaaatgcaatttaattagtttaattgttacagacataaataaaacaaagcatgtgttaatgggtagatgaccaactatccaggagttatragctgttctctcttaccatatgattttttttatgtcattataacccagacagaagataaaatagtaatttttttcaattaaaaaaaattcagatccagacctacagaggtaatatgctaaggataataatagatactgtttattgaccacatagtataatatgtgtaaggtgcaggctaaatgttctatgtgctatatcagatggcataactcatgtggttctgcagtaacaaacaatccctaaatcttaattgcttaaagccacaaggtttatctctctgtcatgccacatgtccactg

SEQ ID NO: 144869 - DNA, 601 bp, Human
caaatttatattgttttgacagcaagaaaagaaagaaagaaacagttcattttttctgatggtgattgtgttgatttaaatccagaatttggaatcttcttaacgatggtgagaaaaaaggctttaaatgcaatttaattagtttaattgttacagacataaataaaacaaagcatgtgttaatgggtagatgaccaactatccaggagttataagctgttctctcttaccatatgattttttttatgtcattataacccagacagaagataaaatagtaatttttttcaattaaaaaaaattcagatccagacctacagaggtaatatgctaaggataataatagatactgtttattgaccacatagtataatatgtgtaaggtgcaggctaaatgttctatgtgctatatcagatggcataactcatgtggttctgcagtaacaaacaatccctaaatcttaattgcttaaagccacaaggtttatctctctgtcatgccacatgtccactgtgggttgactagggtagaagtaggaggccagggctgctttgtatgtctttactctagtactcggcctgacgaggtacctactatctc

SEQ ID NO: 144870 - DNA, 601 bp, Human
acttcctaggtcacccagccagtaagagaaagaagaagttgttgtctctctaacataaaaatctgactgcttaacctccacacttggtttttctttgacaccgaataaaaggaaataaaaataaaatttctgcaataatttaacaaggtcctatacgaaagaattgtaacaaattcagttaccatgtgattaagggtgagctttgagattcagtgttgtaaagataggaaaccaaaggcatgaataaacgggagtttttatgcttttatgtatcaccagttttaaagcttttatgtgtttkccataaagttaaatctcgaagttgcaagataacacaaagcactctgagtttttaaatgtccccatggataaagatgataaattataggaagcaaaatcagaaatgtttctgatacactttattgtaagcaaacatccagtaaagcagttagggggaaataagaataatctgaagtattgattataagtcaggaagtgggatgaagaaatgtactcagtgtaaaactgtggtctagaattttacaaaaagcttaacatgctccctggattaagaataatattggaaatagcaattagatat

SEQ ID NO: 144871 - DNA, 601 bp, Human
aatgtactcagtgtaaaactgtggtctagaattttacaaaaagcttaacatgctccctggattaagaataatattggaaatagcaattagatattgcattaagctgtgagtaactgaaacctaaaaaaaattgtagtttaacatgtaaggattctcttaagatccttttatggttctactccatcatgaattccatcttcaaggtcaccttatgaaccaagatgctacagaaagcatctctattgtgttgcagccaattgactgagtcaactctcttcaaaaaaacatcaaggatatttartacagtgtgcccctttgcatctcgcagtgtagaatataatcacagcagctgcaaggcaggctgggaaatgtagtttttaatctaggtgttgctgtacccagcttgcaggtgggctcctgtggctcaggaaggttaagaggagtattgagaggcagcctcaatttctgtatttccagcccctagcaaggtacctggcctattgacagtgcccagtaaatggtcagggactgaaggtttttaacaaacttgcctaaaataactcattcctgttggccttacttgtctttgaatctccaacct

SEQ ID NO: 144872 - DNA, 601 bp, Human
ttcagtgtttttcccatcattcccttctttatttcccctcactgccatctttatttctcctcacttccatgggtttttgttagccaaagagctctgtaactgtggctgcaaagaataattgaagagatggaataaaaaaaatgcccaaggaagctcatcagtataaaatccttagtttttttcttctttcaataacatactttagaccataattatcaggtatctattcagttttctcttgtattatttcacgttcttttctatttttaagccagcagacacaattttctattttttaagycagtagacaattttgccacacaaaattgtgtgtgactttattaatatcatgaaaatggaaatatataaaagggcatataaatattaatatacatggtctaatacatattgttttgagaaaacaagagtattttatgaatctaatattttcaataccatcttaaaatctgaattaggggtttgaaatatatttgtattcagaaatgaaaattgttttagcaattaaaaattaaacatattttaacttttagaaccctggatatgctgggcgccaggaactaccagaaaacctaaaaatcca

SEQ ID NO: 144873 - DNA, 601 bp, Human
gaggtaggctgatgttgagctgtgagcacccataattacagggataataagtgtgcaaagctaccactgtgcttccagaagaaagcaaaagaccccatgacctgtgtgaccaacatggactataagtgcctccttttatcagctgtgtgcagtgaaacaggtcatcagtgggcttcagctccaagactcaacctagttgtctaccattattcacaaagtgacacaaattctcagcataagaatctggattcacagggaaccatgagaactttttgctttctctgtatgtgactagcttatctcagatatatctctcccaaaacataaacatcatttctattttccaaaaacacattgaaaatttgctgtggagagcatgctgctttcatgcttgtcatggttacagcctgatttttttttttttctttgaaacagactctcagtcacccaggctggagtgcagtggtgcaatcttggctcactgcaacctcctcattccaggctcaagctatttccctgccccagcctcctgagtagctgggactactggcacacaccaccatgcctggctaatttttgtactgttttgtagagatagggt

SEQ ID NO: 144874 - DNA, 601 bp, Human
ctgggactactggcacacaccaccatgcctggctaatttttgtactgttttgtagagatagggttttgccatgtcacccaggctggtctcaaactcctggactcaagtgatccaccccacctcagcctcccaaagtgctgggattacaggcataagccaccaagcccagcccagcccagccaggttgttttgaatagctgatggacaggttcatgtgacatataaggatttctacatgccacatattgtgcccatgccatgggtgtacaaagttgaagaagaagtggttcaggaagctacmttctagttacaaaaactaacatctgtggagttcattagtgttacaaagtcttttcaggtgtatcgtcttatttgagcctcacagcaactctgtggggtctggatggctagcttgtttattgtcacttcacttattggggaatggagactagaggttgcaggattcccccataatcaccatcagctgagaagaggggacaaaaatttataagattttctggtgccaaatccactgctcctgccagtatacctcactgcctgtatgaccaacatggactgtaatggaggcttagactcccta

SEQ ID NO: 144875 - DNA, 601 bp, Human
tccgttctttaatttcatggggttgggactacaaattatcatttttaaggttaatgcaaatgccactgtgagaagcaaagattcatgtgataaagtaatgaggtcgtactttggagcagtagactggggcaggattgtagaacacattgaatgctaacgaactttgggtacaatatagattcagtggtgattgtattagtctgttctcacactgttaataaagacaatttataaaggaaagaggtttgatgaactcacagttccacatggctggggaggcctcacaatcatgctgggaggygaatgaggagcaaagtcacgtctttacatggcggcaggcaagagagcatgtgcaagggaactcccgtttacaaaaccatcagatcttgtgagacttattcactatcataagaacagcagggaaagacttgcccccatgatacaattacctctcactgggtccctcccacgacacgtgggagttatgggagctacgattccagatgagatttgggtagggacacagccaaaccatatcagtgatattctggagaaagtactagagaatacaagcctgattaggagagtaataaatggttct

SEQ ID NO: 144876 - DNA, 601 bp, Human
tgttcatcacatttcatccttgtgacaaccatctaaccacttgattggattaccagtagaatcaagaacttgtagcagagacacaggattaaatctctatgagcttgatgctttgggaatattttccagagcttttggaaaattaaggagctgaaattgtggacattgttgaaaactgcatttgaaatattaatataacgattcttattttaacttactgttcttgccagattataagatgtgcaagtatctgagatacatccaaatcttacaaagaaatatgtgcatgggggaaaagtckttttcatcattcatgtactggaaaccattttaagagtttaaaaaatttctgggaaaacatgattttatatatgatatgcatacagtatactgagttttaaaattcttgccatctcaatgggtggcgactagaattttgggttctttgttgatgtcaataacattgctcttgaacatgtcaggaacagtgcctctgttgcttttaaactatagtttacaatggtaatacatttctgtccaaaatgttaggagaataactcactctccctctgatcagctgtcagacctttgacttcttaat

SEQ ID NO: 144877 - DNA, 601 bp, Human
ttaacttactgttcttgccagattataagatgtgcaagtatctgagatacatccaaatcttacaaagaaatatgtgcatgggggaaaagtctttttcatcattcatgtactggaaaccattttaagagtttaaaaaatttctgggaaaacatgattttatatatgatatgcatacagtatactgagttttaaaattcttgccatctcaatgggtggcgactagaattttgggttctttgttgatgtcaataacattgctcttgaacatgtcaggaacagtgcctctgttgcttttaaactrtagtttacaatggtaatacatttctgtccaaaatgttaggagaataactcactctccctctgatcagctgtcagacctttgacttcttaatttttttaatgagaaaactgcagacgggatgttatagcagcggctgtccatgatcctagcatgtctcctcgaatctcttgtaccatttccacgtgcccctgcccagcttctgtgtgttttcgcttctaatagcaaaaggaggcctggagccattttgttggcaggcacaaagagtaggtgctgcacgggagtttatttcccatccacccc

SEQ ID NO: 144878 - DNA, 601 bp, Human
aggaatcctcattcatgatgtacttctggggaattagaaggcccctttgaaacggatcttcactgtgatgctctgcgttgctgctttccaccactaaggggcgatatcatcacattggatgccgagaaagtttgcgcatggaacaactgctggttatagaccaacaagccaaaatcacagggaatcatcacgcaagaagcaaaaactagatgctgagttaattatttccaaaatgtaattcaagctccacattgttattactttagcacatatcgttttataacgtggtgctcatttgctrtgcacatctagtaaaacaacattttttacaacttaaaaatagtgaactagttacgttaatgaagagcttattaaagcctttaatcttcaagtagctactatgaatgtcagcaagagactcataaattacatattttaatttactggttaattgtgtagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaag

SEQ ID NO: 144879 - DNA, 601 bp, Human
agtgtgactgtgtgtgtgttccagtaaaactttatttaccaaacaggtggccagcctctagggccacagtttgctaagtcctgcaaaattttacaaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtcyaaaacaggatagcctttcttctacgtgctgttggctgtaggacggtgatcaagcaatagcttgagatatatctatttttcttctctcttccttcctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaatta

SEQ ID NO: 144880 - DNA, 601 bp, Human
ttacaaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttycttcctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatg

SEQ ID NO: 144881 - DNA, 601 bp, Human
tacaaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttcyttcctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgt

SEQ ID NO: 144882 - DNA, 601 bp, Human
aaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttccttyctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatg

SEQ ID NO: 144883 - DNA, 601 bp, Human
ggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttccttcctccttttaattttactattatttacaattttttattttcaaaattttaatttaaaaatttattttatttgaaacattttcagtctctcaatcttctggaagggttaattccctccaaagaagaaggcggtgtttcctgtgtygaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtaagcccactgaactataccttaaatgaaatgacttttttcaaatgagaaaatataagctttcataaactcttctatgagagaatattaaaacaattatgaaaacataattgttaatacca

SEQ ID NO: 144884 - DNA, 601 bp, Human
ttaaaagaaatgcctttgaacttggtgctttcatccagagcccaggccctgattcttcaaagttccaaagaggaaaaatatgcttcctaaaaactctaattacctctggttcttcctaaaaactcaaaaacagcaatagtcttttgtttgtttgttttaatgaataaactgaaggacaactggagcaggagagtagacagcaatagccaaattttgaaagcaagaaagcagtaaggtaagcggcagtcgatttagcacactggcagtgggaagagctgagaagtaattgagaagcgcacgycacaggacattcaaagggctcaggaagtggaaactggggcaaaagttgagctaaaaaccacagggctggttataagtctgtttgagaaaaagacctcctgggccgctttccaaagccctgctgccagacaatcggccttccccacactggcaagactaaagagttactgtttgaatcgtgtaaaatagagggtttcctagacttggggacaccaggcacatttaagagtgggagaatcataccaaaactggggattaagtggaaatttgtgtttgaaagggactgagataaataaatttt

SEQ ID NO: 144885 - DNA, 601 bp, Human
agtggaaactggggcaaaagttgagctaaaaaccacagggctggttataagtctgtttgagaaaaagacctcctgggccgctttccaaagccctgctgccagacaatcggccttccccacactggcaagactaaagagttactgtttgaatcgtgtaaaatagagggtttcctagacttggggacaccaggcacatttaagagtgggagaatcataccaaaactggggattaagtggaaatttgtgtttgaaagggactgagataaataaattttttcagtgggccatctttaaccagaawggccaataattgtattacatgtgttagatgctgctaaaggtttgagatggcaaaagggcactctaactcaaaatgcaaactaacaaaggaatctttaaatctagatatgcactcccttagaatccagagccaagctcctccacagcgctgctttctgagcagccggagttctatgatgtttaaaggttcagattgcctccctctgagtgccttgtccttattcagaggccgggccccaagttactcagagagtgaaattcatcagcagcaattttccaaccatggcagagccttggttag

SEQ ID NO: 144886 - DNA, 601 bp, Human
cgtgtaaaatagagggtttcctagacttggggacaccaggcacatttaagagtgggagaatcataccaaaactggggattaagtggaaatttgtgtttgaaagggactgagataaataaattttttcagtgggccatctttaaccagaatggccaataattgtattacatgtgttagatgctgctaaaggtttgagatggcaaaagggcactctaactcaaaatgcaaactaacaaaggaatctttaaatctagatatgcactcccttagaatccagagccaagctcctccacagcgctgmtttctgagcagccggagttctatgatgtttaaaggttcagattgcctccctctgagtgccttgtccttattcagaggccgggccccaagttactcagagagtgaaattcatcagcagcaattttccaaccatggcagagccttggttaggggattgagatggcatctaataaggaagccaataaaataattaccttcctctgtgccatcaaaaatatgtattgccacatttcttaaagagcagtccagtgatgtttgtgacattttcttccaagtagctaggactggttctgtaagttta

SEQ ID NO: 144887 - DNA, 601 bp, Human
ggagttctatgatgtttaaaggttcagattgcctccctctgagtgccttgtccttattcagaggccgggccccaagttactcagagagtgaaattcatcagcagcaattttccaaccatggcagagccttggttaggggattgagatggcatctaataaggaagccaataaaataattaccttcctctgtgccatcaaaaatatgtattgccacatttcttaaagagcagtccagtgatgtttgtgacattttcttccaagtagctaggactggttctgtaagtttagacaatgatgttttcttatttttaatggagatgttaacaaaaggttgacaacaatctagactcatattccttcttcaaggtggtcctgaagtggtctgttgactaaaatattgaggggttgcaggcattcagtcttgccatcctaagtaactacttttgacgaaatttatttgcccgagcctttgtggccacgaaatgaactaagatattatgcacttagtggttatttagggccctaacatgtccactcagctgacttctagccagccctttcttaactcattcttcatccatccttttaatttttttatgga

SEQ ID NO: 144888 - DNA, 601 bp, Human
taggggattgagatggcatctaataaggaagccaataaaataattaccttcctctgtgccatcaaaaatatgtattgccacatttcttaaagagcagtccagtgatgtttgtgacattttcttccaagtagctaggactggttctgtaagtttagacaatgatgttttcttatttttaatggagatgttaacaaaaggttgacaacaatctagactcatattccttcttcaaggtggtcctgaagtggtctgttgactaaaatattgaggggttgcaggcattcagtcttgccatcctaartaactacttttgacgaaatttatttgcccgagcctttgtggccacgaaatgaactaagatattatgcacttagtggttatttagggccctaacatgtccactcagctgacttctagccagccctttcttaactcattcttcatccatccttttaatttttttatggacattaacatctttggagaagacttcattcatagatttaaaatgaagtaaggagacttatgcttccagcgaagatggagtaatggggactgggtttaacctcttatattaaaaatatagaaaactggacaaaat

SEQ ID NO: 144889 - DNA, 601 bp, Human
accttcctctgtgccatcaaaaatatgtattgccacatttcttaaagagcagtccagtgatgtttgtgacattttcttccaagtagctaggactggttctgtaagtttagacaatgatgttttcttatttttaatggagatgttaacaaaaggttgacaacaatctagactcatattccttcttcaaggtggtcctgaagtggtctgttgactaaaatattgaggggttgcaggcattcagtcttgccatcctaagtaactacttttgacgaaatttatttgcccgagcctttgtggccaygaaatgaactaagatattatgcacttagtggttatttagggccctaacatgtccactcagctgacttctagccagccctttcttaactcattcttcatccatccttttaatttttttatggacattaacatctttggagaagacttcattcatagatttaaaatgaagtaaggagacttatgcttccagcgaagatggagtaatggggactgggtttaacctcttatattaaaaatatagaaaactggacaaaatgtgtaagacggttttttttcagagattggacaataggcactactg

SEQ ID NO: 144890 - DNA, 601 bp, Human
ctgtctcaccaaatgagaaggcagaggttgatttgggagaggccaaggtggctggaatttgcagggcagagcaccagagaggagaaatctgcacaaggaggaagtgtcagagaacaacagaaacagaaagacaaatccacagttatactaaaggtgtcaatattttgaataattgatagaacaaatagacaaaattagtaaatatatggaagactttaacaacactatcaataccctgaattcaaaattatagaatgcttcagcccaaaacagcagaatatacatttttttccagtgcacrgaaaacacttaccaagatattctgggtcatataacaattctcgatagggagactttacagcactttatgtctttactagaaaagaagaaaggtctcaaaacaatgatttcaacttcttccttaataagttaggaaaagaaaagcaaattaaacccaaagtaagcagaagaaagaaccatgatcaaagcagaaatcaatgaaacaaaaaatagaacagcaacagaaaaaaatcaatgaaacaaaaagatggatctgaaaagatcaataaaaagaataaatctcttattagagacatcagaa

SEQ ID NO: 144891 - DNA, 601 bp, Human
caaggtggctggaatttgcagggcagagcaccagagaggagaaatctgcacaaggaggaagtgtcagagaacaacagaaacagaaagacaaatccacagttatactaaaggtgtcaatattttgaataattgatagaacaaatagacaaaattagtaaatatatggaagactttaacaacactatcaataccctgaattcaaaattatagaatgcttcagcccaaaacagcagaatatacatttttttccagtgcacggaaaacacttaccaagatattctgggtcatataacaattctckatagggagactttacagcactttatgtctttactagaaaagaagaaaggtctcaaaacaatgatttcaacttcttccttaataagttaggaaaagaaaagcaaattaaacccaaagtaagcagaagaaagaaccatgatcaaagcagaaatcaatgaaacaaaaaatagaacagcaacagaaaaaaatcaatgaaacaaaaagatggatctgaaaagatcaataaaaagaataaatctcttattagagacatcagaacaaaagagaagacatacattaccatagtcaaggatgaaagaga

SEQ ID NO: 144892 - DNA, 601 bp, Human
aatccacagttatactaaaggtgtcaatattttgaataattgatagaacaaatagacaaaattagtaaatatatggaagactttaacaacactatcaataccctgaattcaaaattatagaatgcttcagcccaaaacagcagaatatacatttttttccagtgcacggaaaacacttaccaagatattctgggtcatataacaattctcgatagggagactttacagcactttatgtctttactagaaaagaagaaaggtctcaaaacaatgatttcaacttcttccttaataagttagraaaagaaaagcaaattaaacccaaagtaagcagaagaaagaaccatgatcaaagcagaaatcaatgaaacaaaaaatagaacagcaacagaaaaaaatcaatgaaacaaaaagatggatctgaaaagatcaataaaaagaataaatctcttattagagacatcagaacaaaagagaagacatacattaccatagtcaaggatgaaagagagaacatcactacagtcctcacaaacattagaaacatgacgtgagtatattagaaacaactttgcaagaacacatttgacaatgaagatga

SEQ ID NO: 144893 - DNA, 601 bp, Human
catttgacaatgaagatgaaatggacaaatttcttgaaagatataaactaccagccatcatcaagaagaactagatattgcacagcatgctgaatatagttaataactgtgttgtacatttcaaaattgctaagagagtaaatttcaaatattttcaacacaaaaaaatgataagcatttgaggtgatagatatgttaattcgcttgtaataattccacatgatacgttaattcgcttgtaataattccatattgtatccataaaccataacattttgttccccataaatatatacaattrtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaacgtacaataggaagaaacacttcccagtccatttcataaggacagtgttatgctgatgccaaaaccagagaaagacattccaagaaaaaaacaaa

SEQ ID NO: 144894 - DNA, 601 bp, Human
gtaataattccacatgatacgttaattcgcttgtaataattccatattgtatccataaaccataacattttgttccccataaatatatacaattgtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaaygtacaataggaagaaacacttcccagtccatttcataaggacagtgttatgctgatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatattagactaaaaactaagcaagccataaacagtcatctaaatgaatgaag

SEQ ID NO: 144895 - DNA, 601 bp, Human
cgcttgtaataattccatattgtatccataaaccataacattttgttccccataaatatatacaattgtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaacgtacaataggaagaaacacttcccagyccatttcataaggacagtgttatgctgatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatattagactaaaaactaagcaagccataaacagtcatctaaatgaatgaagaaaagcatttggcaaaatttgacactc

SEQ ID NO: 144896 - DNA, 601 bp, Human
ataaaccataacattttgttccccataaatatatacaattgtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaacgtacaataggaagaaacacttcccagtccatttcataaggacagtgttatgctsatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatattagactaaaaactaagcaagccataaacagtcatctaaatgaatgaagaaaagcatttggcaaaatttgacactcttttgtgatgaaataggaactttatca

SEQ ID NO: 144897 - DNA, 601 bp, Human
tcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaacgtacaataggaagaaacacttcccagtccatttcataaggacagtgttatgctgatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatattagactaaaaactaagcaagccataaacagtcatctaaatgaatgaagaaaagcatttggcaaaatttgacactcttttgtgatgaaataggaactttatcatctgacaacatctacaaaatacctacagctaacgttatacggaatggt

SEQ ID NO: 144898 - DNA, 601 bp, Human
tatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaacgtacaataggaagaaacacttcccagtccatttcataaggacagtgttatgctgatgccaaaaccagagaaagacattccaagaaaaaaacaaaaacaaaaaaaactatagaccaatattcctcaggaacattgacraaaatttcttaataaaattataacaaatccaatagtatacaaaagtccaactgtggcttttattctagaaatggaagatcaacattcaaaaactgatcaatataatctgccatattagactaaaaactaagcaagccataaacagtcatctaaatgaatgaagaaaagcatttggcaaaatttgacactcttttgtgatgaaataggaactttatcatctgacaacatctacaaaatacctacagctaacgttatacggaatggtaaacaactaaatacttccttcccaatatcaagaac

SEQ ID NO: 144899 - DNA, 601 bp, Human
tcgagaccagcctggccaacatggtgaaaccccgtctctactaaaaatacaaaaatcagctgtgcgtggtggcgggtgcctgtaatcccagctactcaggaggctgaggcaggaaaattgcttgaacccggagatggaggctgcagtgagctgagatcgcaccactacactccagtctgggccacagaggcagaccttgcttcaaaaaaaacaaaaacaaaaccccgcacaatggatatcatcacatagccactggaatgtctacagttaaaaaggttaataatgccaaatattggtgccrtaatagagcacctagagccctcatatgctacagaatggcacagccactttggaaaatagtttggcagtgttttagaagttaaacatactcatttttgcttactttctcaagaaaacatgaaattggggttattactccaatgatgagtatttgttcatcattgtttcaccaatatcaatgtatgctttctttccatgcattctgtgtacacagtaacttttgggtataattctgaatcattgtataatctttttgaagacatttaaaatagaggctaaacgtatcaatgaaagtaattca

SEQ ID NO: 144900 - DNA, 601 bp, Human
cagcctggccaacatggtgaaaccccgtctctactaaaaatacaaaaatcagctgtgcgtggtggcgggtgcctgtaatcccagctactcaggaggctgaggcaggaaaattgcttgaacccggagatggaggctgcagtgagctgagatcgcaccactacactccagtctgggccacagaggcagaccttgcttcaaaaaaaacaaaaacaaaaccccgcacaatggatatcatcacatagccactggaatgtctacagttaaaaaggttaataatgccaaatattggtgccgtaatagagcacctagagccctcatatgctacagaatggcacagccactttggaaaatagtttggcagtgttttagaagttaaacatactcatttttgcttactttctcaagaaaacatgaaattggggttattactccaatgatgagtatttgttcatcattgtttcaccaatatcaatgtatgctttctttccatgcattctgtgtacacagtaacttttgggtataattctgaatcattgtataatctttttgaagacatttaaaatagaggctaaacgtatcaatgaaagtaattcaatttgaa

SEQ ID NO: 144901 - DNA, 601 bp, Human
ctttccatgcattctgtgtacacagtaacttttgggtataattctgaatcattgtataatctttttgaagacatttaaaatagaggctaaacgtatcaatgaaagtaattcaatttgaatggcaatgataggaataacgccaatacaagtttgcctagcaacagcaatggtacagtaccacaggttgtaaggaacatccagagatgctaaaatgtaaataaatttttgaaatcaatgttttttttttttttttttgagacggagtttcgctctttgttgcccacgctggagtgcaatggcrcgatcttggctcaccacaacctccgcctcccgggttcaagtgattctcctgcctcagcctcccgagtagctgggattacaggcatgcaccaccaggcctggctaattttgtatttttagtagagacagggtttctccacgttggtcaggctggtcgcgaacttccaacctcagctgatccacccacctcagcctcccaaagtgctgggtttacagacgtcagccactgtgcccggacttgaaatcaatttcttatggcaaatactctatatctagtaaacggttgactctttttttggtc

SEQ ID NO: 144902 - DNA, 601 bp, Human
gtaacttttgggtataattctgaatcattgtataatctttttgaagacatttaaaatagaggctaaacgtatcaatgaaagtaattcaatttgaatggcaatgataggaataacgccaatacaagtttgcctagcaacagcaatggtacagtaccacaggttgtaaggaacatccagagatgctaaaatgtaaataaatttttgaaatcaatgttttttttttttttttttgagacggagtttcgctctttgttgcccacgctggagtgcaatggcgcgatcttggctcaccacaacctcygcctcccgggttcaagtgattctcctgcctcagcctcccgagtagctgggattacaggcatgcaccaccaggcctggctaattttgtatttttagtagagacagggtttctccacgttggtcaggctggtcgcgaacttccaacctcagctgatccacccacctcagcctcccaaagtgctgggtttacagacgtcagccactgtgcccggacttgaaatcaatttcttatggcaaatactctatatctagtaaacggttgactctttttttggtcttttccgtcttttcagttgatgtg

SEQ ID NO: 144903 - DNA, 601 bp, Human
tttgaagacatttaaaatagaggctaaacgtatcaatgaaagtaattcaatttgaatggcaatgataggaataacgccaatacaagtttgcctagcaacagcaatggtacagtaccacaggttgtaaggaacatccagagatgctaaaatgtaaataaatttttgaaatcaatgttttttttttttttttttgagacggagtttcgctctttgttgcccacgctggagtgcaatggcgcgatcttggctcaccacaacctccgcctcccgggttcaagtgattctcctgcctcagcctccygagtagctgggattacaggcatgcaccaccaggcctggctaattttgtatttttagtagagacagggtttctccacgttggtcaggctggtcgcgaacttccaacctcagctgatccacccacctcagcctcccaaagtgctgggtttacagacgtcagccactgtgcccggacttgaaatcaatttcttatggcaaatactctatatctagtaaacggttgactctttttttggtcttttccgtcttttcagttgatgtggcttttctgctaggcatccattacattactggttttacc

SEQ ID NO: 144904 - DNA, 601 bp, Human
cctcagcctcccaaagtgctgggtttacagacgtcagccactgtgcccggacttgaaatcaatttcttatggcaaatactctatatctagtaaacggttgactctttttttggtcttttccgtcttttcagttgatgtggcttttctgctaggcatccattacattactggttttaccaccggctgattttaattccatttcaggcaaggtttctccagatgggtgagttagcaatttaaaagccaatttacaaaaaataacagatgctggagaggttgtggagaaaaggaaatgcttctrcactgctagtgggaatgtaaattagtgcagccattacggaaagcagtttggtgatttctcaaagaacttaaacttagacctaccatctgacccaccaatctcattattgggtattatactcaaaggaacgtatatcattctaccataaagacacatgcatgcatatgttcattgcagcactattcacaatagcaaagacatggaatcaacttacatgcccatcagtgttagactggataaagaaaatttggtacacatataccatggaatactatgcagccataaaaaatatgagattat

SEQ ID NO: 144905 - DNA, 601 bp, Human
aaattagtgcagccattacggaaagcagtttggtgatttctcaaagaacttaaacttagacctaccatctgacccaccaatctcattattgggtattatactcaaaggaacgtatatcattctaccataaagacacatgcatgcatatgttcattgcagcactattcacaatagcaaagacatggaatcaacttacatgcccatcagtgttagactggataaagaaaatttggtacacatataccatggaatactatgcagccataaaaaatatgagattatgtcctttgaagaaacatgratggagctggaagccattatcctaagcagactaactcaggaatagaaaatcaaatactgcgtattttcaattataagtgggagctaaatattgagtacacagggatgcaaagaaaggaacaacagacactggggcctacttgagggttgggggtgggagaagggtgaggatcaaaacactacttattgggtactatgcttatcacctggtgatgaaataatctgtacgacaaacccctgtatatctaacagacctgcacatgtatccctgaacctaaaagtttttttaaaagctgacttt

SEQ ID NO: 144906 - DNA, 601 bp, Human
aatttatagaagactagcccatagaatcataagatatttgaaactaaataagttgtaacacatttcaacactattatcctatgattgcaggctgttttgctcacaggagagcagggaactgcaaaaactgtcatggttaaggcctatttgaaaaaatatgatcctgaagtacagctatccaaaagtctaaacttttcatctgccacagaaccaatgatgtttcaggtgaaatccatcatttgctgtaatattataaacataatacattttaaattagtggttacaataaaatgtgtacgcrtataaaatgtgaaaatattatatattcaaaagaaatcatgctgcacttggcattcagctgtttagctttcctaaggctaaggttgaaggcaaatccaaatagcatactttgacctaatattgagactgcagctgaactttggagcatatctactgtaatgtaaatgaaggataaaactccaatgccttatttttaaaaatttaacaacatatattttaataattatatgtatacttattaaatgcgtaagtaaattatattctactctgacaagaatgctcattatttttagaagtatgg

SEQ ID NO: 144907 - DNA, 601 bp, Human
tttagctttcctaaggctaaggttgaaggcaaatccaaatagcatactttgacctaatattgagactgcagctgaactttggagcatatctactgtaatgtaaatgaaggataaaactccaatgccttatttttaaaaatttaacaacatatattttaataattatatgtatacttattaaatgcgtaagtaaattatattctactctgacaagaatgctcattatttttagaagtatggattaaaatctaatgcataagacaaaacgtttccttctctctagagaacaattgaaagctaygtggataagcgaattggaagcacatatgggccaccaggagggagaaaaatgactgtatttattgatgatattaatatgcctgtgattaatgagtggggagatcaggtatggctgaaatatctcatatagatgatcctgaatttgtatttttatgtatatatattatatatatgtaaatgttaataactttgttaaaaactttatgtttttaagtctactgccaatcctcagtctttttctgacttctctgttatagctgagtttctcctttcttaaatccctatgtgtttttttgttttt

SEQ ID NO: 144908 - DNA, 601 bp, Human
cttcagtgtcctttcttagctcctctcttctgcctttctgcagggttacatccttgctctaacctcttattgtgcataatttctgaggagtacgtgatgttcaaaaaaacaaaaacaaaaaatgaaaaaccaaacaactatttatttatttatttaactgtgccacacaccgtggttctagttgtggtcatctatccacccaggtcattccccattagaagacttcaccggtgttgccagaagtccgcatgctcctggtgggatccccaacactttcctcccaccgacctacactgcttcrttgacaccatctactttggctctaccaggacaagtcccattttgctctttatccctattcgcctcagacaccactagaagctcagtactcatcctgtggcgaaaaaccaaacagttctgtatggcctgcgtctgctccaaggcagatagacctcagcagttcctggaaggagaggagggtgaaggcatgtttagatcaggttcatgcttatcttccataagctgaagcgctcctgaattccgaactcacgtatccaactagggatgtctggttggatcgcaaacttaacacctccaacac

SEQ ID NO: 144909 - DNA, 601 bp, Human
tcaaaaaaacaaaaacaaaaaatgaaaaaccaaacaactatttatttatttatttaactgtgccacacaccgtggttctagttgtggtcatctatccacccaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactcatcctgtggygaaaaaccaaacagttctgtatggcctgcgtctgctccaaggcagatagacctcagcagttcctggaaggagaggagggtgaaggcatgtttagatcaggttcatgcttatcttccataagctgaagcgctcctgaattccgaactcacgtatccaactagggatgtctggttggatcgcaaacttaacacctccaacacctgctcctccaacagtcttctctctctcagcaaatagcacctccacagtcactctgtcagaaaatcaagttggctctatcttcacactgtatctgaaatt

SEQ ID NO: 144910 - DNA, 601 bp, Human
gtccgcatgctcctggtgggatccccaacactttcctcccaccgacctacactgcttcattgacaccatctactttggctctaccaggacaagtcccattttgctctttatccctattcgcctcagacaccactagaagctcagtactcatcctgtggcgaaaaaccaaacagttctgtatggcctgcgtctgctccaaggcagatagacctcagcagttcctggaaggagaggagggtgaaggcatgtttagatcaggttcatgcttatcttccataagctgaagcgctcctgaattccraactcacgtatccaactagggatgtctggttggatcgcaaacttaacacctccaacacctgctcctccaacagtcttctctctctcagcaaatagcacctccacagtcactctgtcagaaaatcaagttggctctatcttcacactgtatctgaaatttgaccactactcatcacctccactgctaccacctggcgccacccaccaccagctctcttcttgatcattacaaatgcctcctcactgcctcctgtctcccttacccttctcagcttgttctcacatcatcaacaaatgaaaa

SEQ ID NO: 144911 - DNA, 601 bp, Human
actctgtcagaaaatcaagttggctctatcttcacactgtatctgaaatttgaccactactcatcacctccactgctaccacctggcgccacccaccaccagctctcttcttgatcattacaaatgcctcctcactgcctcctgtctcccttacccttctcagcttgttctcacatcatcaacaaatgaaaacaagagttagatcacgacacactcttctggtcaacatcctccaaagagacttgtagaatataaataccaaaatccttaccatgatccaagactctacacattttgacckcctctccctcttcccgtgactctttgcttccaccacatttactgatctttgtatacgctggatatggtgttcactcagtacctctgcatttgcagtttcctctgcctagagtgctcttcccctaggtatcgaactggcttactttctcaccttcttcaggtcttggcttatatatcatgtcaggtgaagcctcccctgctctccttgagtcacacccttgagcccctcctatattctacaaaagtcttagagtataccattttatttacatatcaacatgcatctgtacatcttgtctct

SEQ ID NO: 144912 - DNA, 601 bp, Human
ctgaaaagctttgcccttgcagctgtcttccatcagtttcttttggtatttggatgtttcctggctccatttcctcagtgtcttttctttacctctttaatccattctgcacaagctttcattcccactgttcatgtcaaggccaccaaagaccttgatcttgccacatctcaaggttaattttcctctccctcttacttgactttttagcagcatttgacctaaatgatcctttagcagcatttgacctaaatgatccctctaaatattttcttcacttggcttcagagggtccccataktcttgattttcttcctagtgcactggctacctcattaaagtcccccttcttctttccctcctctaaacactgaaatgcacctggtctcgatgccaggccctcttctctatctacattctttccctaggtggcctcatcaagcttcaaggctctaaacatcatccctgtgctgatgacttcaaaatggatatctccatcccaggcctctctacctggctccaggccgattgctaactacttaatagacatcagtgtttgatgtctgatactcatctcaaagttaccatgtccaaacagaac

SEQ ID NO: 144913 - DNA, 601 bp, Human
atttgctgtggggcttgtgaagcattgatggcatctctcacctgcccactgtcttaaaaaaatgctctgccgatttattccagtatgacttcaacaatacatctttataaatcaccagatcatcagaggtgataacattcggaggcacattttcattgtatatattttctacaaattttgtgagctctttgtaggttttctgtggggaaatctggtttcatccctttaaagttaaacaatcccattaaagttaaattcagtcatcttttggagcctccattccctcatctataaatcataratgataatgccagtttcacaaagttgtaaagtgtctaccatgtctcacacaagggtgatacttgtcaaatgttactcccctttgtcctctcttccctctgttatattgtcaatctgaaaaggtcctttgtgtactgaatccaccaacccagaaagaggacgctcgtccactaccgaccatcacttctgctctcctatcgcaagttttagggacctttgatctcacctaagtgattcatctgtgttttctataagtagtgctgttaatgttataactttcttggatggggttatgcccttc

SEQ ID NO: 144914 - DNA, 601 bp, Human
aaaaaaacaaaaaagagagagagagagttcagtaagatgaccaagcattatataaatgtgaaataactatcctctatacctataccaagggttggcaaattatagtttctgggccagatccagccagcccactgcctgtttttattagacttactagctaagaaggatatttatttgtttatttatttatttattttgagatggagtctctctctgtcaccccaggctggagcacagtggcacgatctcggctcactgcaacctccgcctcccagttcaagcaattctcctgcctcagccycccgagtagctgggattacaggtgccccccaccatgcctggctaattttttgtatttttagtagagacgaggtttcaccgtgttggtcctgtgattacaggtgctcgctaccatgcctggctaattttttgtatttttagtagagatgaggttttatcatgttggtcaggctggttttgaacttctgacctcaagtgatccacccatctcggcctcccaaattctggagtgacaggcgtgagccaccatgcccggctgatttttcatttttaaatagttaccaaaaaataaaaataagca

SEQ ID NO: 144915 - DNA, 601 bp, Human
aatacctttgctcagttattgatttgccttttcattctcttagcggatcttaattttaatgaaacattcatttttttctatttagtccttttttgtattatattttaaaatctttgtttaccctaagggcacatagatattttcctatgattttcttcacatttacacataaaatttactactttctcatttagtactataactgacctagaattcattttcttataatgtctgacataggagttgtgattattattttcaatattgatatccagttgatccagctccatttattaaaaargtcatcttttccctgccacatcacagtgccattttttgtcttaagtcatctgatcatatatgtgactatatagtctcctccactggtttccttatctatctttgtatcattacctactatattaattgctgtagcttctttagtatatatatttaaatttaacatatgtatatttggtagtgtcagatctctaactttgttgttcttcaaaacgtcttgtccatttggccttttatttccgtataaaatttagatcactttgccaatttataaacaaacacacaaatcattctgctgcca

SEQ ID NO: 144916 - DNA, 601 bp, Human
ctaagctgtaagctccctgagaatgggccactgtaatctttgtcttttttacttttattattaaatgcttacttttaaccaattctgtaaaaggatgtgttgaataaataaaaaaatgaccagctttgaagggtaaagtgagaatttagttcagtacatttgagtctgaggtgtctgcagaacacagtgtccatagataataagactcatggatgtggagttcaggagaggggttctggttctggagatagcaatatagaagtctcagtagagaggaaccttttgtggtcatggggagtaygaatagggtgcgtcatggaaagaaaagatggctgtggaaagaattctggggtctcccaacatagagaaagggggcttgcgatggagagtgagaagaagaggcaagacagagaggaggaaatccagagtggtttccagaaactaagcaggtagataattaatctgaaaatgctggccgggcgccctggctcacgcctgtaatcccagcactttgggaggccgaggtgggcggatcacctgaggtgaggagttcgagactggctggccaacatggtgaaaccccatctgtactaaaaataca

SEQ ID NO: 144917 - DNA, 601 bp, Human
atatgcatgacgacactttcagtgaagtggatgggtgcacaagccacattgcattaggaagagaagaagcacagagaatacttttggaaaacttgaaagaaagaaacaagagaggtcaggatctggacaaggggtgtgttgtgactgtctctatgtattgcaaaagcaatacatcacagtcagtctaattctttaaaaaatcagccaaattgacctctttggctgattagttcagagactggccagtcagtgagaggattactctgacagcatcaggccactagatctttctggttccagkgctcatagtctttctgtgagaccccatggcctactgcccattacttgcattgtaacacctccttccagtgaggattaccttttagtccttgtcattagcttacccatgaggatttacatacaacatttcagataatgtctgctttatttttacacatctcatcacctctggtagcacatacatttaaccggaaacagagtgaaccaaaaaacaaagaccaagatcttttcattccataatttgtagccatctaacatttctattatttataccttattgcacaatgcatctttttctgtg

SEQ ID NO: 144918 - DNA, 601 bp, Human
ggttttttttgttgttgttgtttgtttgtttatttgttttaagaaggagtctcactctgtcgcccaggctggagtgcagtggcatgatctcggctcactgcaacctctgcctcccgggttcaagcgattctcctgcctcagcctcccaagtagctgggattataggcacacaccacacacttggcttttttttttgtatttttttagtagagatggggtttcaccatgttggtcaggatggtctcgatctcctgacctcgtgatccacccgccttggcctcccaaagtgctgggattacargtgtgagccaccgcgcccagccgactatatattttttaatctaaaactttctatcatttttcttcttaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggaggtaagtctcaaaagtagagaaaaagcccatattgtaaaaatataaattatattggaatagaaaaagcagcaaccttt

SEQ ID NO: 144919 - DNA, 601 bp, Human
gctgatggaaaaggcatcactttcatctttactgacagtgaaataaaagatgaggcatttctagaataccttaacaacttgctatcttcaggggaggtaagtctcaaaagtagagaaaaagcccatattgtaaaaatataaattatattggaatagaaaaagcagcaacctttcaaaaatgaggctatttagtacattttttattttagacatggttaatgtacgagatttagcagattttctgaagttcctgtgaaatgaatgctgcccatctccagatgctttgtttaattttgaacayggttccttacttgtctcttcagtcttcactttggtcttataatttattttaggagaagcaaagtatctgtccatctatctgcatactagtgaggagtatagaatggttgaaagagttctgttagttgtaaatggatgtctgtactgccacttctgaaaccgcttgtatcagcacttccgtgagcactcacatctttagtacttcatcagaaagactcaccagactcagcatatacaggtcgagcttctcaaatccaaaactctggaatccaaaatgctccaaaatctgaaactttttgag

SEQ ID NO: 144920 - DNA, 601 bp, Human
actcagcatatacaggtcgagcttctcaaatccaaaactctggaatccaaaatgctccaaaatctgaaactttttgagcacggacatgatgctcaaaggacatgctcattattggagcattttagatttcagattttttgatttgggggtgctcaaccagtaagtgaaatgcaaacattccaaaatctgaaaaaaatctgaaatctgaaacattgtggtcccaagcattttgaataagggatgttcaacttatagttatactcatggctgagatttattgtggcaacacagtaaggatacrgagccagatcagtagagaaaaagactcatcttgtggagtcatcgatgttccaggaacatggaattgatgttccagcttcctatgcttttgccaaggggccatgcagaacgtcctctccatccagtatgaagggcagtaacatatgcactgtttccattcagggaagcccacttgagattcagagtccagtggtttttttttaggtttggtcacttcctgcctagctacaactaccaaagttccagattcctagaaggaaagcagatagatgtttgccatgtatcacaaggtttgtgtaaa

SEQ ID NO: 144921 - DNA, 601 bp, Human
ctgcaaaacaaccttatcaattactaatggaggagacattccaaaagccaagttccctgataacagacaagggtcagctctgcaagcatacccttttcaagattaggcctgctgtgttaactcttccctacaccatggtatacagatgcttaatggtgcaaaaattagttaagtattttggagccagagttgattagactgactctgagtcaaagtacagagggcacccctggacattttaaagagatgattgagtggtggtggagatagctttttggtgatagctattggagcacaggaraacacaattagttcttgattgagctgctcaataaaaagttgcagtcttgatcatctctggcaaatcagggatttgactgtggagatgctgaaagaaaatatgaaacaagatgacatgcaaattaaaaaagggactggactttggcagtgaattgactgtggagaactcttaaaacacagaacacttccttgtccattccttaaagatctccaacttgtttgcacgagatgagatggatgaaatcacccaaggtctgatttcagtgatgaagagggagctacctcgccatcctcctacctt

SEQ ID NO: 144922 - DNA, 601 bp, Human
ttcatattattaaaaaatactgcataacctgcaattttcattaattacctagagacatgggttgtttgaattgtaagggacttggtgatgtaacctcgtccagctccacctcccatgtagacatattagctttactataatgtctctgatgtaggtttgaaaatctctatctcattgtgcttcccaatatagtagccattaggcatatatggctacttaagttttgattaattagcctcatttctacttactatttggtttatttttggtacagggtcttgctctgttgcctaggctgaartgcagtggcatgatcatggctcactgcagcatcaacctcccaggctcaagccatcctctcaccttagactcccaagtagctgagactacaagcatgtgccaccatgcccagttaatttttgtattttttgtagagacaaggttttgccatgttgtccaggctggtctggaactcctgaactcaagcgattcacctgcctgggcctcgcaaagtgctgggattacaggcatgagctaccgtgcctggcttagctccattcctggtgcttagtagtcatgtgtggctaatagctaccacact

SEQ ID NO: 144923 - DNA, 601 bp, Human
ggtgcttagtagtcatgtgtggctaatagctaccacactggaaagcatatatataaagcatttttattatcacttaaagttctattgacagctctgctctagggagtctcactaatttataaggcagcctgcttcattcttggatagtctaattgccaaaaagctcttatttataatcaatagaattttgtctctgtacttttctgattctaactctgccctatacaaggaactcaatccctcttccgtgtaaagtttttcagatatttggagaaggtttttgcaaggctgtctaagttgwttcctttttagaccaaacaactgttcctgcagctgttctcacttgtcccagtgtccaggccttttgctgtcctggccctctctctaaaagagtactagtttatcagtttcctcttaaaagaaagttcctagaattgaacgcaataatgtagatgtagtcccaggacagggaagagtgtggagtatatttcctcccttcatcacaacattaaatttatatatgactgcagcccaagaagattcattttcaaatctgtgatgtcacactcttgggtcagattgcgtaaatctctctctggct

SEQ ID NO: 144924 - DNA, 601 bp, Human
gtcactgtgtaagattgacaaatgggccaacgtggatccccagaaaagctatgcctgtttttctgcatagagagtttgcgtaacactttcattgattttcagtgaggttcctacttcacaaaagtttatttattccataccttttcctttacttaaaaccattcccagaccacccttttagataagatctcccaaattctcttggtgaatcagtgtatactaattcttactgttaagaagattttctttctatttgaacgcctgctaatgtcatccatggagataaatttttacctttgtrcagctacaaaaatctgtttctttactttgaaaatttgggtatatttttcaaaattttttatatgttcttaggttgttgaagtttattctgaatgtaatatttttacaacactttaatgatagtcacatatatgcccaagatcttaaaaaaaactcaaaagcattaaaaatcttcaaaactacaaaagtttaaattaatataaaaggttaaataattttatagtacgtgaagaactcttttttcacttgagcttcttctgtataaaattatgccttttgtaataaagccacaataaagtgg

SEQ ID NO: 144925 - DNA, 601 bp, Human
ttactgttaagaagattttctttctatttgaacgcctgctaatgtcatccatggagataaatttttacctttgtgcagctacaaaaatctgtttctttactttgaaaatttgggtatatttttcaaaattttttatatgttcttaggttgttgaagtttattctgaatgtaatatttttacaacactttaatgatagtcacatatatgcccaagatcttaaaaaaaactcaaaagcattaaaaatcttcaaaactacaaaagtttaaattaatataaaaggttaaataattttatagtacrtgaagaactcttttttcacttgagcttcttctgtataaaattatgccttttgtaataaagccacaataaagtggacatttgaatcgagtgtggttgccttgatttcaaggccaatccagtgaacttgggagacattggtttttgcttctgtaaacccacccagctggtatccagcagtgaagaggttgtaacaaatatcacttgaatgaaaatggatcacagcacaaattcatttcaaccacttatccctaatatttgtccagaaccttaaagttttgcactgttgacaccagctttcac

SEQ ID NO: 144926 - DNA, 601 bp, Human
acatttttgtttaacttataccagcatatacctgaactattaattttgctacttggcctaagactattatttcttctctcactctgtctgtctctcttgttctttttcatctgtttatgaaatttctgcttgactatgagttatatttggtcttctgtttaaggtccctgtatgttccaggtttctgggatggcccaaatcgaggaagagttggtagagtttttttttttaaaagaaagaaagaggaaaaatccatactcctctcaaggagataggtatatatgtgtgctgctttttctcytttttttttttttttttttttttttgagacagagtcttgctctgttgcccaggctggagtgcagtggcgtgatctcggctcactgcaacctccacctcctgggttcaagcgattctcctgcctaatttttgtatttttagtagagacggggtttcaccatgttggccaggatggtctcaatctcttgactttgtgatccgcctgcctcggcctcccaaagtgctgggattacaggcatgagccatggtgcccggcctatgtgctgcttttttatctattatacagccttctagtctcaga

SEQ ID NO: 144927 - DNA, 601 bp, Human
acacacatacatacacatatatgtgcatgtatatatatgtggatatatacacacatatatacacacgtgtatatacttacacactgctaatacacacacatataagtatgtatgtacatatagatgatctggagtaaatttgcttaactttcttgggtttctatggggattataatttctcattgatccttaaagaatcaatgtgagcattaaaattaattaatacaaaatgctaggcacatagaaagcactcaataaatattagtgcttctgttcctgctgatgacctggctcctgtctrtctcttcaactttatctcttgtcattttgtccctacacacaatgcgatccagtcatacagaaaaatgtataggattctggaagaatggtcaggatctgttacctttaaacgtgcctccacctctgctgggaatgcttttcctaactttcattgcctaattagagtcattctttaaatctgggcccagacctcactcctcccaggaagttttcagttcttcttcgaggccttcctttgttttcctatcactcacatgcttctgtcatggcagaaatccttatgtagggtaattgtatttgc

SEQ ID NO: 144928 - DNA, 601 bp, Human
atagagccaataaaaataacattaaaaattagagaaaagcagcagaattaatgagcaaatctaagaacctatgctttgcaaaaacaaaactgtaagaaatattcctggaaaatctaatcaagaagaaaatgaaaacaaatgaaaatagaaagataaatcctcataattctagatgtgaagatttaaataattataaagtaattgttttttaagagacagggtttcattctggcccccaggctggagtgcagtggtgcaatcatagcttactgcagccttgaattcctgggcttaagcagtyctcctacctcagcctcccaaactgctcccaggattataggtgtgagccactgtgccaggctgcaaatattacctagttatatgttaatatattagaaaatctaaatgaaataaaagttttatgggaaaaggagctaaattcaaataaacattgagaatgaaaataagaaagggatcaaagaacttctaccccagaaggctttgggcctagattattttactgattattttaaatttacaggaagcagatcattaccacattgtaggacttagaaaaatatgaaaaactactgttacagta

SEQ ID NO: 144929 - DNA, 601 bp, Human
ttcttacttactgagaaacccggctgggtgtggtggctcacatctgtaatcccagcactttgggaggctgaggagggcagatcatgaggtcaggagttcaagaccagcctaaccaacatggtgaaatccccatctctactaaaaatacaaaagttagccgggcatgatggtgcatgcctgtaatcctagctactcaggaggctgaggcaggagaatcgcttcaaccagggaggcaatggttccgagatcacgccactccactccagactgggcaacaagagagaaactccatcccccccccaaaaaaaagaaacccaggttcattgaattttttctttaactgggaagattgttttgaaagtgcttaagagtttttttaaaaataattttctttatggtataaatgtttctttgcgttttaagtaatcttgcttccaaattaagaccaattgcattgctatgaactgaaagatcatttgagagatatcagcttgctaatactgggcccttcttataactcttcattatttacaccactcctgtgaagtcatactctctttcaaacattttaggcaaatgtaggcatgatctgtgctggtat

SEQ ID NO: 144930 - DNA, 601 bp, Human
gggaagattgttttgaaagtgcttaagagtttttttaaaaataattttctttatggtataaatgtttctttgcgttttaagtaatcttgcttccaaattaagaccaattgcattgctatgaactgaaagatcatttgagagatatcagcttgctaatactgggcccttcttataactcttcattatttacaccactcctgtgaagtcatactctctttcaaacattttaggcaaatgtaggcatgatctgtgctggtattaaccttattttcattatttgctatcttttttagtgtctaawaacgtaacagaatagcatgttctggtgaccctaagtaatagcaagtcctttcatactaaccttccttgctgggaattcgatgccactgtcaatttccggtatatcttgcagagcttctgttgtaataaatgctttccaggcaatttgtattcatgagttgcttttctggtttgcaaatctgctctccagttgctgtttccttaggggatgccaagctattaatttcatattatctgtatttaaaagttaaaaactaatcttttccaattcgaacattgttgaattcacccttacagggaa

SEQ ID NO: 144931 - DNA, 601 bp, Human
gctattaatttcatattatctgtatttaaaagttaaaaactaatcttttccaattcgaacattgttgaattcacccttacagggaatagattatgtcttggagatgcactgggcactggtgaagcaaagtgggccagaatattctttattaattatggcctttgggggtcctgggataatttaacaaaggtggaggctggttggctcattggatctctgattattttattttattttattttattttattttattttattttattttattttttttagagacaaagtcttgctctgtagcycagacggaagtgcagtgctgtgatcatggctcacagcagcctcaaattcctgggctcaagtgaccctcccagactcccaaaatgctgggattataggcatgaaccactgcgcctggcccggtgattttattgatcacatggtgggaggctggcaatcccctctaaatttggagaaggaaatattcacaaaagtgtcattgatgagctccggccaatataataactcatctaatttatctccagctatgcaatcacccatacaccatgtgggcagaaccaaagggccggaaggggaagcta

SEQ ID NO: 144932 - DNA, 601 bp, Human
gggcctataggaaagtggcaaatagaacattgtgatccctcagttcaagaccattcatgccaaccttgctcaggctcttggtactacgtagcttactgagtccagctttggtgcttgcatctaataaggtgttaattttaaggtgagagtagacaagggcaggattccaacattcctgactcccttagggattctgttactattgatattttaattcaactaccaatgtgggatattcagtgtttcctagacactgttcccagtgctctaaacccccgtccccatgtttttgcttatactrtttctactaaccaaaatgtctttctctacctccacttatatcctagataaaaatctcagatattcttcaaagtccacatccaccactacctccatcaagacttttctgtgtccccagctcaatataacctgtcctgaatcctcacaatgtcttgtttgcactcatgttgtggacttagaatctgacttaaattattgttctttgcacatttatcttttatttctattgtaccatgaactcctttttggccaagttttattcatctttacatgttctgcactgctctttttgagtaggaat

SEQ ID NO: 144933 - DNA, 601 bp, Human
gccataacaaacatcctatttagtggtgaaatgttgaaagatttcctcctgagatcagtgcttctcatccaagtggatatagcccagtgctcggaagcacacctaaataccccacctcatcaatactccagaacacgatacatcagtctatgtttactaagaaaacccagggaaatcctagaatggaccaggcaatgtaaatagaagagaagagttaaaagaaatagtgtccatttccacgaagcttcttaggagccacattttcaggggtgcacaaatgtggtataccagaacacttctrttcttagtttctgcagccaggtcaactataacttgtccctggccccattccccttggctcccctggctttcaatctccctgctcatcttattcttggaaccttgcctggacatccttagctcaatgcatgctcctgtatcacttggacatgaatgctgctattttttctgatcttagctttatctctccatttctggattaaatttactgatagtcttcactgaagtcctttctgatgcaacccagtcccaggaaccttcttgtggaaggaatagaaatatgcccgaaactcttccttat

SEQ ID NO: 144934 - DNA, 601 bp, Human
catcaaatttccacagtaggaaacaattttcttaactggagaaaaaatagcggctcctgtactacaaacaattgatgggagtgataagtacttgctaaaatgttaaagtcaaatcttagatatgtctaagttttcctttattcaccgtttgttttggataactttttcatttgatttgcttggtatcattgctaaaaacatcaccaggcaggactacaattctaaattattctaaattgaataggctttattatttaagatcagtgattaaaattttgtaactttccttcccaatttattsaagcgtcacagcactgacaggtaaattcttttctaaattgaacccaagttcctttccctgccctttaagctgtttttaattttatatgtgaatttatgtaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggtaatctctctctcaa

SEQ ID NO: 144935 - DNA, 601 bp, Human
ttcactgttacaatgaaaggacttgagaatcagttactaaggagagtcattctaacagagaaacaggtaatctctctctcaaggtaaagaatttctgcttataatacatgcttaaaatgtattgagaaattgctaagtatgtgaaaaagaaaaaaaaatttaaaaaccatatttatccttgttaacataagtatttcttttgcagccttaattcctgtcaagaaatcatgtaactcatcttctcatccagcctgaaacacacacacacacacacacacacacacacacacacacacacacacccgtctctttctacttctgtctttaaacttctaggtgtactgactctcttatgtatagtccttgtcttggggacacctgaaaacatcaataaaacaatgattgagagaaaaagaaattcctctgaatggctcttctttccactgtagtagtttcaactactacagtccaataatctaatgatatagggagccatacctttatttttaattaaattttcctgcactaaagcagggaaattatgtctaactgagggttctaataaaacaaagaacaacttaggactggaagattttaagag

SEQ ID NO: 144936 - DNA, 601 bp, Human
actgttacaatgaaaggacttgagaatcagttactaaggagagtcattctaacagagaaacaggtaatctctctctcaaggtaaagaatttctgcttataatacatgcttaaaatgtattgagaaattgctaagtatgtgaaaaagaaaaaaaaatttaaaaaccatatttatccttgttaacataagtatttcttttgcagccttaattcctgtcaagaaatcatgtaactcatcttctcatccagcctgaaacacacacacacacacacacacacacacacacacacacacacacacccgtctctttctacttctgtctttaaacttctaggtgtactgactctcttatgtatagtccttgtcttggggacacctgaaaacatcaataaaacaatgattgagagaaaaagaaattcctctgaatggctcttctttccactgtagtagtttcaactactacagtccaataatctaatgatatagggagccatacctttatttttaattaaattttcctgcactaaagcagggaaattatgtctaactgagggttctaataaaacaaagaacaacttaggactggaagattttaagagact

SEQ ID NO: 144937 - DNA, 601 bp, Human
gttagtcccttgtggtctaattggtgctgtgggtttattttgagatgattcctcgctggtctagatcccccatgcaggctgcactaacctccagaagtcaagcaactccactgtctaaaggtccccagggctccccacacccactcttcttattccctagcttcctcttcaagagatgtgctaagatgctcatagcaaccttgctggagaaaaaaatgcacatttaatatgcaggagggtattctaaacattatatttaaccctcctaacaatcctactattatacccatatttttacagrtgagcaaatggagaccaaagaaaataagggtctcggtctataacagcacatggactttgcagcctgccaagcctcctagataaggtttacaggtcctgctatgaagtttagcaagagtccactgtgctatgatatctgtttttccatatccagaaaaggaagctaatatgatttcattttgtccatgtattcctatactgccacccaggggtgaccattttaatgaaaatgactaactggttatttccctgcaaatacagcaatgctctttatcgccccatcaactcctgccaccctgta

SEQ ID NO: 144938 - DNA, 601 bp, Human
ttctaaacattatatttaaccctcctaacaatcctactattatacccatatttttacagatgagcaaatggagaccaaagaaaataagggtctcggtctataacagcacatggactttgcagcctgccaagcctcctagataaggtttacaggtcctgctatgaagtttagcaagagtccactgtgctatgatatctgtttttccatatccagaaaaggaagctaatatgatttcattttgtccatgtattcctatactgccacccaggggtgaccattttaatgaaaatgactaactggktatttccctgcaaatacagcaatgctctttatcgccccatcaactcctgccaccctgtaagtacaatggcaataacactagtcttggagttggaggacaagggtattaggctgttttaacacacagctagttactggcagagaccggcctaatacccttgttattcagagttcatatttctgggtccttggcttttccaaatgtaaaataaagaaattggactaaattcagcacatttcagtttgacaaatatttattgggttgagtttcttctttacaaagccacaagataagtactgt

SEQ ID NO: 144939 - DNA, 601 bp, Human
gttactggcagagaccggcctaatacccttgttattcagagttcatatttctgggtccttggcttttccaaatgtaaaataaagaaattggactaaattcagcacatttcagtttgacaaatatttattgggttgagtttcttctttacaaagccacaagataagtactgtcaataatacaaaaatgaataggaaagcttatgtatctgttttctagatgcataaaccgtagttggagggaaataatctactgatagattgtgatacaaactatattagaggccaggcgtggtggctcacycctgtattcctagcactttggaaggttgaggcaggtggattacctgaggtcaagagtttgagaccagcctggccaacacggtgaaaccccgtctctactaaaaatacaaaaattagccaggcgtggtggtgcacgcctgtagtcccagctactcgggagtctgaggcaggagaattgcttgaacctgggcggcagaggttgcagtgagccgagatcacaccactgtatcctagcctgggtgtcagagggagactccatctcaaaaaaacaaaacaaaacaaaacaaaaaacacgcacaga

SEQ ID NO: 144940 - DNA, 601 bp, Human
aggcgtggtggtgcacgcctgtagtcccagctactcgggagtctgaggcaggagaattgcttgaacctgggcggcagaggttgcagtgagccgagatcacaccactgtatcctagcctgggtgtcagagggagactccatctcaaaaaaacaaaacaaaacaaaacaaaaaacacgcacagaaaaaaatcacaaaaaaacaaaaaacaaaacaaactacattagatgtacagatgaaggctgtgccatggcttttgattgactggttcaggaagactttttgaaaatgatgaaatttctgmagcaattttcccagaaaccttcccaaataagttttaaaacaccttcttttaacgtaattctaagtgcagcatgtgattctgtataaaatcagaagaaaaatgttgtaaggaatattattgagattattgagatttcaatgtagactctgtgtttagtgagagtatcagtgatactgacacatcagtatcagtgttaaatttcctgaatttgaatattgggctacacttatgtaaaagaatgacctggttcttcagagatttgctaaagtgtttaggggtaaaaggacatgacatccacga

SEQ ID NO: 144941 - DNA, 601 bp, Human
aaaatcacaaaaaaacaaaaaacaaaacaaactacattagatgtacagatgaaggctgtgccatggcttttgattgactggttcaggaagactttttgaaaatgatgaaatttctgaagcaattttcccagaaaccttcccaaataagttttaaaacaccttcttttaacgtaattctaagtgcagcatgtgattctgtataaaatcagaagaaaaatgttgtaaggaatattattgagattattgagatttcaatgtagactctgtgtttagtgagagtatcagtgatactgacacatcrgtatcagtgttaaatttcctgaatttgaatattgggctacacttatgtaaaagaatgacctggttcttcagagatttgctaaagtgtttaggggtaaaaggacatgacatccacgagtgattcagcagtaataataatgataacaacaataacaataatgacaacattatgtattctatagagatatagtgataaagcaaaatgtgatttggtgaatctaagtgaaggctatatgaaagttccttgtattaggcttgcaactttttgaatgcttgaaattttttcaaaatataattttaa

SEQ ID NO: 144942 - DNA, 601 bp, Human
agactctgtgtttagtgagagtatcagtgatactgacacatcagtatcagtgttaaatttcctgaatttgaatattgggctacacttatgtaaaagaatgacctggttcttcagagatttgctaaagtgtttaggggtaaaaggacatgacatccacgagtgattcagcagtaataataatgataacaacaataacaataatgacaacattatgtattctatagagatatagtgataaagcaaaatgtgatttggtgaatctaagtgaaggctatatgaaagttccttgtattaggcttgyaactttttgaatgcttgaaattttttcaaaatataattttaaaaatatatcattttatgtaagaagaaaaaaactcctgtaaacattcaagtttgccctctgtagaaggagatacaaataaaatggaaaatgggtttgtattggcaatcggctgtgccaaaccaggtacctggtgctcccataggaaccaggccaagagctcacatttaatctgggtagccccttggtttcttggtattattgcctttttgtttctacttgttctgactgcaaataaagatagcatttcttacagaagca

SEQ ID NO: 144943 - DNA, 601 bp, Human
aaaaaaactcctgtaaacattcaagtttgccctctgtagaaggagatacaaataaaatggaaaatgggtttgtattggcaatcggctgtgccaaaccaggtacctggtgctcccataggaaccaggccaagagctcacatttaatctgggtagccccttggtttcttggtattattgcctttttgtttctacttgttctgactgcaaataaagatagcatttcttacagaagcagtgtgggaacagggccaagagaatgggacatgctatttataaacttaaagctggcaagagagcttgrggtaattgggcaaaattatttagcagaattgtctggtgcctgccagtataagtgctgtggaaccttaatgacagtaggcataattttaaaaaaatttccacagaaacaaaaatatggatagatagatttggctaatgatagtaatttcttctgccattcaaaaggtactttgctttaaacttttaaaattgttaataaacactagtgagttgggtttactgtaataactggtaattatagttccaatgttattttttgttttttaatgacaggagttagaggctgagagggttaaacttt

SEQ ID NO: 144944 - DNA, 601 bp, Human
tttcaaattgactctttcatttggcattgaaatgcagttactgcaacgggttatgacacatgtaatccatgtcagaagagcttgggtaccaaaggcccagcttaccctctacttggcttgacctcccactttagatgggaaagacaggttctcctctgggcagccaaatcatcatgccacacctcaatttgaggatgtactctctctgcaatatataaaaagaaaattttatccaaagaaaataaaatcaacaaacatattgttctgtagcagacaaatcacagaaacctgaattctactwccttattagaagtgaatgaatacttcacaactgcaccttaatcccgggatgttatttaaacaagtctgaccttccagaagtactgtacctttatggtgagcttagtgaaaagtccttttatctgcctactcgcactgctcccgctagtgaagttgtctgtttcttggtccagtgactcctcccagccatttgggatacccctgggcattaaaaatatagcaagcagagctgagggctgctcccctagtctagccaagagtgtgctggatcaagacctctctccttgaggttaatcccaat

SEQ ID NO: 144945 - DNA, 601 bp, Human
cagttactgcaacgggttatgacacatgtaatccatgtcagaagagcttgggtaccaaaggcccagcttaccctctacttggcttgacctcccactttagatgggaaagacaggttctcctctgggcagccaaatcatcatgccacacctcaatttgaggatgtactctctctgcaatatataaaaagaaaattttatccaaagaaaataaaatcaacaaacatattgttctgtagcagacaaatcacagaaacctgaattctactaccttattagaagtgaatgaatacttcacaactgyaccttaatcccgggatgttatttaaacaagtctgaccttccagaagtactgtacctttatggtgagcttagtgaaaagtccttttatctgcctactcgcactgctcccgctagtgaagttgtctgtttcttggtccagtgactcctcccagccatttgggatacccctgggcattaaaaatatagcaagcagagctgagggctgctcccctagtctagccaagagtgtgctggatcaagacctctctccttgaggttaatcccaatttggacttccacagtagacagcatacccgttgga

SEQ ID NO: 144946 - DNA, 601 bp, Human
gaaactggaaaccatcattctcagcaaagtaatatcagaatagaaaaccaaacaccgcatgttctcactcataagtgggagttgaacaataagaacacatggacacagggaggggaacatcacacactggggcctgtcggtgggtaggggtctggggggagggatagcgttaggagaaatacctaatgtaaatgacaagttgatgggtgcagcaaacaaacatggcccatgtatacctatgtaacaaacctgcacgttctgcatgtgtaccccagaacttaaagtataataaaaaaaaaaataatgaaaggcaaaactaaaaataaaattcaagtttctcttcctggtgagacattttcactatacccaatttgctcttgttagagacagagggattagagttttctatagcaacgactgttctactaaagcagtgtgaggagtgtaccattcaactatcagcatgacagtcagcccatgtgtgaagtgttcaggttagctacaccctgagacaagcagcgtggacaagctgtgacactttgaggagagccaccaagatgacagtgggtgtgaagcctatcacatggggaacagcaaagag

SEQ ID NO: 144947 - DNA, 601 bp, Human
tctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccaggtgagtcctcactaccttcatccaaaagtggtgacttaaaagtttgcttgtatttctactcttttagaarttgctttttcactattcacaatagcaaagacatggaatcaacctaaatgcccatcaacagtagagtggataaagaaaaggtggtacatatacaacggggaatactatgcagccataaaaaagaatgaactcatgtcctttgcagaaacatggatgaagctggaggccattatccttagcaaactaacacaggaacggaaaaccaaataccgcatagtctcatttataagtaggaactaaatgatgataccacatggacacatagaggagaacaacagacactgtgacctgtcagagagtg

SEQ ID NO: 144948 - DNA, 601 bp, Human
tacacgagtatttactgagcacatgttatgtaaacccaccacgctagctttggggatgtaagaataaaccagatattgcttgaaaagaaataataacctcagaatggggataaagataatttaaaaataactccaaagtaaggcagaatcacctaagtgctataagagagctaagaaacaagtgttgagtctaaaaggagggaaagattacatgtggttggtgaaatcaaaaagtttcttagaaaatatacctttgtgggttaagccatgaattggggaactatttggtacgtggcaaaaygtttcaatctttttcttgtgtttttggctctttatgtatgatttaaccaattattttctggctccccacaccccataaagaaagtggcatttgaggtggaccctgaagaggtagaaatgaggaaaacattccatgctgaaatggaacagcatgagaaagggaacgagtggagaacatctaagttgtaagaatcagtctggttttgttgaaatgaaaggtggatatggaggcatactgagaaatagagctggacatgtaaactggtgacatactgtggagagcctgggttcctgtaggaag

SEQ ID NO: 144949 - DNA, 601 bp, Human
ggaatatacagggagataagggtgtagagattaaggaagtaaaatggcaaaaccgatgcatacaagagccaagagagcatgcagaaatgagtctatgatttctggcctatgcagagatttctggtctggtggttggaagaggagttggtttgaggagggttggagtgggggattgctggatgtgattttaggacctgtttagtcagaatcagaataggccaggttttgctgccataaaaacaatctcaaaatttcagtgacttaacacaaccaaggtgtacttctcattcatgttacctcyccaacgtgctgttatagtcactcagaaatccacattgcttccataactactatggcagaggggcaaggatgtggcagactgtgcactggctcttaaaagttaccccacaagtgacacatgtcacttacgctcctatttccttagccaaagccagacacacagccacatctcacttcaaaaagagcagggaaatgcagttccccgtgtgtttgaaaggcggggaaacagtttgtgaccagctcttatgactacagacgtgaaatttgagctatccagaaaacaattagaaaagataaccta

SEQ ID NO: 144950 - DNA, 601 bp, Human
agaatcagaataggccaggttttgctgccataaaaacaatctcaaaatttcagtgacttaacacaaccaaggtgtacttctcattcatgttacctctccaacgtgctgttatagtcactcagaaatccacattgcttccataactactatggcagaggggcaaggatgtggcagactgtgcactggctcttaaaagttaccccacaagtgacacatgtcacttacgctcctatttccttagccaaagccagacacacagccacatctcacttcaaaaagagcagggaaatgcagttccccrtgtgtttgaaaggcggggaaacagtttgtgaccagctcttatgactacagacgtgaaatttgagctatccagaaaacaattagaaaagataacctaggccgggcgcggtggctaatgcctgtaatcccagcactttgggaggctgaggcaggcggatcacaaggtcaggagatcgagaccatcctggtcaccggtttaggtgaaaccctgtctctactaaaaatacaaaaattagctgggcgtggtggcacgtgtctgtagtcccagctactcgggaagctgaagcaggagaatcacttg

SEQ ID NO: 144951 - DNA, 601 bp, Human
atccacattgcttccataactactatggcagaggggcaaggatgtggcagactgtgcactggctcttaaaagttaccccacaagtgacacatgtcacttacgctcctatttccttagccaaagccagacacacagccacatctcacttcaaaaagagcagggaaatgcagttccccgtgtgtttgaaaggcggggaaacagtttgtgaccagctcttatgactacagacgtgaaatttgagctatccagaaaacaattagaaaagataacctaggccgggcgcggtggctaatgcctgtartcccagcactttgggaggctgaggcaggcggatcacaaggtcaggagatcgagaccatcctggtcaccggtttaggtgaaaccctgtctctactaaaaatacaaaaattagctgggcgtggtggcacgtgtctgtagtcccagctactcgggaagctgaagcaggagaatcacttgaaccagggagtcggaggttgcagtgagcagagatcatgccactgcactccagcctggtgacagagtgagactctgtctcagaaaaaaaaaaaaggaatctagacagtccaagagaagagtcagg

SEQ ID NO: 144952 - DNA, 601 bp, Human
gtgcactggctcttaaaagttaccccacaagtgacacatgtcacttacgctcctatttccttagccaaagccagacacacagccacatctcacttcaaaaagagcagggaaatgcagttccccgtgtgtttgaaaggcggggaaacagtttgtgaccagctcttatgactacagacgtgaaatttgagctatccagaaaacaattagaaaagataacctaggccgggcgcggtggctaatgcctgtaatcccagcactttgggaggctgaggcaggcggatcacaaggtcaggagatcgasaccatcctggtcaccggtttaggtgaaaccctgtctctactaaaaatacaaaaattagctgggcgtggtggcacgtgtctgtagtcccagctactcgggaagctgaagcaggagaatcacttgaaccagggagtcggaggttgcagtgagcagagatcatgccactgcactccagcctggtgacagagtgagactctgtctcagaaaaaaaaaaaaggaatctagacagtccaagagaagagtcaggcagttacaaagatggggtacagaaataacagccaaagccatgggaatgaaagc

SEQ ID NO: 144953 - DNA, 601 bp, Human
gttgaaatgtatcatgtggttcatatttttttcacaggtctaatgcacttatggaagttggttttttaaggcagtgtggtgtggtacaatgaacactatctagggtggggaggaggcactgcagagagtgtcaagatgtatgaggttttggtcttggggatgcttaagtaaagtaagtgaatttacccaatctggaaacctattttacctcatttcaaaaatctttaagccctcacttggacttgggctgcagccctggtattgtatgatgctgagcaggggggtagggggcattgaagcrtgctgaaatccaggcagcagtggcagcaaaatgacccccacaatctggggaagcctcatatctatgcaccatggtctgaatgtttgtgtcccctcaaacttcatctgttgaaatcttaccccaccccctccaaggtgatggtattagcatgtgaggcctttggaaggtgattaggtcatgagggtagagctctcgtgaatggggttagtgcctttatgaaagaggcctgagggagctcactccccctcccaccatgtcaggacaccatgaaaggagccatctatgcaccaggaaatgggc

SEQ ID NO: 144954 - DNA, 601 bp, Human
gatgcttaagtaaagtaagtgaatttacccaatctggaaacctattttacctcatttcaaaaatctttaagccctcacttggacttgggctgcagccctggtattgtatgatgctgagcaggggggtagggggcattgaagcgtgctgaaatccaggcagcagtggcagcaaaatgacccccacaatctggggaagcctcatatctatgcaccatggtctgaatgtttgtgtcccctcaaacttcatctgttgaaatcttaccccaccccctccaaggtgatggtattagcatgtgaggcytttggaaggtgattaggtcatgagggtagagctctcgtgaatggggttagtgcctttatgaaagaggcctgagggagctcactccccctcccaccatgtcaggacaccatgaaaggagccatctatgcaccaggaaatgggccctcaccagacgttgaattcatcagggtcttgatcttggactccccagcctccagagctgtgagaaataaaaatttctgttgtttctaagccacccagcgtatggtatttggtgatagtggctgaatggacaaagataccgtgcaatacgagtggagg

SEQ ID NO: 144955 - DNA, 601 bp, Human
aggcagcagtggcagcaaaatgacccccacaatctggggaagcctcatatctatgcaccatggtctgaatgtttgtgtcccctcaaacttcatctgttgaaatcttaccccaccccctccaaggtgatggtattagcatgtgaggcctttggaaggtgattaggtcatgagggtagagctctcgtgaatggggttagtgcctttatgaaagaggcctgagggagctcactccccctcccaccatgtcaggacaccatgaaaggagccatctatgcaccaggaaatgggccctcaccagacrttgaattcatcagggtcttgatcttggactccccagcctccagagctgtgagaaataaaaatttctgttgtttctaagccacccagcgtatggtatttggtgatagtggctgaatggacaaagataccgtgcaatacgagtggaggagaagtatacttttgaatctttccttactggtgagctggctttgcttcctcaatgccatctgctaatatgacccctgagaaggaggcacatatgacatagaaaggaagaagtgggaaacctggtgcctgggtccacagtggatggtgggaagga

SEQ ID NO: 144956 - DNA, 601 bp, Human
gaaattatgaaccaggtaatacaataaagggctggttgaaagtgcagatctgcaaacccaaacatacctgggccgcttaaactggggcttcctggcagcaattccttcacccaaaaaagtcaacccaatagtttggatttgaggctctgtggctgtctgggagagatcttggacagatggacctcagggttaacctcttcatagttgcaggcaactatgttttcctcctgtgtggtgggcatgggtcatttttgtatgcctgttagagttgctgctggaatcagaaccagtagatggaccsttttattgtagacgactcatgcttttacactttaacttctgcctatgattaagtgatttgtacagatttgaatgtgagtcaaattaagaggttgaggtccctctaaaaaattaattattttagtggtgaaatataatggtgaaaatggagaaataggtaccgatttgcttgttgtttttttcttatttgaaaatgtacattgattactgtggattaattgttgagtcaattgttactggaaaacaatcatgagactcagaataaagatagctgtttcttactgggttctgttggctgcaa

SEQ ID NO: 144957 - DNA, 601 bp, Human
ggtaatacaataaagggctggttgaaagtgcagatctgcaaacccaaacatacctgggccgcttaaactggggcttcctggcagcaattccttcacccaaaaaagtcaacccaatagtttggatttgaggctctgtggctgtctgggagagatcttggacagatggacctcagggttaacctcttcatagttgcaggcaactatgttttcctcctgtgtggtgggcatgggtcatttttgtatgcctgttagagttgctgctggaatcagaaccagtagatggacccttttattgtagacractcatgcttttacactttaacttctgcctatgattaagtgatttgtacagatttgaatgtgagtcaaattaagaggttgaggtccctctaaaaaattaattattttagtggtgaaatataatggtgaaaatggagaaataggtaccgatttgcttgttgtttttttcttatttgaaaatgtacattgattactgtggattaattgttgagtcaattgttactggaaaacaatcatgagactcagaataaagatagctgtttcttactgggttctgttggctgcaactgcctgtcactaa

SEQ ID NO: 144958 - DNA, 601 bp, Human
tcttatcacctatcatggctgcagctcactttgaagctctactgtggtcaagtcaaaattagcaggtggaaagtcagtaggtgaagaatagtcatccgctttcttcctgtgcctcagctgcagatgtggaggaggcctgtgggggacactgtgggcaggggcaaggtagggctcgcaacacccaggccctggcatgcaggcatcttctttgagggcagccaaccagagagagctgctgcaatcttcaggagatagatggcagttgtgaaacatttcagaaatcctcttcttttttttttttcttgagatggagtctcactctgttgcccaggctggagtgcaatggcgcaatctcagctcactgcaacctccagctcctgggttgaaacaattcttctgtctcagtctcctgagtagctaggattacagatacacgctgccacgcccagctaattttttgtattttagtagggacggagttccaccgtgttgcccaagctggtcgcgaactcctgagctcaggcactctgcccgcctctgcctcccaaagtgctgggattacaggcatgagccaccatgccaggccagaaatccccttcat

SEQ ID NO: 144959 - DNA, 601 bp, Human
taacctctctatgcctcaataaaaagtaggggtcatagaggaaaaagtgtaatcctcaggtctggcatagggcatctgctatgtgagcctttgctatttgctattactgcttactgtggcttttttattttaattttaatttttttatttttttgtttttgagggggagtttcgctcttgttgcccagagctggagtgcaatggcacaatcttggctcacagcaacatctgcctcctcggttcaagtgattctcctgcctcagcctcccgagtagctgggattacaggcatgtgccaccaygcccggctaatttttttatttttagtagagacagggtttctccatgttggtcaggctggtctcgaactcccgacctcaggtgatctgcccgcctcggcctcccaaagtgcttacaggcatgagccactgtgtactgtggcttttttaaaagcacacttacaaacaccgtctaaataacccagcctgattgttgctgaagagcagggataggctcaataatctatagttttcgtacttagtcttgatggaacttgggcgtcagtgagcaccttttaatgcctctgaaaacctgaagtcctt

SEQ ID NO: 144960 - DNA, 601 bp, Human
cacattgaaaaaaatcagtgtgtgtgtctgcgtgtgtgtgtgtgtgtgtgtgtgtgtgtgtgtgtttgtatggtggatgggtaaggcagaggagtaaagcaggggagatgagacccccacatgaaaaatgagaggtagagttattttgaagcaattttttcttttctaatgttatacacctaagtttccacttcttagaaaaagctgtttcttagatattgtcacccttcaagagtgaccagaacaacgctaatgttgacctcatagtccgcagagtatgaaaaggcttttttttttttttgagacagagtctcactctgtcacccaggctggagtgcagtggcatgatcttggctcactgtaagctccgcctcccgggttcactccagtctcctgcctcagcctcctgagtagctgggactacaggcgcctgccaccacgcccggctaattttttgtatttttagtagagatggggtttcactgtgttagtcaggatggtctcgatctcctaacctcgtgatctgccagccttggccttccaaagtgctgggattacaagcatgagccaccgtgcctggccagggctacttagttttatt

SEQ ID NO: 144961 - DNA, 601 bp, Human
gtgtgtgtgtgtgtttgtatggtggatgggtaaggcagaggagtaaagcaggggagatgagacccccacatgaaaaatgagaggtagagttattttgaagcaattttttcttttctaatgttatacacctaagtttccacttcttagaaaaagctgtttcttagatattgtcacccttcaagagtgaccagaacaacgctaatgttgacctcatagtccgcagagtatgaaaaggcttttttttttttttgagacagagtctcactctgtcacccaggctggagtgcagtggcatgatctyggctcactgtaagctccgcctcccgggttcactccagtctcctgcctcagcctcctgagtagctgggactacaggcgcctgccaccacgcccggctaattttttgtatttttagtagagatggggtttcactgtgttagtcaggatggtctcgatctcctaacctcgtgatctgccagccttggccttccaaagtgctgggattacaagcatgagccaccgtgcctggccagggctacttagttttattggaacaaatgtgtcttattttttaatccgtcacttaaaaattagatctatg

SEQ ID NO: 144962 - DNA, 601 bp, Human
aattaaatgtatgtttttacttactcagataggataaaaattgaacacgtttagtttatttcgcctaacttgtattcatttttaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactgggtaagactagcartctacaaaatgtagcaacacttccatatttttttgccccaaattttgcctttcgtaattttataactgattcttagaaatagatgtaaaactgaattcgaaaaatattaaacttattcctctttcatcctttcatacctcctaaagtgagggtatgatataggtatctttgtttagagaagaacatgctcatctagcatatagtgttttttttttgattggttgtgttttaagttctaaggagatagctgtattgcatggatagctgactaacaagaatgaacacacaatagccaaagtt

SEQ ID NO: 144963 - DNA, 601 bp, Human
taagtgtgactgagtcagtaggattaaaggacagggatgcagagcacatcttgacaggactgagccatcctgtaagaaggactttcttgacaggactgagccatcctgtaagaaggactgtttatcccttgcttcattcatactctgaaaatcggaatgctgttgacattggcatttgcaatcttctagggtcaggtatctgtaactataccttgtagggttaatccaatcatgtcttttgagtattacagtgattgattatgaatcactaaatctatcctgtgaagtaaaattacattaratttattacatagtcgacataagcatgatataaaatcaattcagtcatgtccacgtactagccacatgtccctctgcataaaaccaagctacggtagcatggtccatgttcatgttctcttttctcatcttgacttcactctatttgttgtcaccacactgttctatattctcagtggatcagtgttcaaatggccacggtcttctgtctgaacactgataccaatgcaaagagctcccaggttctattggcaactgctcatggttaagtctcattcgctatcttcaaagtaggcagttt

SEQ ID NO: 144964 - DNA, 601 bp, Human
cctgtaagaaggactttcttgacaggactgagccatcctgtaagaaggactgtttatcccttgcttcattcatactctgaaaatcggaatgctgttgacattggcatttgcaatcttctagggtcaggtatctgtaactataccttgtagggttaatccaatcatgtcttttgagtattacagtgattgattatgaatcactaaatctatcctgtgaagtaaaattacattaaatttattacatagtcgacataagcatgatataaaatcaattcagtcatgtccacgtactagccacatrtccctctgcataaaaccaagctacggtagcatggtccatgttcatgttctcttttctcatcttgacttcactctatttgttgtcaccacactgttctatattctcagtggatcagtgttcaaatggccacggtcttctgtctgaacactgataccaatgcaaagagctcccaggttctattggcaactgctcatggttaagtctcattcgctatcttcaaagtaggcagttttgctctagtatttactgcagcacaccagccgtctgagtttatctcagagtgatgcctctcgagtagcc

SEQ ID NO: 144965 - DNA, 601 bp, Human
cctctcgagtagccttatagtttgcaaatctctctcaaatctgttgctctatgagtgtttatccagctgcctctaagcctcacttctctctgcacacaggtatattttttctctcttaacacttaccattcttctccacatggcagaacatgtggcttctagtggctcatgggcttcactgcttacgtgctcagaatgttcagcaccctcagggaaactcctcttattgtcatggttccaagttccaatatccagggaagtaactcattgtctttgctttggtcatgcactcctttctggrccaatcaatgaactgtcgctctggagataggttcctagtagaaaccttatgtacagagctggaatgggggacatttcttagaagatacaacgcctagaagaaggagtattcaactagagttaccatttcaaatgttgtaatttgagaacataattaaaaaattcaaggtctcctttgggagaaattataactgacattaaatgaatgcagaagggcagacttgtgttatatcctttagtgttatcatactgctttgcttggcaatttggtggtttccgtttcttggtcctaccttacttt

SEQ ID NO: 144966 - DNA, 601 bp, Human
gtttatccagctgcctctaagcctcacttctctctgcacacaggtatattttttctctcttaacacttaccattcttctccacatggcagaacatgtggcttctagtggctcatgggcttcactgcttacgtgctcagaatgttcagcaccctcagggaaactcctcttattgtcatggttccaagttccaatatccagggaagtaactcattgtctttgctttggtcatgcactcctttctgggccaatcaatgaactgtcgctctggagataggttcctagtagaaaccttatgtacasagctggaatgggggacatttcttagaagatacaacgcctagaagaaggagtattcaactagagttaccatttcaaatgttgtaatttgagaacataattaaaaaattcaaggtctcctttgggagaaattataactgacattaaatgaatgcagaagggcagacttgtgttatatcctttagtgttatcatactgctttgcttggcaatttggtggtttccgtttcttggtcctaccttactttttccaacaacaatccaggcttctattgattactttattagggtactggaacaacat

SEQ ID NO: 144967 - DNA, 601 bp, Human
ttccaatatccagggaagtaactcattgtctttgctttggtcatgcactcctttctgggccaatcaatgaactgtcgctctggagataggttcctagtagaaaccttatgtacagagctggaatgggggacatttcttagaagatacaacgcctagaagaaggagtattcaactagagttaccatttcaaatgttgtaatttgagaacataattaaaaaattcaaggtctcctttgggagaaattataactgacattaaatgaatgcagaagggcagacttgtgttatatcctttagtgtyatcatactgctttgcttggcaatttggtggtttccgtttcttggtcctaccttactttttccaacaacaatccaggcttctattgattactttattagggtactggaacaacatagatttggctttaacactgaaggatcaaatgaattttataaacaattctactgccaaatcatttgagcagtattaggaagtctcaggctgcttgctgctttgggttgaaagtcccaaagatagctgttaaaatggaactattacacataccgaacaacatgttaatgtagtctcagctattaatat

SEQ ID NO: 144968 - DNA, 601 bp, Human
tagtgttttgttttgtttttttttatgaagtcttgttgtctcccaggctggaatgcagtggtgagatctcggctcactgcaagctccgcctcctgggttcacgccattctcctgcctcagcctcccgagtagctgggactgcaggtgccagccaccacgcctgactaattttttttttgtatttttagtagagacggggtttcaccatgttagccaggatgatatagatctcctgaccttgtgatccacccacctcagcctcccaaagtgctgggattacaggcgtgagccaccgcgcccrgccgatagaaatttttaaaagtacaaatgatcaacaaaatgaagtgatatatttttgaaatgataaaatcagtacacctttggccagactaagaaaaaaagagatatgactggaaaaaaaaaaaaacagagatgaaaaaggagacatcataactgataacacagaaatacaaaagatcattaaagattgttatgaaaaattacatgccaacaaattggaaaacttagaataaatggataaatttctggacaaatataacctaccaagactgaattatgaagaattagaaaacctgaatag

SEQ ID NO: 144969 - DNA, 601 bp, Human
catttaaggaagaaataatacctattcttctcaaattattccaaacaattgaagtggctaggaattttttcagactcattctatgagactagcattactctaatatcaaaacacaaggacacaacaaagaaagaaaactacatacaggctgatatccctgatgaacatagatgtaaaatcctcaacaaaatactagcaaaccaaatcaaacagtgctccgaaagatcattcacattgattaaatggaatgcagggatgtttcaaggtacataaatcagtaagtgtgatatatgacagtaayagaatgaaggacaaaaaccatatgatcatctcaatagacacagagaaagaactggataagattcaacattcctttgtgataaaaaccctaaactaattaggtatgaaggaatgtacctcaacacaataaaggtcatgtatgacaaacccatagctaacatcatactaaactgggaaaagttgaaagcttttcctctaaaattaggaacacaacaatgatgcctactttcaccacttctgttcaacatagtacaggaaggtctagctagagcagttaggcaagagaaagaaataaaaagca

SEQ ID NO: 144970 - DNA, 601 bp, Human
atctctacaatgaaaattattaaacattgatggaagaagttgaaaaggacacagataaatggaaagacatcttgtgttaatgacttgaaagaattaatattgttaaaatgtccatagctacccaaagcaatctgcagattcacatgcaatctttatcaaaataccaatgtcattgtttatggatagaaaaaaattctaaaatgtatatgaaaccacacaaaatcccaaatagctaaagcagtcttgagcattaaaaaaaaaagtttaaggcaccaaactacctgacttcaaaatgtactayaaagcaatagtaaccaaaacaggatggtagtggcataaaaccagacactaggccaatggagcagaatagagaaaccagagataaacccatgcatttacaaccaacttatcttcaacaaagttgcctagaacatgtaatgaggaaagatcaatcttttcaataaatggtgttgggaaaactgggtaattatatgcagaataatgaaactagaccctatctctcaccatacacaaaaatcaaatcaaagtggattaaagactgaaatgtaagacctgaaattgtgaaactactatgagaaaa

SEQ ID NO: 144971 - DNA, 601 bp, Human
actgaaatgtaagacctgaaattgtgaaactactatgagaaaacactgaaggaaatgctccagaacattagtctgggcaaatatttttttgtgtaagacctcaaaaacaggcaaccaaagcaaaaatagacaattgggattacctcaagctacaaagcttttgcatggcaaaggaaacaatcaacatagtaaagacataacctacaggacaggagaaaatatttgcaaactatgcatctgacaaggtgttaatatgcagaatatataagtaacacaaacaactcaatagcaaaaaaaaaawaataataatctgattattaaagtggacaagagatccaaacagacatttctcaaaataagacatataaattgcaaaaagatatatgaaaaaggctgaacataattggtcatcagagaaatacaaatcaaaactacaatgagatatcatctcaccccaatttacatgccttgtatgaaaaaaaccagtaacacatgctggcaatgatgtggagaaagaagaaccttcatacagtattggtagaaatgtaaattagtactttggagaatagtatgcaggttccccaaaaaactaaaaatagaa

SEQ ID NO: 144972 - DNA, 601 bp, Human
tagaaatgtaaattagtactttggagaatagtatgcaggttccccaaaaaactaaaaatagaactgctctatgattcagcagtgctgctactaaatacatatccaaaagaggtgcaatcattaagaaaactttgaaaggatttttttcattttaaatataaaatttaaaaaaacgaagtgaaatcagtatattgtagaggtatctatctgtactcccgtgtttactgcagcactattcataaaagccaagatatagaatcaccctaagtacccatcaccaaatgaatggattaaaacatgyggtacatatacacaatggaatactattcagccataaaaaaagaatggcattatgtcatttgtgacaacatggatgaatacggtgggcattatcctaaatgaaataagctaggcatagaatgacaaataccacatgatctcactcttgagaatctaacaaatttgatctcttagaattagagtagaatagtggctaccagaaactgagggagggtagaggggaggaagaatgatttctagtgttctagtgcacagtaaagtgaatagttaaccataatttattttttaaaaaaatatatag

SEQ ID NO: 144973 - DNA, 601 bp, Human
cctaagaacatattgagagacatacatccagatttatatacaagggtgtttaatctagtgctatttataatactgaaaaatcaaaaatgtcttaaatatataaaaaggtattgattgaatgaacaagaatgcatatgacatgatggaacaccgtgctgccattaaaaactgttttctgataatatttgatgacagtaaaatattcacgacatactgttgaaacgtagagatataaaataatgtatagtccgggcatggtggctcacacctgtaatcccagcactttaggaggctgaggcakaaggatcatttgaggtcaggagtttgagatcagtctggccaaacatagcaaaaccctgtctctattaaaaatacaaaaaattagtcgggcgtggtggcacatgcctgtaatcctagctactcaggaggctgaggcatgagaatctcttgaaccctggaggtggaggttgcagtgagtcgagattgtgccactgcactccagcctgggcgacaaagcaagattctgtctcaaaaaataaaataaaataaaataaaataaaataaaataaaataaaataaaataatgtataatacatatatg

SEQ ID NO: 144974 - DNA, 601 bp, Human
aactgactcaagaagatgtagaaaatctgaatagagccataagaagtatggagatttattcattaatcaaaaaattcacacaaaaggaatcttagtcccagatggcttcattggtgaattctagcaaaattttaaagaatagcactagtttttctcagcttttctaaaaaataaaagaggagggaacacttttcaacccattctgagaccagtattaccatgataccaaatgcagacaaagacatcacacatagaaaaaactacagaccattatcccttaggcacatagaaacaaaattckcaacaaagtattatcaaaccaaatgcagcaccatataaaaacattatacactatgaccaagtgaattaatcccaggagtatgagattggttaaacatatgaatatcaatcaatgtaatataccatattaatagaataatagacaacaaccacatgatcatctcaacagatgctgtcttagtctgtttgagctgctgcaacaaactaccatagactgggtagcttataagcatagaaatttatttctgatagttctggaggctgagagtccaagatcaagaccttggccgattcagtagct

SEQ ID NO: 144975 - DNA, 601 bp, Human
gtccaagatcaagaccttggccgattcagtagctgataaaggccggtttcctatttcatagatgacttctcattgtgtcttcacatggtggaaggagggcatcttttataaggtcactaatcccactcttaataccttgtcacttcctagtaccatcactttggggtttaggtttcaacatatgaattttaggggtacataaacatttagtccattgcagatgcagaaaagcattgaaaacattgataaatatggactagcaaactaggaataggaggaaattttctcaacctgataaaargcacctacaaaaaactcacggttaatgtcacacttaatggtaaaagactgaatgccttctcccaaagatcaggagaaagacaaggatgtctactcttacgacttttattcagcattgtattggtggttctagatagggcaatcagaccaggcaaagaaaaaaaaaaaccatctacattggaaaggaagaagtaaaactgcctctatgattgtgacatgaatttgtgcataaaaaattataagttgtttaccaaaaaacaattagagctaatagatgagttcagcaagattgtaggataca

SEQ ID NO: 144976 - DNA, 601 bp, Human
gggttctaagaccatgcaatgttggaaaagacaatcttcttaacaaatggtgctggaagaactgatatgcatttgcaaaggaatgaagtgtggtttttacatcacaacatacacaaaaattaactcaaaatcaatcagagacttaactgtaaacactaaaaccataacatacttagtaaaaaaaataagagtaaatctttgaggccgtggattaggcaatggttttctagatatgaaaccaaaaacataagcaataaaaggaaatattgataaattggacttcatcaaaatgtaaaacttygtgcttcagagggcaccatcagaggacaacctataaaataggagaaaatatttgcaaatcatacatctgttaagggtctagtatccagaatatataaagacctcttacaactcaacaatagtcaaattacccaatttaaaaatgggcaaaggatttgaatggatatttctacaaggaagatgtacaaatggccaataaacacatgaaaagatactcagctttgttagttattagggaaatgcaaattaaaatcacaatgagatatttcttcattcccactaagatagctataatcaaaga

SEQ ID NO: 144977 - DNA, 601 bp, Human
tgtagatagccatttcagctgtaataagaaattataccatttataaaaataaaataagatattggtttatttttaagcttttgatctcagaatgtctgtacaaactttggtgcagcttttccctgggaattaatgactagagagggttaatgggctaaaactctgttgggtcatcaacttttccagctagtcattaattctcaaatgccctaagcctcaatctttatcacttaattaaattcaataatttatttaatttatacatgtatatctcaaagcaattatacataattatttttaytcggatcaaatgtttcactctattgagtgatttgacagtttaactttgggccttaaataatttctttagtttctgtgggtgcaaaactttaatttaaatacggtgttcatgttaactgtctttggaatactagcctttataacttccatggtctgtttgtcaaagtggggtaagtattgattatatggcataatcagaaaagaaaaccagacatgagcaggtgcagccatgttgccgccttgagggacaccatgtttagcataaagctggcattgtggaacacagagtggggaaccagaa

SEQ ID NO: 144978 - DNA, 601 bp, Human
ctaagacttagtactaatttattgagtttcagctctgatcaatgtacttagtttatacaatgctgaactttgcccccactttatgtaccataagcatattgttttctgatatacaggttgagcatcctaaatctgaaaatcgaaacccgaaatgctccaaaatctgaaacattctcaatgccaatagaatgctcaaaggcaatgctcatataacaatttaatgctaatattccaaaatctgaaattcaaaacacttccagtcccaagcatttcagataaaggatattcagcctaatattgkaatttctattttattctttatagtaatttatagaaacaaaagcactgttttcttttcatgacagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggtaactgcagaaagcagttttcacatttaggagatggccagtggtgtgctgaggccccattggagaggcttccaggaggg

SEQ ID NO: 144979 - DNA, 601 bp, Human
actgcagaaagcagttttcacatttaggagatggccagtggtgtgctgaggccccattggagaggcttccaggagggtgctatccgttgccgctctgtctccttactctcttttccttcatagcactttccccacctggtatagtgtatatttgtttatgtattttgtgtgtgccccctgccccaacccccaaccctgactattggaatgtaagattctccagggtgaagactgtcttttcgtaactgctgactctcctactgtcacaacagcacgcaggggattgtcagagctcaataaatatttgtagaatgagctaatggattataaagataggagcttggttttgaaagtgcctgtgctggccaagaattttatgtgcaccatctcctgtaatactaacaaccacatttcaagataggattatcaccatcccaaagatgttaagtactcttcaaatgtggttgctaggattggctgaactaggattggctggctctgatttatgtattgttttgactctatttattacctgatagtaaaagtggtggtgatgttggaggaggaggaggaacagcagctccctgtctttctcaagtca

SEQ ID NO: 144980 - DNA, 601 bp, Human
tttctttttcatttttcttttttagctaaagttattgattaggatctctaagggcctatagtggcagttgcaaacttggaaattctatcgtggcccttaaaaattacttagatagtaaataaaaggggccctatcaatagggcccagggaatctcactattaacagttcttcattcggaaaagtgtttgcttcccctacatttcgttttctttctcaagtttgagccttgataaacattcctttcaaatttaatagtgcatataaagttcttgctttggggagagatggttataaaattcytcatttaaatgtctttgaatgattatggtaatatgatactggtttatcttttacactctgccccatagtgtttcccagaggttctggctgcttctgtcaactatttttacctagtaaagtttcccttacattgtctagtgtggcttgtatttttctttgtatattagctccagttattggagttagacagttaactccagttgtctggttttgaagctgtgaaatgattctgcagctctgtgggaactgctgaggtagaacctaacgtaaaattggaaatggctctgacatcattaaaat

SEQ ID NO: 144981 - DNA, 601 bp, Human
ccttgataaacattcctttcaaatttaatagtgcatataaagttcttgctttggggagagatggttataaaattcttcatttaaatgtctttgaatgattatggtaatatgatactggtttatcttttacactctgccccatagtgtttcccagaggttctggctgcttctgtcaactatttttacctagtaaagtttcccttacattgtctagtgtggcttgtatttttctttgtatattagctccagttattggagttagacagttaactccagttgtctggttttgaagctgtgaaaygattctgcagctctgtgggaactgctgaggtagaacctaacgtaaaattggaaatggctctgacatcattaaaatgattgaacaacttttcatcagtgttctaaggagtttttcatgattccacattttccatatttctctagtagttcagagttttgtatattctgtgaaatgaaaagaagaaactgtattaatcaaattaagtagggagtggactggttttcctaaaatcatcagtcaccatcttaatgatggacagtcctctcccttctgtcgaatgaagttttaacattcaaattt

SEQ ID NO: 144982 - DNA, 601 bp, Human
ttttaaagaacaactaaattgcagttgctcagtgcatataaataggagtgtttccatagagtcaatttgagcagctttagtaattggagttatttttcatttggccacccatctaattgaacattaaaatttaaaaattaaatcaaacacataggtaaaactaatggtataaattctgatcctctttttcaaaaatgggaaaacattcacatttcactaataagtcattagcattcttctcttcaaagtcctcaagatggaagaaattccaagaactaaaacggttagctgtatgaatttkcatgttaatatcccataaccctctccacccacccttgctcctgggataatctggaagaggctcacctcaatgtttctgagtccacttcagaaattccaaacactgggtgagcctcagcattgacctcttacagagaaagggttccttttgccctggtaataatcgaccagtgtttattaggcaaccatgattctttcccccaaggtgcaaaaggggagacaaaaatagaagacgtgtttttcactgtcaagactcaaaatctggttacaggaccacatatatcaatatgaaacatcttaa

SEQ ID NO: 144983 - DNA, 601 bp, Human
agacaaaaatagaagacgtgtttttcactgtcaagactcaaaatctggttacaggaccacatatatcaatatgaaacatcttaaaaaacccacaaaacaaaaaccaaggcaacatgaatgctgggactaggaagcaggaagctgtcaagagaagcaatgttagggaccaaggctcccacccttgcacctaggaccacacagtctctcctcccttccaggctatggcctctgctcctcctcacctcttctaagtacagggtggaagatggttcttcacagctcctgagtttacaagttttcytagtctaagccccagataacaattacaaaccctaagtccaaattcctgggagaaggggtctggtcagttctttttgggttggctgtctaccttggatcaaattagctaagggataggtgtgggtgtcacatagcgcaaatctctaatgcctgacaaccttaactaaagaagtttaggtctagaggtaacagtagtactttacgtttttaagagctactcctattattattattattattgttgctcttagtctgatctcccagggtcagaacatctagacccaaattaatcttaatggtt

SEQ ID NO: 144984 - DNA, 601 bp, Human
aaaaccaaggcaacatgaatgctgggactaggaagcaggaagctgtcaagagaagcaatgttagggaccaaggctcccacccttgcacctaggaccacacagtctctcctcccttccaggctatggcctctgctcctcctcacctcttctaagtacagggtggaagatggttcttcacagctcctgagtttacaagttttcctagtctaagccccagataacaattacaaaccctaagtccaaattcctgggagaaggggtctggtcagttctttttgggttggctgtctaccttggatcmaattagctaagggataggtgtgggtgtcacatagcgcaaatctctaatgcctgacaaccttaactaaagaagtttaggtctagaggtaacagtagtactttacgtttttaagagctactcctattattattattattattgttgctcttagtctgatctcccagggtcagaacatctagacccaaattaatcttaatggtttactaaatactttaaaagcataccctgaaactcagtaattcaaacctttgaattttctgaattccttctctgacttgttcatgaacttgtcccaacaaa

SEQ ID NO: 144985 - DNA, 601 bp, Human
tgctcttgagagaggtttagataatccaactgaaaaaattcaaacccttgcatttgacatttcaaactttcaagagtccattgtagaataacagttcattcaacaggtatttgttgagcatctactgcattttttgagttgtcagtggagacctagactttttttaaaacccaagaactccaacttggcaaatctttggagatttctttatataaaccccttagctatagagccatgaagtaatatttctaatatggctatatgccacataacgtttcagtcaacatggattgcatatacrgtggtggtcctgtaagagtataatgtatttttactgtaccttttctgtgtttagatgtgtctagatacacaaatacctaccattgtgttacagttgcctgcagtattcagtcccgtaacatgctgcacaggtttgtagcctgggagcaatagactacatcatgtagcctaggtgcgtataggctgtaccatctaggtttgtgtaagtgccctctaagatgtttgcgtgaggaaattgcttaatgatgcatttctcagaaggtaaccccatcattaagcgacatgaatgtatatccaaaat

SEQ ID NO: 144986 - DNA, 601 bp, Human
gtacatgcaatacttacttttctttggtgtttttaaggagcgacgaaaatttggccccttaggatggaatattccctacgaattcaattctgctgacttttcagccagtgttcagtttattcagaatcaccttgatgaatgcgatattaagaaagtgagtgaaattatgccttttttcctgtttttattgctcttcttaaatcagggttctacagtcatttgaagtctatgataaggtgtgaatttgctgagccccatggagccccctttgaagggacttgttgctgtaatcaggcacttrctggggcagcctgtccctgcccccaacactcacatacctctgaagctaactaactcagtgtgttgcaaaataccgcagccttcctcatgttacactcagggaccacagtgcacttcaagagaaggtgtgctttaggtcaagcttctcctcactggtcctactcctgcctcctcagaagtgaagatggtatctgcctgcccatgcgaaagttctttctcaccttaagtcacttcttaactgctcagcttatgcatatgaataacaatactttctagtaatggtcattcatcatcatatgac

SEQ ID NO: 144987 - DNA, 601 bp, Human
agtacctaataagagctcattcaatatgactctctgcagtctggccccctcttcttccacagagtagggcttcaaggtaattagagattctgaagcttccgtaatggggtggtaagccatgatgagtgtttactctagtaccaaaccgtcatttttccttgaaatgacaaagggatatgaaattaaaagtaaggcagtctgatgaaaagttatattctatgtgttcatattctgtggtcatttatcattttggtacatacaaataatagttaccttaaaatagttgctttgaaaggcaacyaagctgaaaaataaaattttaaccaagaaaaagtaaacaaaaagcaaatatccttatttctcgtaactcaaatgtatcaagggtttaaagaaactgctaaactgcaatatattgctagtataaaattgctatagaaattaataaatattttgatgtagttttagcacatagaatgagatgcagaggatggcagaggattgcattgaggaaaaatcttgtggataaataattttcttgttgttctcgtaatgattccagaaaatacattactaagaaagcgtattaaagcaatgattactt

SEQ ID NO: 144988 - DNA, 601 bp, Human
gtagggcttcaaggtaattagagattctgaagcttccgtaatggggtggtaagccatgatgagtgtttactctagtaccaaaccgtcatttttccttgaaatgacaaagggatatgaaattaaaagtaaggcagtctgatgaaaagttatattctatgtgttcatattctgtggtcatttatcattttggtacatacaaataatagttaccttaaaatagttgctttgaaaggcaaccaagctgaaaaataaaattttaaccaagaaaaagtaaacaaaaagcaaatatccttatttctcrtaactcaaatgtatcaagggtttaaagaaactgctaaactgcaatatattgctagtataaaattgctatagaaattaataaatattttgatgtagttttagcacatagaatgagatgcagaggatggcagaggattgcattgaggaaaaatcttgtggataaataattttcttgttgttctcgtaatgattccagaaaatacattactaagaaagcgtattaaagcaatgattacttgatttttctccttttttcactaaacaccactttcctcctctgtaacagcttggcattactaca

SEQ ID NO: 144989 - DNA, 601 bp, Human
ttatatccccagagtgaaaattagtctttttccctattttaaataatatacgtgcaatatacttaccagtgtttagtattgtagattttttcttggtgaacaaactgtagtggttccagccatgtaatagtgaaagagttattaatataagacgatgaataattttaaatgtgagtctagtgagtgcttccttttccagacctttcctctagggaaagacccgaaatgtttataatgatgtgtttgggttgacaattaataatccttttttacttttaataaagggtgtatcatggaatayggttcggtacatgatcggagaagtacaatatggaggcagagtgacagatgactttgacaaacgtctacttaattgctttgccagagtaagtcaatttagaaaaataaagtttggagacacatttcactgtattttccaatttttttgtttgtaataggtctgccaaactcaagcatacagcagagctgctgcaaagaattagccaagaaacaaatgcatgtgtgcgcttacacacacgcacacacatgcacacacacacacacacacacacacaacaaccagcaattgggccaggcatgg

SEQ ID NO: 144990 - DNA, 601 bp, Human
atcatggaatacggttcggtacatgatcggagaagtacaatatggaggcagagtgacagatgactttgacaaacgtctacttaattgctttgccagagtaagtcaatttagaaaaataaagtttggagacacatttcactgtattttccaatttttttgtttgtaataggtctgccaaactcaagcatacagcagagctgctgcaaagaattagccaagaaacaaatgcatgtgtgcgcttacacacacgcacacacatgcacacacacacacacacacacacacaacaaccagcaattgkgccaggcatggtggctcacgcctgtaatcccagcactttgggagactgaggcgggcggatcacgaggtcaggagttctagaccagcctggccaatatggtgaaaccccgtatctactaaaaatacaaaaagtagccgggcgtggtggtgagttcctgtagtcccagctacttaggaggctgaggcagaagaatcacttgaacctgggaggcggaggttgcagtgaaccgggatcgcaccactgcactccagcctggtgacagagtgagactctgtctcaaaaaaacaaaaacaaaaacaa

SEQ ID NO: 144991 - DNA, 601 bp, Human
gccgggcgtggtggtgagttcctgtagtcccagctacttaggaggctgaggcagaagaatcacttgaacctgggaggcggaggttgcagtgaaccgggatcgcaccactgcactccagcctggtgacagagtgagactctgtctcaaaaaaacaaaaacaaaaacaaaaaccaaccaacaatctacttgtggtgcagagcagagcagtggtcagttctcattgctctataactcctttcccatgtagatgaaactgcttgtgcccagggcctctcccccactgcccctcctccatcttccrcattcctgtgcacctcacttgtgaggaaaacactggccatcatttctctgcctctttctctgagtgaaagtcttatggtgatttcaagccccaaaataagtgattgggggattaatcataatttgagttttctcatctcttctattaggatagacaattggaaattgaggaagtgttcactttttctctgtgccaaataaaatccacatataacatgctgataaatattttctagagaaaattgtttattagcaattgtggctttcacatcaaggatgaatgtaataaataacacctacc

SEQ ID NO: 144992 - DNA, 601 bp, Human
caaggatgaatgtaataaataacacctaccagactcaaactcttcttaaaatgttttacattttagggaagtaatatataacacctaagtgagaaaaaaccagatgtcttttatggttattaaattctttatattggaacctataccggtaattctctacttaaatgattcttttttcttgacaaaattaaagcctcaacaacaaagcacaagctttgggagtattttgataagctgggggttgactagaaaacggatttttaacctttacttgttttagcaagtttttcttgaagctacrtatggagaactgtgaaaaataataagtgttggtgagaatgtgcggagggaggagccctgctgctgggaggtcaaatggacacagacctcctggaaagcagtccagtaatacttactgaaattaggtatctcaggtagacatatctcagaacatttctagaaagagtccacaaatggacatgtacaaaaatattcatggcaacattgtgtgtggagctgaaggcaagcatcatagatggttttcctggaagcagaggtggagatttgcattcaagtgcctcctccccagccttcctgcaag

SEQ ID NO: 144993 - DNA, 601 bp, Human
tcttaaaatgttttacattttagggaagtaatatataacacctaagtgagaaaaaaccagatgtcttttatggttattaaattctttatattggaacctataccggtaattctctacttaaatgattcttttttcttgacaaaattaaagcctcaacaacaaagcacaagctttgggagtattttgataagctgggggttgactagaaaacggatttttaacctttacttgttttagcaagtttttcttgaagctacatatggagaactgtgaaaaataataagtgttggtgagaatgtgmggagggaggagccctgctgctgggaggtcaaatggacacagacctcctggaaagcagtccagtaatacttactgaaattaggtatctcaggtagacatatctcagaacatttctagaaagagtccacaaatggacatgtacaaaaatattcatggcaacattgtgtgtggagctgaaggcaagcatcatagatggttttcctggaagcagaggtggagatttgcattcaagtgcctcctccccagccttcctgcaagacatgaccttggctgaagcagctgcctcctgctagggcagttc

SEQ ID NO: 144994 - DNA, 601 bp, Human
tacatgttctaggacatatatcaagtacacttaaatagatgccctcagagggaaaaggagacagtgaatggatatcagggcagaatggggaaaaattaaaataaaaggggcctagattcataaaaataataaactcgggagtgtgagaaactgacctctgtatttgagattcaaaggagaaaaaaaaagatgtcttaataagtatactttgttagaataattgtaaaagtatctaaaattggagttttagcagcagagactaagatgtggttagcttcagaatataattcaccaagagtamcagcagaatgctgatgggatcaagtgcgtgggtgaaagaagaggggagtcaaggtcatccctagttttgacttaagccactggacacagaatggggctatttacagacaagaggaagggctgcagcagggaagagttttattggctggggctggaaattaagagtttggttttgatcatataacatttgagatgtctattagacatccaaatcaagttgtctcagactgtaactgccatgagggcagggactttgtcttattacatcagtgccaaactctgagcaccagaaacagagccc

SEQ ID NO: 144995 - DNA, 601 bp, Human
gtctcagactgtaactgccatgagggcagggactttgtcttattacatcagtgccaaactctgagcaccagaaacagagcccaacacatctaagtgctcagtaaatatttgttgaatagaagaacgaatgcatgaatgcaggtgaacaaggcacctggatgtacagatccggaggtcatggtggagctcaggcatggagataaggatctggaattcttcagcatgtagacagtggcaacggaaagctgctgtgttggtccagagcctccagggagatgtctgagccgggagcacacggagsgggaggaagaagtgtcgctgtctcagcctgctccaccttcaagagctcaagcagggggattcccctctctgacccctctcctgcctttcttcctcttctacttcttccctgtaccctgacatttggcattttgggccacagaggactagtgagctgacttcaaccctctcctagaaacccaagattctctgtcctctgggcctgggatgtgcagacttcctgatctaaaagcacagggttccatatccaggccccagttcattggctgttcccaagtaacagcagctccctcctcacctg

SEQ ID NO: 144996 - DNA, 601 bp, Human
ctgtcctctgggcctgggatgtgcagacttcctgatctaaaagcacagggttccatatccaggccccagttcattggctgttcccaagtaacagcagctccctcctcacctgagttattttactcccttctatcatctgattctggtttctctggactccattctcagcaattagtgccttaagtcaaaagttcatcttactattttcccattcatttgcccctgagtggcttctgtgggctcattccctccccctctctcaggacttccctaagagtggcacaaccttcagtggcttcarttctctgactgttggccaccccacttccttatcctactgaatcttctctttgccctacatcctctccaacctcctgtcttgttgctttccctcattcatttctctgtctagcttggacctgtttcagatggtcatcaataaccagaggtgagtttgggtctctggccctaagggcatgagcttaccacatgaacctggcagcagcaaccctcttgagaaaggctgcacaaaagcctcacagcccccacaccctgccttcacctgtttgatctcatcctcagccccaggcttgccttctga

SEQ ID NO: 144997 - DNA, 601 bp, Human
tccactttaccctaaccatgtcatccagagttgcccatgggagaagcagctccactgtaaactcacgcctgcacatggcatcctctgtccctctgactttcaatctcgggcttgtctttgaaccttgttttctctgttctcagcatcttacagagtctctctgctaaaagcgattgcagaactgtattggatgttcatggggtatgaccgctcacaaagtagctccatgtagatttcatatttcatattttgactttgcccccaaatagcctccaaatttggtgaaactcagctatttgtrtgtgtataaagtgctgggaaaatagtaagaaacttcattttggtcttatacatacatgtcatctgacaacacagaattcagtgtggttatttgttatctgtgtgctgaggacccagggcctttgcccccttagggtgtcttcctgcaatttaagtcatccacgtcgtgaaaaatctaatatttctaagtaatgaccatgctcataacactattctctttaataactttcaactactctccatttcttgaattaatcaccagtcctcaccctgacatcaatagtcatccatgatatgacct

SEQ ID NO: 144998 - DNA, 601 bp, Human
acctcagctgacatccacctggatgttttttgttcctgctttaaacctctttagtactttgcttatttttatttccttctgactcttgccttagtgcactttgtattgtggttattaagtaattggctcatccctccgctgggtcacaagctccttgaaagaaaggactgtgtgtctcttatctttgcattctgttctggttctaaactcagcctgctcatgcataggagttgaataggataaaacagagagaatcagtacacagggtatttcagagcaatcactggatctaaaaagagcyggaggaaggagatggagggaaggtactagagaacgtgtgaccaaccagaggaaggcaccgtccctctttcctgtcaagtgctccgagtaattcagacgtcgtgcctgcatttccactcttcctgtcttcccattatttccttccccactgggaaaattgctgtgagacgtaagtcattgcctcaaatctggctcataggcatttagcatcatttttttttcctttctgagaataagtctattcacaccaactatatatttgttctctcactggtttgttaaagataattcatatggaata

SEQ ID NO: 144999 - DNA, 601 bp, Human
ttccttctgactcttgccttagtgcactttgtattgtggttattaagtaattggctcatccctccgctgggtcacaagctccttgaaagaaaggactgtgtgtctcttatctttgcattctgttctggttctaaactcagcctgctcatgcataggagttgaataggataaaacagagagaatcagtacacagggtatttcagagcaatcactggatctaaaaagagctggaggaaggagatggagggaaggtactagagaacgtgtgaccaaccagaggaaggcaccgtccctctttccygtcaagtgctccgagtaattcagacgtcgtgcctgcatttccactcttcctgtcttcccattatttccttccccactgggaaaattgctgtgagacgtaagtcattgcctcaaatctggctcataggcatttagcatcatttttttttcctttctgagaataagtctattcacaccaactatatatttgttctctcactggtttgttaaagataattcatatggaataagaaagggatgtcttaaggcaaacagcaaggcagctgaatacatttacttcatgtggacagggacataatta

SEQ ID NO: 145000 - DNA, 601 bp, Human
ttgtattgtggttattaagtaattggctcatccctccgctgggtcacaagctccttgaaagaaaggactgtgtgtctcttatctttgcattctgttctggttctaaactcagcctgctcatgcataggagttgaataggataaaacagagagaatcagtacacagggtatttcagagcaatcactggatctaaaaagagctggaggaaggagatggagggaaggtactagagaacgtgtgaccaaccagaggaaggcaccgtccctctttcctgtcaagtgctccgagtaattcagacgtygtgcctgcatttccactcttcctgtcttcccattatttccttccccactgggaaaattgctgtgagacgtaagtcattgcctcaaatctggctcataggcatttagcatcatttttttttcctttctgagaataagtctattcacaccaactatatatttgttctctcactggtttgttaaagataattcatatggaataagaaagggatgtcttaaggcaaacagcaaggcagctgaatacatttacttcatgtggacagggacataattagcaaaggaagctcttcaactcaaggtgg

SEQ ID NO: 145001 - DNA, 601 bp, Human
gcttttatactggatataaaatccccttatgcaaaaccttagaccagtattttgaatacatccagtcactgccatccctagataaccctgaagtctttgggcttcaccctaatgctgatatcacgtaagtccctggcattttttaatttgaaggggtcatttgtaactcagtctggcaaagatggtgcatttcattttctctcctaatctctctcctttccccctttttttattttactgtgaaaaatagtgtcgcttcctgtctcccaattacaactttgtcatatcttggcctgctctyctctcactaaatcctgatgctccagtgtttatgacaacgttaagctctaatttatgcattgattatttcttctctgtcatgtcataaaacgagttggtgttagtggtagcagtgctctccgccggcagaagagtggtctgccagctcctcatctctttcttcaaaaattcattaagaatataatgctcataaatagaatctaaaaagccaggtgagaacagatgggagggtgaagaatcgtatttctgcctggtcctctctttcatggcccctctccctcacttgctcatctgcatcctt

SEQ ID NO: 145002 - DNA, 601 bp, Human
cctcatctctttcttcaaaaattcattaagaatataatgctcataaatagaatctaaaaagccaggtgagaacagatgggagggtgaagaatcgtatttctgcctggtcctctctttcatggcccctctccctcacttgctcatctgcatccttttgtcatgcactgcctgtggtgggtgcagtgcggtgagcacttgagtacccgacacagatgcacagccccgggaggaaagagtggaggggctcagctttgcgtgaggtccctgctccactcatcacctagagaagaaatgctccccrgttccaagccccttggcatgaggtgtcaccccttctctctttaggatccctaccaaacccaagcacctgaactggaatcctttggaatggaccgcatgtcctctgcagccccctgatgaaaagtcacaaggtttacattcaggaaaatggtttcaggaagtggaagaaaccaagactcctctggcagattctaagttgagaatgccctaagagtggggcattcctctctcctagtccctggcctactgttgtaattttaataattctctgggtttggacatggacatttccctggccttg

SEQ ID NO: 145003 - DNA, 601 bp, Human
tctttaggatccctaccaaacccaagcacctgaactggaatcctttggaatggaccgcatgtcctctgcagccccctgatgaaaagtcacaaggtttacattcaggaaaatggtttcaggaagtggaagaaaccaagactcctctggcagattctaagttgagaatgccctaagagtggggcattcctctctcctagtccctggcctactgttgtaattttaataattctctgggtttggacatggacatttccctggccttgccagatgtcccaggagtcccagtttgctgccaatttcyttgtcttcccgcctctgaccaccctcctagctccctgcatgaggatgcacttttggcctctttacacccaccttgattccaccttcttcatatcctctcatctcgcccaggctgcttttcatcttcaaagatgcggacatgattgaaaatacctacaaatgccaatgcttcattccacccccatgatggaaccacgaaggttcgttagtggcagctcttgctgttatctaaggaggctttcataagttatctggggatgggaaagaagtgaagaaataaaaaggattcctcagggattgg

SEQ ID NO: 145004 - DNA, 601 bp, Human
ggatacttgcactccctggaacctccctcctcctagatatcacagtggctcacttttacctcttctagtctttgcttagatgtagccttttcaatgatgccttccctggctgtgctatttaaagattgcaacccactccccaaaccctgcccaagagcttgtcctcctgacctgctcttctctatagtttgtatcacccactgacatactctacactttttttttttgccacggaatttcgctcttgttgcccaggctggagtgcaatggcacgatcttggctcaccacaatctccgcctytcaggttcaagcgattctcctgcctcagcctcccgagtagctgagattacaggcatgcaccaccacgcctggctaatttttgtattttttagtagagacagggtttctccatattggtcaggctggtctcaaactccctagccttaggtgatccgcccacctcggcctcccaaagtgttgggattacaggtgtgagccaccacacccagcctcatactttacactttaattactgatttgttattgtccaacaaccaccactaaaccataagttccactacacctgaaacttttgtgtgt

SEQ ID NO: 145005 - DNA, 601 bp, Human
cctgcccaagagcttgtcctcctgacctgctcttctctatagtttgtatcacccactgacatactctacactttttttttttgccacggaatttcgctcttgttgcccaggctggagtgcaatggcacgatcttggctcaccacaatctccgcctttcaggttcaagcgattctcctgcctcagcctcccgagtagctgagattacaggcatgcaccaccacgcctggctaatttttgtattttttagtagagacagggtttctccatattggtcaggctggtctcaaactccctagcctyaggtgatccgcccacctcggcctcccaaagtgttgggattacaggtgtgagccaccacacccagcctcatactttacactttaattactgatttgttattgtccaacaaccaccactaaaccataagttccactacacctgaaacttttgtgtgtgttttcactgctgcatcccttgtgctatagcagtgcctggggctcaggaagtatttgttgactgatcagtgctgctaaattcttctagagtgtgaaggatgtgatcaatgaggagattccatagaaagatcccacaagttcacgt

SEQ ID NO: 145006 - DNA, 601 bp, Human
gacatactctacactttttttttttgccacggaatttcgctcttgttgcccaggctggagtgcaatggcacgatcttggctcaccacaatctccgcctttcaggttcaagcgattctcctgcctcagcctcccgagtagctgagattacaggcatgcaccaccacgcctggctaatttttgtattttttagtagagacagggtttctccatattggtcaggctggtctcaaactccctagccttaggtgatccgcccacctcggcctcccaaagtgttgggattacaggtgtgagccaccrcacccagcctcatactttacactttaattactgatttgttattgtccaacaaccaccactaaaccataagttccactacacctgaaacttttgtgtgtgttttcactgctgcatcccttgtgctatagcagtgcctggggctcaggaagtatttgttgactgatcagtgctgctaaattcttctagagtgtgaaggatgtgatcaatgaggagattccatagaaagatcccacaagttcacgtgagtggacagagaaagaactgataagtcttaatgcacttgcaaatttgtgactgaaa

SEQ ID NO: 145007 - DNA, 601 bp, Human
ggctggtctcaaactccctagccttaggtgatccgcccacctcggcctcccaaagtgttgggattacaggtgtgagccaccacacccagcctcatactttacactttaattactgatttgttattgtccaacaaccaccactaaaccataagttccactacacctgaaacttttgtgtgtgttttcactgctgcatcccttgtgctatagcagtgcctggggctcaggaagtatttgttgactgatcagtgctgctaaattcttctagagtgtgaaggatgtgatcaatgaggagattccrtagaaagatcccacaagttcacgtgagtggacagagaaagaactgataagtcttaatgcacttgcaaatttgtgactgaaaatgttctcatatgagggctctgaactttaattccatccttgacaagagactggggagtcacgagagctggttcctggataatccacaagatcccaacaagatgaaaccatttcaccctcacccagggtgatggtgcacctaggccttgttcactgcaggctgtttcactcaccagctctcaagaaagatgaaacagggctagaaaaggtccagagaagt

SEQ ID NO: 145008 - DNA, 601 bp, Human
aataactttatgcttgtggactctcatattattagagatgtattttcagggtaaattgttatgggtgggattgctagatcaagatttagtgaatattgtcaaattcccttacatagggttatactgttttgtacttttacttgcagtctgtgagtgcccattttttcagaatctcatcaacagagcgctggtgaggcatttgaaccttcaccaatatgacagtgagaaatgttatctcagcatagttttagttcacttctcttattttgagtgaaattgagaaaattttcatatacttaasggctatttatatatagtctgtccattcctttccaatggagtttttattctttttatttaattttaggacttatttatatgttagggataacaaccctttgtttgtgatgtggattgcaaatatttttctcagcttatttagcgttgcttgtgattttcccccattgatcaggtagaagtgttattgtcgtttcgttttatttttatgcagtcaaatttatgactacataaattctgttcttgctgttgttacatctggatttttagtaatagtaagaaagcttcttccctcatcagggta

SEQ ID NO: 145009 - DNA, 601 bp, Human
attgatcaggtagaagtgttattgtcgtttcgttttatttttatgcagtcaaatttatgactacataaattctgttcttgctgttgttacatctggatttttagtaatagtaagaaagcttcttccctcatcagggtataaaggaatcatctacatttttttttttttttagtgcttgtatggtttcacgtttttacatttagttcttttatccattaggaatttacctattaggtataagtatggatgaaattctttttcagaatagcaatccagttatcctatcaccagtgactttttytttctttttttttttttttgagccggagtcatgctctgttgcccaggctggagtgctgtggcatgatctcggctcactgcaaccacctcctgggttcaagtgattctcctgcctcagcctcctgagtagatgggattacaggtacatgccaccatgcctggcaaatttttgtattttagtagggaaggggtttcaccatgttgaccaggctggtcttgagctcttgaccacacgtgatccgccagccttggcctcctgcttcctttaacatagaatttccttccataggtactcgggtcc

SEQ ID NO: 145010 - DNA, 601 bp, Human
gtcgtttcgttttatttttatgcagtcaaatttatgactacataaattctgttcttgctgttgttacatctggatttttagtaatagtaagaaagcttcttccctcatcagggtataaaggaatcatctacatttttttttttttttagtgcttgtatggtttcacgtttttacatttagttcttttatccattaggaatttacctattaggtataagtatggatgaaattctttttcagaatagcaatccagttatcctatcaccagtgactttttttttctttttttttttttttgagmcggagtcatgctctgttgcccaggctggagtgctgtggcatgatctcggctcactgcaaccacctcctgggttcaagtgattctcctgcctcagcctcctgagtagatgggattacaggtacatgccaccatgcctggcaaatttttgtattttagtagggaaggggtttcaccatgttgaccaggctggtcttgagctcttgaccacacgtgatccgccagccttggcctcctgcttcctttaacatagaatttccttccataggtactcgggtccatttctgggctttctattctgtt

SEQ ID NO: 145011 - DNA, 601 bp, Human
gtagatgggattacaggtacatgccaccatgcctggcaaatttttgtattttagtagggaaggggtttcaccatgttgaccaggctggtcttgagctcttgaccacacgtgatccgccagccttggcctcctgcttcctttaacatagaatttccttccataggtactcgggtccatttctgggctttctattctgttttcctttctattttgtagcagtctgttttaagtttagctagtctccagtatgttttattatctgatagttatagtctcccctcattgctctttttttttttttctgagcttgtcctagctattgttgcatgtgtgtttctctattgttgtcagaaattggtgttgaattttgttgaatacctttcaacatttatggaaagaatcacatgattttcccctaaacacctaaaaagttagtgaattatattaatggatttcctaactcaaattttctacagataatctgaaattaataccactgggttcggaggtattattctcctaaggtagtgatatactctattaatggttcattggggaattttgcattgatattcataaataagaatggcctggagttttt

SEQ ID NO: 145012 - DNA, 601 bp, Human
gtttggtagaattctcctgtgaaaccatctgggctcagtgctagttctttgatatctttcgtatttctctgtcaccactgcagtcaatattttgtcagttgtgttctcctaggaaattatttgtttcatctaggttttcgtatttattttcacaaagacatgcaaactagtctttaatctggtctaataagctggactcagtacaatgtggtaaagaatgaaatcacttcttccttaccctatactgagtccaacccattcaataaaattgttacagaagtgtggacataacactagctcygtagaccttggtctgaaatctgatgacaacttgaagccactctcgtgcctctcctaaaggaatgtactagccttcttaatataatctatcgaggcagctctgttcaaccacttcactatggtgttgccaacacatcccagagaaaccactgagaaacagtggttatactgttatatggtggttatacttacttaatactaagaaggaacttagtattgacacagatgaacacctcaccagagccagaggctcctcttcacagggttctcctgctgtccggcttagcaggttctcagtcct

SEQ ID NO: 145013 - DNA, 601 bp, Human
atgtggtaaagaatgaaatcacttcttccttaccctatactgagtccaacccattcaataaaattgttacagaagtgtggacataacactagctctgtagaccttggtctgaaatctgatgacaacttgaagccactctcgtgcctctcctaaaggaatgtactagccttcttaatataatctatcgaggcagctctgttcaaccacttcactatggtgttgccaacacatcccagagaaaccactgagaaacagtggttatactgttatatggtggttatacttacttaatactaagaargaacttagtattgacacagatgaacacctcaccagagccagaggctcctcttcacagggttctcctgctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatagcctatgttctactcacattttaacctctt

SEQ ID NO: 145014 - DNA, 601 bp, Human
cttaccctatactgagtccaacccattcaataaaattgttacagaagtgtggacataacactagctctgtagaccttggtctgaaatctgatgacaacttgaagccactctcgtgcctctcctaaaggaatgtactagccttcttaatataatctatcgaggcagctctgttcaaccacttcactatggtgttgccaacacatcccagagaaaccactgagaaacagtggttatactgttatatggtggttatacttacttaatactaagaaggaacttagtattgacacagatgaacacytcaccagagccagaggctcctcttcacagggttctcctgctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatagcctatgttctactcacattttaacctcttttatagtcatgtccaccttccctcctga

SEQ ID NO: 145015 - DNA, 601 bp, Human
atggtggttatacttacttaatactaagaaggaacttagtattgacacagatgaacacctcaccagagccagaggctcctcttcacagggttctcctgctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatrgcctatgttctactcacattttaacctcttttatagtcatgtccaccttccctcctgagtagagctcatctatgccaatggcctttaaaacatcaacatgccacatatatgttgtctagacctttcctctgtgctccacagtcatttatacaatttctatgtgacatccactggcatgtctttcagacagcttgacctttaaaagccccaaactgaatctcctccatctacttctcctccatctaaatggcttcctacagcagttagaataaaagacaagctctctgccatgtgacaagg

SEQ ID NO: 145016 - DNA, 601 bp, Human
gctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatagcctatgttctactcacattttaacctcttttatagtcatgtccaccttccctcctgagtagagctcatctatgccaatggcctttaaaacatcaayatgccacatatatgttgtctagacctttcctctgtgctccacagtcatttatacaatttctatgtgacatccactggcatgtctttcagacagcttgacctttaaaagccccaaactgaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcat

SEQ ID NO: 145017 - DNA, 601 bp, Human
agtgtatggtccaggtagcagtgtgatctagtatctctcatgctttaaagagccttcccttcccttcacatgcctataaatctatagcctatgttctactcacattttaacctcttttatagtcatgtccaccttccctcctgagtagagctcatctatgccaatggcctttaaaacatcaacatgccacatatatgttgtctagacctttcctctgtgctccacagtcatttatacaatttctatgtgacatccactggcatgtctttcagacagcttgacctttaaaagccccaaactsaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcatggggtggagtgaagctgcaggacaggtctcaaggggggactgataggacttagcgaatgcagagcaatggctgagaaccttcttctgtagctgttaatctgtttcttgctgcaaactg

SEQ ID NO: 145018 - DNA, 601 bp, Human
tccacagtcatttatacaatttctatgtgacatccactggcatgtctttcagacagcttgacctttaaaagccccaaactgaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcatggggtggagtgaagctgcaggacaggtctcaaggggggactgataggacttagcgaatgcagagcaatggctgagaaccttcttctgtagctgttaatctgtttcttgctgcaaactggtgtgttagagaggacacggtgagccttctgtgttttgtcaagtctctcttcacagctttgtccagaagcccacatggtgttgctggcatgcatgctgtaggatgccgtaagcgagcttctcccaaaatagtgtcaggatcttgcaacctttcaccacactagtgaggtcaggtagaaggccctggacccctgcctaaaatgggggattatatccactag

SEQ ID NO: 145019 - DNA, 601 bp, Human
ccacagtcatttatacaatttctatgtgacatccactggcatgtctttcagacagcttgacctttaaaagccccaaactgaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcatggggtggagtgaagctgcaggacaggtctcaaggggggwctgataggacttagcgaatgcagagcaatggctgagaaccttcttctgtagctgttaatctgtttcttgctgcaaactggtgtgttagagaggacacggtgagccttctgtgttttgtcaagtctctcttcacagctttgtccagaagcccacatggtgttgctggcatgcatgctgtaggatgccgtaagcgagcttctcccaaaatagtgtcaggatcttgcaacctttcaccacactagtgaggtcaggtagaaggccctggacccctgcctaaaatgggggattatatccactaga

SEQ ID NO: 145020 - DNA, 601 bp, Human
actaatcgacacctcgggtaccctgtgggtaagtccaggtgtgtgaggatgcaggcctagaatagggatgatcatggggtggagtgaagctgcaggacaggtctcaaggggggactgataggacttagcgaatgcagagcaatggctgagaaccttcttctgtagctgttaatctgtttcttgctgcaaactggtgtgttagagaggacacggtgagccttctgtgttttgtcaagtctctcttcacagctttgtccagaagcccacatggtgttgctggcatgcatgctgtaggatgccrtaagcgagcttctcccaaaatagtgtcaggatcttgcaacctttcaccacactagtgaggtcaggtagaaggccctggacccctgcctaaaatgggggattatatccactagagcaactggcaggcctgtaagaccttcgtcctcctctgttctctcttcatccttaacttcccatatggtctgccttggggtctctctcacccacccctgatcccctttccccagcatgtcttagcccatttctggttcctgctcaggtggttggctctgttctgcagctctgtgtttggtaatttttt

SEQ ID NO: 145021 - DNA, 601 bp, Human
aatgtccccagccagaggaatcattaatttatctgaccatccatggtgttcaacagcattcttgcttctttttgtttgtttgttgttttttgttttgttttgagatagtcttaccctgttgcccaagctggagtgcagtggtgcgatctcagctcactgcaacctccgcctcccaggctcaagcggttctcatgtctcagcctcccgaatagctggaactacaggcatgtgccaccaggcccggctaatatttgtatttttagtagagacagggtttcaccatgttggccaggctggtctygaactcctgacctcaagtgatccacccaccttggctttccaaaatgctgggattataggcatgagccacggtgcccagccatcagttgatgataggctataattgggccatcatggagaactcgatgccccctgtttattggaatcttcactctgaagttagcatccataaatttgagagaagagggagatttgggcagggcgaatcacaagtctctctcctcagtccttgcataagaatgcagaatctctgaagtggagggggaaatcaaggtgaataaatgctttaaaataagtaaaa

SEQ ID NO: 145022 - DNA, 601 bp, Human
cttgttcttcatctcagagcatttatgaggactgttctcctgaaagcccttgggcttttgtggcatatagagagatttgcaattctctgttatagctagctaactaggcttctgcctttcatatctttgcaaacataaaatcacattgtggaaaaagaaatgtgagttgttcagccctggaataccagggaatgacattctgtgcatagtaaaatgtgtgttggggagagcttggctagctcttattcacagtggatcagcttttcaaggcttcttcccaacatctatgttttgaggcccrtgttcagatcatctcataaaaaattaaatcactcatcatgaaagtgatttattaggtgggatctagcagcagcagcatctccatcagcctctccttggagcaccagtgaacttggccagagtcagcagagagcaaaatggtcatctctgcaatggtgtgcactgttgggacctagcccctggtgctgagcacacttccacggagggctcaagctgaaggtgactgagagagcacctgagaatttggatatgggggctgtttttttttttttgtagctagaacaggtaggaatcatgaact

SEQ ID NO: 145023 - DNA, 601 bp, Human
atgcagtccgtgctcttggagcgcatcatctgttggggaagatgatgaatggcaaatgctgatgaggtacaatatggtaaactctaaaatcagggtatgtatacattgctatgataacacaggtggaggagcaatcaattccaatttagggatcaaagaaagctagtgagacaggctccatttaagttgtgccttaaagcaggggtccactacccctgggccacaagccaataccagtccgtggcctgttaaaactgggccacacagcaggaggtgagcagcaggtgagggagcactaccrcctgagctctgcttcccgtcagatcagtggcggcattagattctcataggagcgagaaccctactgtgaactgcgcatgccagggacctaggttacacactccttatgagaatttaatgcctgatgatctgtcactgtcttccatcacccccagatgggaccgtctagtttcaggaaaacaagctcagggctcccacagattttacatgatggtgagttgtataattacttcattatatattacaatgtaataatagtggaaataaagtgcccaataaaagtaatgtgtttgaatcatcc

SEQ ID NO: 145024 - DNA, 601 bp, Human
ttggggaagatgatgaatggcaaatgctgatgaggtacaatatggtaaactctaaaatcagggtatgtatacattgctatgataacacaggtggaggagcaatcaattccaatttagggatcaaagaaagctagtgagacaggctccatttaagttgtgccttaaagcaggggtccactacccctgggccacaagccaataccagtccgtggcctgttaaaactgggccacacagcaggaggtgagcagcaggtgagggagcactaccgcctgagctctgcttcccgtcagatcagtggckgcattagattctcataggagcgagaaccctactgtgaactgcgcatgccagggacctaggttacacactccttatgagaatttaatgcctgatgatctgtcactgtcttccatcacccccagatgggaccgtctagtttcaggaaaacaagctcagggctcccacagattttacatgatggtgagttgtataattacttcattatatattacaatgtaataatagtggaaataaagtgcccaataaaagtaatgtgtttgaatcatcccgaaacttttccgccgcctcccctccagtcta

SEQ ID NO: 145025 - DNA, 601 bp, Human
ggaaaaatgtcttccacaaaaccagtccctggtgccaaaaaggttgggaaccgctgtcttaaaggatgtgcaggagtttctcagattggagatgaggtgggaaggaagtgactgcaggactggggtcaaggacagagtacaaagaagaggaacataatgagcggtaaggaccaagaacttagactgggatgcacacaccaaggaacaatccaaggaagggaatgcaaacatgaatgtgtgtggggagttctgggaaccaggtccagtatgcctaaagcatgagggaggggggtgcttaaasagcggagtggccgatgcagagtgtggcttttgaaggttttgccaaaagagtttggggcaatattttaaattggaatacggttatttaatcatttatttaaatctacttaacctactctaccttctacatggccatttctgcttgcatgagttgatgggaattagcattttgcatacagagatttaagccttttcctgccatcacataattcaggctgaagttggaatgaagataaacaagcatgtcatcatgtacagaatgacaagtacaacaataaaagcaagcactgagagctatgcg

SEQ ID NO: 145026 - DNA, 601 bp, Human
ctagttaggaatgagctataatcgatgaaaaaatgagggcagagcattccaggctgtggaggtaacttgggaacagtcaaagaaatatgaggggagtcatggaatgcttgatgagcttcaggtaactcacagcacagggtagagtgtgggaagaagaaagaaggaagcaagagcagaagctggagatagaaaaaggcttagtgatgaaaaaggtttgtatgccatgtgaaagacttcagattttatcctgaaggttatggggagtcttcgaatacatttaataatcacttttcaaatgtcraaacttaccttggaacagtggttggaggcaggaggatgtgttaggaggtgatggcagtgccgcacacagaggatgatcaggaagttagggggcagaactgaaggcagtggggatgacggtgggtcacggggaggggatgctggaaatgatttggaactagagcttggaaactaagaaggtctggggagccacagcaaggaggaagccatctctgagggttctcagttgggcaactgggcagacattgatgtcactaaagtagatggggcaaggagcagtccaggagagggataagggaga

SEQ ID NO: 145027 - DNA, 601 bp, Human
tgctggaaatgatttggaactagagcttggaaactaagaaggtctggggagccacagcaaggaggaagccatctctgagggttctcagttgggcaactgggcagacattgatgtcactaaagtagatggggcaaggagcagtccaggagagggataagggagaactaaaataataaggttttggatttgtttggtacaggaaacaaagagctctggggctccagggaaatgtggatgcacagagttcatgataaagtcagaggttcaatgttacccaggcttacctggtgtttcgtggctytctgtaagatgtcagccatggtgacacccctgtgtcttccctaacatagcagttcatccacatattctatctgtagtgtacctaatgctagagagagctcatggagtaatatgaatcacatacaaatttaaatttctgaaaatgtatatagtaacatgtggatccttgacttttgttaacttcattttgttgtctcatcagctattttcattgaactttcttctcagacttatttgtatttttcttatacggtactttatatgactttttaaaactggggttgtgccatatttcaaaatg

SEQ ID NO: 145028 - DNA, 601 bp, Human
gaagggggcgctttctggtggggcataaagagtaagggtttgtaagatgcatctcagtgaacctgaaatatttgtccctgatttatctctgttaacttcttgacaactgtgatgggctttgccttatggggatttatttttctctgtttttcaaactgaaaatgatttttaatattctttattctaaaagtcctacattcttattgagaagcataaacaatagagaaaaataaacagcaaaaagaaactaataattacataaaaagctcatcatacaaaaatcctactgcaaaaatacccktctagtttttttctgtgtctataagcacaatattaacaacaaaattagatcataccataactgggtttgatgccatgttattttattctataatcccccaatgacacctcgcatgatcaatgaatatacagctacatcagcatttttattggctatatagatttttataaagctttactaggatttattattacaaatactgttataaagtcatatagattcatctttgtacacttgtctgattattgcttctaaaacagccttattaaacattgaataaatacaaaagaatatatatac

SEQ ID NO: 145029 - DNA, 601 bp, Human
tactgttataaagtcatatagattcatctttgtacacttgtctgattattgcttctaaaacagccttattaaacattgaataaatacaaaagaatatatatactgtatataaaatgtaaaggacaaatatacaatgttgcttttttacgccactctttctatgttttgcttcttttcttcttcttcctttttggcttttgctaaataagacttttcccatttcattttttttctcttctctagtttggaaattatgtactctgtttctgttcttttaccagttaccctagaaattttaacrtcagttcttattttggtctaaaattaatatatttatgctaggcatggtggtgtgtacctgtagtcccagctccttgggaagctgaagtaggagaattgcttgagcccaagagtgttaagtccagcctgggcaacagagcgagaacctgtctctttaaaataaataaataataaataaaatgaacatatttactttcctttctcttagataactttagctacagtcactctcctcctgacatttcagtattttaattttatcttttataatcccacaattagacatacaatgattgtttta

SEQ ID NO: 145030 - DNA, 601 bp, Human
tctctttaaaataaataaataataaataaaatgaacatatttactttcctttctcttagataactttagctacagtcactctcctcctgacatttcagtattttaattttatcttttataatcccacaattagacatacaatgattgttttatactataatgcttatttagacttacctatgcattggcccattcttttctatacttcaaaccttccaacagaataacctccctcctttctaaagtatactccaccatgagggggacattcttttatggatgataaactcttctatttttstatgaaaatgccttattttgccttccttttttgaaaaacagcttttatgagatgtaatctgcatatcttaaattatctcatttcaagtggacaataaatgatttctagtaagtttaccactacaatataacgttataagatttccatcactctaaaaagaaatgttgggcccatttgtgccaggctgtcatccccagcctcaggcaattgctaatctactttctgtttctgtaaatttaccttttctggacattttgcataagcagaattatacattatgtgatcttttatgtctggatt

SEQ ID NO: 145031 - DNA, 601 bp, Human
ttacctatcatcttcttctgacaggtggaggttactttctagtttacccttatactgaggttgtagctgtgtggggtcccagatttatgtaggaatttcctattatgctttccacctcaggtatgagggcttctctcctgtctcattgcactatccaaacagaaactcaaaaacaccagttagttgatgcccccagggtaaaatctggctttatctctctggattccagcattcactttatttccagcattcattttatttgaccctgaggattttttattgtattgccagttcagtgatrtttttaaaaggatgtttttcatatcttctccagaagttttagttgtttcagaagggtggttcacagtaacatttgcaccataccgtcagaaatgtaaatgtcaaatgtctctttctttttaaggattaattcttaggtgtagaattgctatattaaaaggtatgcaagtataatatttagatgtatatatttccatattacaatggcttgttttctgttcaagaaaataaaacagaaaaacaagccactaatctcaagcatttgctgaatcccttttagatttgcctctcacatctacaa

SEQ ID NO: 145032 - DNA, 601 bp, Human
tttgcctctcacatctacaaaaggaaatatgaatgtggttaacatctggacaagagacaaaattagcaaacaaaacaataatcctccaaaataaaattatgtgaagtgtatagatggtaaattaggagttcagaaaaggctgaaaaatttaaatctgaccatgtcacacctggctagggaaatcttcagtggctgcccattgcctttagggtggtgttcagaatcctacaagttcccatataaccctgcatggtctggctcctgcctcttctctgtccttgtcgctcctcctagctcactrgctccaagctcactggccttatctgtgttcctcaaatgcactgaaacccttttcaccccaacccttacttcttatctgaatgtccttttctgcctcccaccaccccaccccactgcgtggctgacctgttcatccttctggtctcagcttacatgtgactttttaacttttactaatcttctagtgtaaattacctctggcacacaaacacatacacacacacaggcacatacagcgccccaccccccacccacccacacacacacacacatttctactcaaatgtccaggtaactggtc

SEQ ID NO: 145033 - DNA, 601 bp, Human
gacaagagacaaaattagcaaacaaaacaataatcctccaaaataaaattatgtgaagtgtatagatggtaaattaggagttcagaaaaggctgaaaaatttaaatctgaccatgtcacacctggctagggaaatcttcagtggctgcccattgcctttagggtggtgttcagaatcctacaagttcccatataaccctgcatggtctggctcctgcctcttctctgtccttgtcgctcctcctagctcactggctccaagctcactggccttatctgtgttcctcaaatgcactgaaacscttttcaccccaacccttacttcttatctgaatgtccttttctgcctcccaccaccccaccccactgcgtggctgacctgttcatccttctggtctcagcttacatgtgactttttaacttttactaatcttctagtgtaaattacctctggcacacaaacacatacacacacacaggcacatacagcgccccaccccccacccacccacacacacacacacatttctactcaaatgtccaggtaactggtcaacccagcatctcagggacagagactaaattcatgcatctcagagtgt

SEQ ID NO: 145034 - DNA, 601 bp, Human
tctgtccttgtcgctcctcctagctcactggctccaagctcactggccttatctgtgttcctcaaatgcactgaaacccttttcaccccaacccttacttcttatctgaatgtccttttctgcctcccaccaccccaccccactgcgtggctgacctgttcatccttctggtctcagcttacatgtgactttttaacttttactaatcttctagtgtaaattacctctggcacacaaacacatacacacacacaggcacatacagcgccccaccccccacccacccacacacacacacacatttctactcaaatgtccaggtaactggtcaacccagcatctcagggacagagactaaattcatgcatctcagagtgtctggtcgacctgaaagaaagctagagagtgggaatgagagaatcaaacctctctgaaagcatcctgttctttccctccacagcacttgttagaatgggattatctaatatctatctcctccactagagaacagaactatgtcctattccctgccatattctagaacttagctcagtgcctggtacatggtaaatctttattgaataaatggatttaaagatgc

SEQ ID NO: 145035 - DNA, 601 bp, Human
gtttccctgtaacattctgaacagctcactctttttactaggtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtaagtcttgctggtttcccactggcatacagggctatttgtatatttaaacagtaagtttgattaccttgaaaagcaagaaatctacctgttggtgactatrtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtgctaaaaaaaaaaaactcaaaaatctttaaggccaaaaagcaatggtgttggtcatttggtattctataagacgt

SEQ ID NO: 145036 - DNA, 601 bp, Human
tacattcctcatgaggtaagtcttgctggtttcccactggcatacagggctatttgtatatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacrgtgacccatttatatatcaatttctatgataccttaagctgtgctaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgg

SEQ ID NO: 145037 - DNA, 601 bp, Human
acagggctatttgtatatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtkctaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacact

SEQ ID NO: 145038 - DNA, 601 bp, Human
agggctatttgtatatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtgcyaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgt

SEQ ID NO: 145039 - DNA, 601 bp, Human
atatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtgctaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgtcctaagtgcttc

SEQ ID NO: 145040 - DNA, 601 bp, Human
ctgtgctaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagrcactgtcctaagtgcttcatacacattatgacactcagtgctcaggacagcaccagcagaaatcaagctaagtggcagagcaagaatttgaatacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaaatgga

SEQ ID NO: 145041 - DNA, 601 bp, Human
aaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgtcctaagtgcttcatacmcattatgacactcagtgctcaggacagcaccagcagaaatcaagctaagtggcagagcaagaatttgaatacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaaatggataaatattgtaagtatacacttt

SEQ ID NO: 145042 - DNA, 601 bp, Human
ctgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgtcctaagtgcttcatacacattatgacactcagtgctcaggacagcaccagcagaaatcaagctaagtggcagagcaagaatttgaayacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaaatggataaatattgtaagtatacactttcaatagttttattggtgtgatcttcaaaaaacaaggcagcatacttgccttcaaagatttttaatactgg

SEQ ID NO: 145043 - DNA, 601 bp, Human
ccagacactgtcctaagtgcttcatacacattatgacactcagtgctcaggacagcaccagcagaaatcaagctaagtggcagagcaagaatttgaatacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaartggataaatattgtaagtatacactttcaatagttttattggtgtgatcttcaaaaaacaaggcagcatacttgccttcaaagatttttaatactggcatgtgaaagtgagataaaacttactctaaaagattacaccacaggactgctattgccaggggaaaggttcaagaccttgtgataattcgagctgtccagtcttagctggggccacttcaccaacaagacctttgttctggtgattattccagcagaaactgagcatcaggggtgtaactaaatggattcctatatgggaaag

SEQ ID NO: 145044 - DNA, 601 bp, Human
gccacttcaccaacaagacctttgttctggtgattattccagcagaaactgagcatcaggggtgtaactaaatggattcctatatgggaaagagcttgtactaagagacatctaaaacttgtccctgttccaagatcacttactttttagtgtcttattttatagaagagatctttcttgaacaggtggctgtaaagtgaattttgtaaatcaaaatataattataccattgagttctgtagtaaaaatgaagctacattattgtagagaatactacctggtcccagaaacataatgaaartgctatataaggctacagcaagtcttaaattttattaataaaaagacaattttaggctggaacaataattatactcaaaatcaggactagaattacattttctagggtttaaggtttttctaagcatgtctctatctcaagtaaagtttcccttttaaaaccctaagcaggacaaggtgatttgtttgaaactgttaatatactagagatacctgggctattgatttgatactgtagtcaatacctgagctttattttccactcatggggttgcaaaagtatttctataatttccctttt

SEQ ID NO: 145045 - DNA, 601 bp, Human
ttagtgtcttattttatagaagagatctttcttgaacaggtggctgtaaagtgaattttgtaaatcaaaatataattataccattgagttctgtagtaaaaatgaagctacattattgtagagaatactacctggtcccagaaacataatgaaaatgctatataaggctacagcaagtcttaaattttattaataaaaagacaattttaggctggaacaataattatactcaaaatcaggactagaattacattttctagggtttaaggtttttctaagcatgtctctatctcaagtaaartttcccttttaaaaccctaagcaggacaaggtgatttgtttgaaactgttaatatactagagatacctgggctattgatttgatactgtagtcaatacctgagctttattttccactcatggggttgcaaaagtatttctataatttcccttttccttaagagtgaatttccactcttgagatggattgatttaaagggaattatatatagatataatttatatatatatatatacacacacacgcacgtgtacgcacacacacacacacacacgtatgtatgtatgtatgtatgtatgt

SEQ ID NO: 145046 - DNA, 601 bp, Human
ttctaagcatgtctctatctcaagtaaagtttcccttttaaaaccctaagcaggacaaggtgatttgtttgaaactgttaatatactagagatacctgggctattgatttgatactgtagtcaatacctgagctttattttccactcatggggttgcaaaagtatttctataatttcccttttccttaagagtgaatttccactcttgagatggattgatttaaagggaattatatatagatataatttatatatatatatatacacacacacgcacgtgtacgcacacacacacacacatacgtatgtatgtatgtatgtatgtatgtatgtatgtatgtatgtatagcatatacatatgctgttcagccactggaggttgaaggacttgggatggagatgagaatgaggcactggaggctgcaaaaatgtaggctctagaaccaagaattctgaagagtagctgaaggttgctacgtcggactgcgttagggacctccactggcatgcttgactgattttaatatagtttgctccacccgcataggtagtcctattcaggctgcctattttatatctgtgctcagtgttatatctcctt

SEQ ID NO: 145047 - DNA, 601 bp, Human
ctaagcatgtctctatctcaagtaaagtttcccttttaaaaccctaagcaggacaaggtgatttgtttgaaactgttaatatactagagatacctgggctattgatttgatactgtagtcaatacctgagctttattttccactcatggggttgcaaaagtatttctataatttcccttttccttaagagtgaatttccactcttgagatggattgatttaaagggaattatatatagatataatttatatatatatatatacacacacacgcacgtgtacgcacacacacacacacacaygtatgtatgtatgtatgtatgtatgtatgtatgtatgtatgtatagcatatacatatgctgttcagccactggaggttgaaggacttgggatggagatgagaatgaggcactggaggctgcaaaaatgtaggctctagaaccaagaattctgaagagtagctgaaggttgctacgtcggactgcgttagggacctccactggcatgcttgactgattttaatatagtttgctccacccgcataggtagtcctattcaggctgcctattttatatctgtgctcagtgttatatctccttcc

SEQ ID NO: 145048 - DNA, 601 bp, Human
tccacccgcataggtagtcctattcaggctgcctattttatatctgtgctcagtgttatatctccttccctttttgtgctttccgtcttcctctttcactcactagaaacaacccaattgcagtaaacagaggtgtcccttgctgaaaggaaacttctgcaccatactagaggcctgtcctataaaaggaggagaatggttcagatgactctgaagcccacccatctctaacattccaggctttatgagggggcagtgggcatctctggcagagaatcctgcagttcctggcctcctgtgrtcctttggattgatacctcactttgagttctctcccactccatgtgtcccttccttgttcctttgattctggcatctctttgattgtggccagcagaaagttcaaatccctttatgagttcctgccagtatttgtagtcaatcttttgttgggcatatgtcaccaaattgaaatgtgtatattgcattggcttgttttccaataattgtcatattttattgttcccacaaccagaggcttttgtattgatctcttcaaaatagtcaataagtgatacatcaaaaggaacaaatgacagat

SEQ ID NO: 145049 - DNA, 601 bp, Human
atacctcactttgagttctctcccactccatgtgtcccttccttgttcctttgattctggcatctctttgattgtggccagcagaaagttcaaatccctttatgagttcctgccagtatttgtagtcaatcttttgttgggcatatgtcaccaaattgaaatgtgtatattgcattggcttgttttccaataattgtcatattttattgttcccacaaccagaggcttttgtattgatctcttcaaaatagtcaataagtgatacatcaaaaggaacaaatgacagatatttaactggctstcccacaaaatcaaatattttcattgattggattaggaaaggctctctttagctgtcatagctaaggcaacaatgatctttggaaactatagctaatcatatttgttggtaactgctctgtaaagatttttgctgtattaactttctatgacatttctaataactctgcaaacataatgaagaaaaaaattccactgtacccctatgaaggttagattgcaaaaagaatatctaactgacacccagtacttaatcatgtgaaaggagaaaaaggtacaattttatttcagctctttaagg

SEQ ID NO: 145050 - DNA, 601 bp, Human
taaaaatcattttagttgaacagtagttttggaaacgcaggaaatggaaagtttaatggcaagtttggttctgcaagacatattttagaattcatttgggctggtagagatacatctagaggaagaaaaagaattgagaaagaagaggttattggaagagaaatgacagatgagaaaatctcctttattgcattgtttactttgttttaggtgaaatctcgtttgataaagatgggccatcttaattcaatgaacatatttcttagacaagaaattgacagaatgcaaagagtcatttcartactccgcagtagcctgagtgatctaaaattggccattgaaggaacaatcattatgagtgaggtgagctgttattacatcagtaggcatttccttctttgttgatgtttcttattcatgtgttttaactttttcttctccagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgt

SEQ ID NO: 145051 - DNA, 601 bp, Human
gaaatgctcagttttctacgtggatatttgaagggaggcctaatgtgttttggatgactggtttctttaatccccaaggtatgtgctcataggagatttggcaagcttggaatttgtgtattgttggatagtagcatcgtgtgataaatatataccatataaaacaatatggaggcgtagcttgctgggtgctgcacatagccattcaaaggcgaaagaacacaaataattcttctgtatttgttttacaaattcaatctgaagctcttcctatcaattctttacaatgtggtagcaaaayccttcctttttcttttcaccaacttcagcaaaccatcagtctggggttaggacacatgaaagagtaaaaagaagtttctctctaacttatagtttttaaatgtttgtgaaatatcaaaaatgaagcaccaaaagatgcaaaaattgtttccagggtttagaaaattatattggtttcaaaaatgactgtgacaaaagtattcagagaacttcaggggggtcttcccccactcagttttctagttttctttttcttttttcctgaaagagtgctttataattctgcttcatttattccttc

SEQ ID NO: 145052 - DNA, 601 bp, Human
gggaggcctaatgtgttttggatgactggtttctttaatccccaaggtatgtgctcataggagatttggcaagcttggaatttgtgtattgttggatagtagcatcgtgtgataaatatataccatataaaacaatatggaggcgtagcttgctgggtgctgcacatagccattcaaaggcgaaagaacacaaataattcttctgtatttgttttacaaattcaatctgaagctcttcctatcaattctttacaatgtggtagcaaaatccttcctttttcttttcaccaacttcagcaaaccatcagtctggggttaggacacatgaaagagtaaaaagaagtttctctctaacttatagtttttaaatgtttgtgaaatatcaaaaatgaagcaccaaaagatgcaaaaattgtttccagggtttagaaaattatattggtttcaaaaatgactgtgacaaaagtattcagagaacttcaggggggtcttcccccactcagttttctagttttctttttcttttttcctgaaagagtgctttataattctgcttcatttattccttccttctagaaatgtttactgagaaagttaatgg

SEQ ID NO: 145053 - DNA, 601 bp, Human
atatcaaattatacatagtattttataaagtccgtagcctttagagttgtaaagggcagcccccagatttcacttatctatttttctcccagaatttccattgagttaggggaggaacattttttattatgggtctcagattttgtgtgtctacttatgagtctctttcctccgtatgagcctcaatttgagtaagtcgtcaccaggtaatttctggctggggagcatgaagtaatagcatttaacttaataaggattgtttgaccacctcccatttgccagcccctctgctaggtacttycaatgaagagagatttgagacttggttcctgccctaaaggagcctataatctggttggtaagacagacacatcagcaaccttaatgtaatgtgataagtgccccactgtgtgagaactaagtgccatggtagcccagaggacagagagattaattctgccaagagcttcacacaggaagcagtgagtagggtttgcagaagcagggatgccaaaaaaagagcgggtgctttccaggtagaggcctgagcaaaaacaagtcttgttcaggggaacagggagaccagtgtggccagggctca

SEQ ID NO: 145054 - DNA, 601 bp, Human
tcacttctctgctctcttttcattctcttgacatgagggacaaattactttctgttccacctcacttggccaaatctggcaaataaagattacagctactccatacatgttcccagggagtgtgcaaacagatagagtcctttcccactggaagcctcgctggacactatttgacatcaacagttgatctcccaacatgaatgtatctcctgggttttatgtcctctaattcagtcctcttcaatgaagtaatttctttctttggttcaaaacatttaagtaaatggctttaaaaaaaaaaccctacataggcagggcgtggtggctcacgcgtgtaatcccagcactttgggaggccgaggcgggcggatcacgaggtcaggagatcgagaccatcctggctaacacggtgaaaccccgtctctactaaaaatacaaaaaattagctgggcttggtggtgggtgcctgtagtcccagctactcgggaggctgaggcaggagaatggcgtgaacctaggaggcggagcttgcagtgggccgagatcgcgccactgcattccagcctgggcaacagagcgagactctgtctcaaaaaaaaaa

SEQ ID NO: 145055 - DNA, 601 bp, Human
acataggcagggcgtggtggctcacgcgtgtaatcccagcactttgggaggccgaggcgggcggatcacgaggtcaggagatcgagaccatcctggctaacacggtgaaaccccgtctctactaaaaatacaaaaaattagctgggcttggtggtgggtgcctgtagtcccagctactcgggaggctgaggcaggagaatggcgtgaacctaggaggcggagcttgcagtgggccgagatcgcgccactgcattccagcctgggcaacagagcgagactctgtctcaaaaaaaaaaaaaaagaaaaaagccctacatatttaagtaaaacacaatgcagtttgtataaaggctgtagtttcatcacaaatatatatgcagtaatcaaaatcacctggaccataaggaagactatagaacacctgcaaaggctttattcacgtgtgattgctaatgtttataattgtataatgcaatgtggcatctgatgctgtttagtgtgtttccctcattgaccctctggtgactgctccacaggcctaagtgactttgaggtccgtgctacctcaaggacaagtgacatgccttgcttgcccctggtc

SEQ ID NO: 145056 - DNA, 601 bp, Human
aaaccccgtctctactaaaaatacaaaaaattagctgggcttggtggtgggtgcctgtagtcccagctactcgggaggctgaggcaggagaatggcgtgaacctaggaggcggagcttgcagtgggccgagatcgcgccactgcattccagcctgggcaacagagcgagactctgtctcaaaaaaaaaaaaaaagaaaaaagccctacatatttaagtaaaacacaatgcagtttgtataaaggctgtagtttcatcacaaatatatatgcagtaatcaaaatcacctggaccataaggamgactatagaacacctgcaaaggctttattcacgtgtgattgctaatgtttataattgtataatgcaatgtggcatctgatgctgtttagtgtgtttccctcattgaccctctggtgactgctccacaggcctaagtgactttgaggtccgtgctacctcaaggacaagtgacatgccttgcttgcccctggtcagcacctgagcttctgctgtttgtagcactgctgtttgccttatgggtggcctgatattttgtctgtcatatttgaagaggctgagtcagccaccgtggagctcatc

SEQ ID NO: 145057 - DNA, 601 bp, Human
taatgggattgctgggtcaaatggtatttctggttctagatccttgaggaattgccacactgtctttcacaatggctgcggagaaataggaatgctgtcacactgttggtggcaataaattttctgaaaagcttccttggtcattctaatgagtgaagaaccttgaccttggacctttgctacccagtatgtggtccaccagccagcagcgtctgtatcacctgggagcttgattgaaatgcagaatttcaggccccactcttgatctacctactgaatcagaacatgcacttttagtacatccccctcctcaggtgattcccatgaacattaaagtctgagaatccctgccttaaaacaaatctggtgcctgggttccacctccagagattctgattgtatttatctgagctgtgacttgggaattgggagttttagaagattcctgggtgtctctaattttcagcagtttaatgtccctgccttacagcaaagaaccggggaaggtgcttggtgcatttttattcaacagggttgaccaaccctatctttgtttaatgatttctgaccttttgtttaatttaccaatgaactacatttg

SEQ ID NO: 145058 - DNA, 601 bp, Human
aaaatcagcttttcattccattagacttgctatcagtctacaagaaagatggccattcattttttaaattcaataatgaacagttcattggatttgctaccctttgagtgctgcaaggatcatgctctctttaggaagcagagacaaaatgatcaagacttgaaaggacatgtatcttctctacgttctctgaacatgggaatggcccattaacgtttcctatctccactctcagactgcaaatatatttaacattttcctttcttaatagtacaaggtaatgtaagtgtgttctagagtycacctcctggcattgctaagcattaggagacttatggctgaagtcagctgcccaacatcattcccattagggagtgcctctccccattagggagaagataagacatgatgtctccttattttcactagagtttttcagagctctgatgatggcttaagtctttgtagcagatgtgctaaataagcgagaatccagctctatcctcctctggcacctatgacattgtcttggtcattgtctagccacaaggaatgaggtcaaatttgcagtttagctggaactttaaatgttataggaaaa

SEQ ID NO: 145059 - DNA, 601 bp, Human
ccagcctgagtaacatagcaagaccctgtctctaaaataataaaaaaggaagtcaacatactcacatgctgatcaaatcccctgaagtgactccacacagagcacaggcattgaccagccattgctaccaggcaaacttccactacatttcctgcctcctatacttaacattttgtatcataaaaccagtctctcctactaggcactcggtttcatgaaactatagctttataagaatcttctataaaagtccttcactcagctgctttggttgattggtcaactcttcttttgggttaaygcaaaggcccttctttaccacacctaatcctattttagtgggcactccgagtaaatgtgtcaagatgcaaataaagccaaaccatttgaatttttatttaaattttcagtggcttctctccatccacagacttaagtccaaactctgaccttgaaaaatcactgctgtatcttcgttctaaccttatctgctgtcactgactccacactctctcagccatccatgtgtgtgtgtgtgctgttcctttacctggaattgccccatctggcaaactcctatgtagctctcaagagtcatctt

SEQ ID NO: 145060 - DNA, 601 bp, Human
aaaaccagtctctcctactaggcactcggtttcatgaaactatagctttataagaatcttctataaaagtccttcactcagctgctttggttgattggtcaactcttcttttgggttaatgcaaaggcccttctttaccacacctaatcctattttagtgggcactccgagtaaatgtgtcaagatgcaaataaagccaaaccatttgaatttttatttaaattttcagtggcttctctccatccacagacttaagtccaaactctgaccttgaaaaatcactgctgtatcttcgttctamccttatctgctgtcactgactccacactctctcagccatccatgtgtgtgtgtgtgctgttcctttacctggaattgccccatctggcaaactcctatgtagctctcaagagtcatcttccacttcatcttctcaattacgctttccctgagttgtcttcccgagtagttaactttgttcacgccttttttcataatgacaacgttgtgtcaatgtccagcctcccccacactccctctggactgagctccttgaatgtggggcccatggatggcctcttcatctttgtggtcatcccac

SEQ ID NO: 145061 - DNA, 601 bp, Human
ctattttagtgggcactccgagtaaatgtgtcaagatgcaaataaagccaaaccatttgaatttttatttaaattttcagtggcttctctccatccacagacttaagtccaaactctgaccttgaaaaatcactgctgtatcttcgttctaaccttatctgctgtcactgactccacactctctcagccatccatgtgtgtgtgtgtgctgttcctttacctggaattgccccatctggcaaactcctatgtagctctcaagagtcatcttccacttcatcttctcaattacgctttcccygagttgtcttcccgagtagttaactttgttcacgccttttttcataatgacaacgttgtgtcaatgtccagcctcccccacactccctctggactgagctccttgaatgtggggcccatggatggcctcttcatctttgtggtcatcccacatagtgcagggcttggtacatggtggccacttcagcaaggtttgacagagcaatgaaagcatgaccatatgagtgcctctccaagtgtctcatttaataatggggagaacttgactcagtaaagccaggctaggacctattctttcttt

SEQ ID NO: 145062 - DNA, 601 bp, Human
gtttttaaagcagattgcaacaaggcttcaacatctcttctttttttctttaaggcttcctcacagcaatgaggcaagaagtgacccgtgcccacaaaggctgggcactggacactgtgaccatccacaatgaagttctgagacagaccaaggaggagatcacgtcaccccctggggtaggcgttgctgggcaatagcagggaccattctggagccagagctgaaatttcaagttctgcttaaaactgagctatgagtgccttggttaggtccatttgctttgcagtgagggttccctccrtcatagccagaagacatcagtgccaaagcctcccccatctgccagagtggaagattaatgacaaggtctaatgagctcttagaactccgtagactacatttctacaaaattacaagttacacttgtgtttgctaaaaaggctttttggccaagtgcggtggctcatgcctataatcctagcactttgggaggctgaggcaggaggattgcttgagcccaggagttcaagaccagcctaggcaacactgggagaccctgtctccaccataaacaaacaaacaaacaaacaaaaactagcca

SEQ ID NO: 145063 - DNA, 601 bp, Human
tagccagaagacatcagtgccaaagcctcccccatctgccagagtggaagattaatgacaaggtctaatgagctcttagaactccgtagactacatttctacaaaattacaagttacacttgtgtttgctaaaaaggctttttggccaagtgcggtggctcatgcctataatcctagcactttgggaggctgaggcaggaggattgcttgagcccaggagttcaagaccagcctaggcaacactgggagaccctgtctccaccataaacaaacaaacaaacaaacaaaaactagccagtcrtgatggcacacatctgtagtcccagctatttgggaggatgaggtgggaggattgcttgagccccggaggttgaggctgcaataagcagtgatcacaccaccagactccagcctgggtgacagagtgagaccctgtcttaataaataaataaataaataaggcttttctacacatctccagctactgctgtgggctactcacagattctactgtaggcagcagagcagtgctgagggcagcagagatgaaggggactagcaggttggagccaggggccagttccaggggtgtcccctttga

SEQ ID NO: 145064 - DNA, 601 bp, Human
aggttggagccaggggccagttccaggggtgtcccctttgagtggaaaggaacatggctggggggaagagcccccacttcctggacactgatctgctcaatgaatgtgggaaaattctttaacttttttgagtcttcacatcttcatctgcaaaatgagcatgataattcaaccttattaaaggagttgtggccaggcacggtggctcacgcctgtaatcccagcactttgggaggccaaggcgggaggatcacttgaggtcaggagtgtgagaccagcctggccaatatggtgaaacccrtctctactaaaaatacaaaacttagcctggggtggtggcaggctgtaatgtcccagctacttgggaggctgaggtgggaagattgcttgaatacaggaggcggaggttgcagtgaactgagatcccgccactgcactccagcctgggtgacagagcgagactctgtctcaaataaataaataaataaaattttaaaaaaggtagttgtgaagatttaaatgtgatcatttaggtgtggtgctggaccccatgtagactctcagtaaatcagtctccctttccctttctctgattttcatt

SEQ ID NO: 145065 - DNA, 601 bp, Human
ggtaaccatatgtcctgattttctgggactgcccatggttttactgtcaaatcatgtgcctccgtttttggttcaaaaaacacagtcctcacacggtgagcccccacagggggattccagaaacactttgcaatgaatcttactgtctttcgttctaatcagcatttacttccctgatccgatcctcactggagatggaaaaacggtcaccatcctctacatttacctatttggtgagctggcatgattgttggagcctcccctgtgattctccttcagcctttctttttttagtgaatayactgcctacaggatccagtttaaactcttcagcttagcacccagatccttccacagtcaacccctgacttcttttacaaccatcgagccctctgataaaggaaatactggggcttttccggctcgccctgcctttctttgtagtgttacttctgcctgtgatgcctacgctctctcctctgtctttccaaacacagccccctgctgcaagcccatcaaggcccatcaaggccatcccctctacagaggctcctgagcactccagccacagggaccttgcctcagaattcaccgccctcac

SEQ ID NO: 145066 - DNA, 601 bp, Human
tgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctsagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtga

SEQ ID NO: 145067 - DNA, 601 bp, Human
ccaaaatcttataaaagaagcaaaagtgtctggcaattccatacctttgaactgaaccaggtaaagaaggaatcacagacataaagtcatagccttttatttatttatttttttccctggagatagggtctcacaattttgcccaggagacttgaactcacaatcttccagcctcagcctctcaaatagttgggactacaggtgcacagcactgcacccagccaaattcatattgtttaaatagtctcctctgaatctgtgtgtgtgtgtgtgtgtgtgtgtgtgtgtgtgtgtgtgtgtraaaaaccgcagcctcaaactgtcttatgggtagtcaccagagtaacagatctcagattccactaaaatagctaaatgtatataaaatgtttatatcacacataaatgtttctgaattacaaaagcatcattggggctctagaggaaaatgaaaacacaagtcccagaaatctgaaaaatgaaaaacaggggtgaaagataatgagaagtacagtcacatctaaagtcaggtcatctgggaaccctgcccactggatgccataaggtcgaccacagttctaatcctgtcctcttctcctcc

SEQ ID NO: 145068 - DNA, 601 bp, Human
gtcttcgtcagtttaggctgccataacaaaatatcacatacatggtggcttaaataacagaaatgtattttctcacaattctggaggctgtaaagtccacaatcaaggcctattaggtcctgttgagagccctcttcctggcttgtatgtaggcagccacctgtgtcctcacatgacctcttctttgtgctcatgtggggagagatctctctctctacctcttcttctaaggccaccaatcctaccagattaggaccccaccggtatgacttcctaaaggctccatctccaaatacagtcycattgggggttacagcttcagcttcaacttatgaatgggggaggggtggacacaattcagcccataacacaaccctctactcttccttaattagctttcttgtaatgagttccaatatggaagggaagagataatcaccaaaaatattctcagaacgaaaagacaggagtttccagattgaaagggctgaccaagtgcccaagaaaatggatgagaagagatccacaccaggcacatcatcatgaaattgtaaaaacacaggaaggtagaaggaaattaaacaatgcctcacaattctaa

SEQ ID NO: 145069 - DNA, 601 bp, Human
accagtcaaaaaggagaacacacgcgcaccagcatcatgttaatattctcttgcaacgcatgcagttcacctttatgaagctgaggtcctagcttgacctcaacctgtcttcgtcagtttaggctgccataacaaaatatcacatacatggtggcttaaataacagaaatgtattttctcacaattctggaggctgtaaagtccacaatcaaggcctattaggtcctgttgagagccctcttcctggcttgtatgtaggcagccacctgtgtcctcacatgacctcttctttgtgctcatrtggggagagatctctctctctacctcttcttctaaggccaccaatcctaccagattaggaccccaccggtatgacttcctaaaggctccatctccaaatacagtcccattgggggttacagcttcagcttcaacttatgaatgggggaggggtggacacaattcagcccataacacaaccctctactcttccttaattagctttcttgtaatgagttccaatatggaagggaagagataatcaccaaaaatattctcagaacgaaaagacaggagtttccagattgaaagggctgaccaa

SEQ ID NO: 145070 - DNA, 601 bp, Human
acaatccctttaatgcagagcccagctttaggagagctgctcccacgtggtggacagaaggggccactggccaaccctagttgcattctggtagaaagaaacacaagttttaaagaaaaacggaaaggtctgaacccggcgtcactattcactagttcattcagtgagccagggcaaatgatgtgaaatttctgagtgccaacctcgcttctctttgggagtgaaacagaacctacctcaaagggctgttttgaggattcttgagaacagttcccacctatgaagacacagcctggtgggktagattccaggaaattcagtgatccttctgaccaaaattatactttttgtcatctcaggaaataatctgttccgagaaattccagaatgtaggccgctttcagtgacctgcctttagcctgtgaatcctcagactcaccagtgctcagtagagcagtggggttctgacagttccttctaaagcacttgtgcctacctcttccgggagagcacagcaacattcagcacagcaaaccagagcagcacggctcagatatgaaggcctgcttcctgcaattctctgtcctacaaacatatcaga

SEQ ID NO: 145071 - DNA, 601 bp, Human
aatgcatgcgcacacacacacacacaaaatggtatctctgtatactcaaaactcatctcctcaaagtctgtccatttctatccatcattgactggcaatgtatgtgtcatggatgtcacactttttactatcagaactcccagaagtagggactttatcagtcatttctttgtaagggtctacacacaaaagccacttgatattagcggccagccaattctatggtctcccaaatatagggaataaaaaaggaaataagttccttaatatcttgttttatatttgaaattcagcaagtatsgtatttacccccaccttcctcacctcagccttctatctccatccactgaaaaactggatcatgaaatttaagcagaagggaaatctggtaatggtaagattaagaaaagggaagaagtctgaagaatccaaaatatggaggagaaaataagaaagaatgatccaagtaaaagactaaaaggaaaatttaagccaaaaataataaaaaggaataaaatacataataaaatacctgataaggcaatgtcaggtgataaccaagaaaaagaagtctgtaggaaataaatacaatttctttttt

SEQ ID NO: 145072 - DNA, 601 bp, Human
aatgggctaaatgtaatacctgaaattatgaaactactagaagaaaacatagagaaaatgcttcataatactggtcttctgggcaaagattttttggataagaccacaaaagcaataaaagcaaaaacagacaaatggaattacatcaaactaaaaatccatcaaactaaaaatgtcttcacagcaaagaaaataacagcgtgaagagacaacctacagaatgggagaaaatatttgcaaactatgcatctgagaaggtgttaatatccagaatatattatataaggaactcaaacagctmaataccaaaacaaaacaaaaaacaaaacaaaacaaaacaaagcaaaacaaaacaaagcaaaacaaaaaaacctgatcttttaaatggtcaaagggacctgaaccaacttttcttcaaagaagacaaacaaatggctagcagttatttgaaacaatgctcaacatcagtaatcatcagggaaatacacatcaaaaccacaataagagaggatcatctgaggccagagtttgagaccagcctaggcaacagagcaaaaccccatctgtacaaaataaaaaattagccaggcaggatggcgca

SEQ ID NO: 145073 - DNA, 601 bp, Human
tgtacttttcattaatttataaatttcctataataatcatgtattatttttgtaaccagtgcagtgatctttgtggttaaacacaaactgccttttccaagccaactagggaaattccattcccttgtcagtgactgtatcctaggccaatacgtggagatgtctggtgtaggggcttccaggaaagatttccttgctccttacaggaaaaacaagagaagaactgttttcttttgaatactgtcatgaccggtatgatttatttatcattcaatcatttacctaaaaacacctactatgsagcaggcactgtggctaatgaaaagatgtaatttttaatctttgaaacattttatagtagactggaaaacacacaactgagtggggtagcagatatgcaaacaaaaattccaataataatgtgaaattgatctaatggcagcacacacacataacgtgggggcacaaagatttcacaaaccagaagagtctcgagggctgattactgttcaagcaaagaaaaggggagcatcatcagacccagtgtccagccacagcactttcctggcacgtgcaaaggctcagagtttagtgaggcatg

SEQ ID NO: 145074 - DNA, 601 bp, Human
atgattgcaattttcttctatacacacaaacatatacatatacaaccaaaaactggaaagcaaacaccacaatgttaacaacagttttctttgtgtaatgccagattattttattgtacttttcattaatttataaatttcctataataatcatgtattatttttgtaaccagtgcagtgatctttgtggttaaacacaaactgccttttccaagccaactagggaaattccattcccttgtcagtgactgtatcctaggccaatacgtggagatgtctggtgtaggggcttccaggaaakatttccttgctccttacaggaaaaacaagagaagaactgttttcttttgaatactgtcatgaccggtatgatttatttatcattcaatcatttacctaaaaacacctactatgcagcaggcactgtggctaatgaaaagatgtaatttttaatctttgaaacattttatagtagactggaaaacacacaactgagtggggtagcagatatgcaaacaaaaattccaataataatgtgaaattgatctaatggcagcacacacacataacgtgggggcacaaagatttcacaaaccagaag

SEQ ID NO: 145075 - DNA, 601 bp, Human
cttaagccattagtctaatttcagaaaaatatgacttaatggtacggaaaactgcttatgttagacttaaatgtaagactataaaaagctatatacaatatgattgcaattttcttctatacacacaaacatatacatatacaaccaaaaactggaaagcaaacaccacaatgttaacaacagttttctttgtgtaatgccagattattttattgtacttttcattaatttataaatttcctataataatcatgtattatttttgtaaccagtgcagtgatctttgtggttaaacacaaamtgccttttccaagccaactagggaaattccattcccttgtcagtgactgtatcctaggccaatacgtggagatgtctggtgtaggggcttccaggaaagatttccttgctccttacaggaaaaacaagagaagaactgttttcttttgaatactgtcatgaccggtatgatttatttatcattcaatcatttacctaaaaacacctactatgcagcaggcactgtggctaatgaaaagatgtaatttttaatctttgaaacattttatagtagactggaaaacacacaactgagtggggt

SEQ ID NO: 145076 - DNA, 601 bp, Human
agaatataactatgatggaataaatctcacccaacagacttggctgagataatattataaattattataatactataaactaaacaaactaatatccaaaacagcaaactgaaaatagaatgccataaattatatggagttttacacttaacattagtacagcttatgtactttttgtatatcacaataaaaaagcaaaaataataatgccaataatagatgtgaataaacaatatacatatcaagaaacacggatttcttctttcaacaaacatctactaaatgctgactaaatgaaaartaacactacaagtcaaaaaagcagagtgaaaccacttttgactataaaatcagtgattaaaaaatacttcacagattgcttgagcccaggaagctgaggctgcagtgagctatgattataccactgcactccagcctgggcaacagggcaagatcctgtcttgaaaaaaaaaaattcccagtactggcaagaatacagttaaacagccactcatatgcaggtttctggtaatgtaattggtccaagttttctgaaagataatcagagaagtatatcaaaaaactttgaatgtgtttatac

SEQ ID NO: 145077 - DNA, 601 bp, Human
tgatatgtaccagtcttaccagacaaaaaaagattaaatgagataaatattaacaacagcagttgtaactgttaataaataacacaggaaagtatcatttacttgaactctaagactcctctctctcacacacacacacacatacacacacacacacacacacacacacaaacatacgcatgcgcacacgcacagagagagacacgcacacacacagaaaaaataaatctgagccaaggaataagggagaaagcataaaaaggaaataatttaatggttcttctaaatactgaaaaaaaaagattttgatatctagaagaacatgaagataaataaaacggtatgttgccaaagagaaggattgtgcaaaaaaaccatagacatgtaataaataatataaaggaattgagaaagaaataatttatttctcagtcagaaccaaaaatgaagtctctatgtaattaggagccctagggagaatataactatgatggaataaatctcacccaacagacttggctgagataatattataaattattataatactataaactaaacaaactaatatccaaaacagcaaactgaaaatagaatgcca

SEQ ID NO: 145078 - DNA, 601 bp, Human
cccagtacagtttataacttgaaatccaaacatatcactagcatactgggttctaatctcagctctgatccacacagcactattaacagtatggcccaaaatatttcacttccctctaaatgaaaaacacaatgatatgtaccagtcttaccagacaaaaaaagattaaatgagataaatattaacaacagcagttgtaactgttaataaataacacaggaaagtatcatttacttgaactctaagactcctctctctcacacacacacacacatacacacacacacacacacacacacacaaacatacgcatgcgcacacgcacagagagagacacgcacacacacagaaaaaataaatctgagccaaggaataagggagaaagcataaaaaggaaataatttaatggttcttctaaatactgaaaaaaaaagattttgatatctagaagaacatgaagataaataaaacggtatgttgccaaagagaaggattgtgcaaaaaaaccatagacatgtaataaataatataaaggaattgagaaagaaataatttatttctcagtcagaaccaaaaatgaagtctctatgtaattaggagc

SEQ ID NO: 145079 - DNA, 601 bp, Human
aacccagtacagtttataacttgaaatccaaacatatcactagcatactgggttctaatctcagctctgatccacacagcactattaacagtatggcccaaaatatttcacttccctctaaatgaaaaacacaatgatatgtaccagtcttaccagacaaaaaaagattaaatgagataaatattaacaacagcagttgtaactgttaataaataacacaggaaagtatcatttacttgaactctaagactcctctctctcacacacacacacacatacacacacacacacacacacacacacaaacatacgcatgcgcacacgcacagagagagacacgcacacacacagaaaaaataaatctgagccaaggaataagggagaaagcataaaaaggaaataatttaatggttcttctaaatactgaaaaaaaaagattttgatatctagaagaacatgaagataaataaaacggtatgttgccaaagagaaggattgtgcaaaaaaaccatagacatgtaataaataatataaaggaattgagaaagaaataatttatttctcagtcagaaccaaaaatgaagtctctatgtaattagga

SEQ ID NO: 145080 - DNA, 601 bp, Human
cagaatacacattcttctcaactgcacatcaatcattttccagtataaatcatatgttaggccacaaaataagtcttttaaatttaagagtatcaaaatcttgtcaagtatcttttctgaccacaatggtataaaactagacatcaataaaaggggaaaccttgaaaactttacaaatacatagaaattaaacaacatgctcctaaacaatgagttaatgaataaatttaaagagaaatttaaaaatatcctgagacaaatgaaaacggaaacataacataccaaatcctatgggatagarcaaaaacaattctaagagggaagtttatagcaataaatgccaactctcaaaaataacccaaagcccaaactttgagaatgatctattaaatgcaaataccctgagaaaggatatcccttttattaaacattaattaatattttatgagaaacttgttttgttgttgttttgttttgaacagatggctcttcctctgttgcccagactggtgtgcagtggcacaatcatagctcactacagcctcaaactcgtgggctcaagggatcctcctcctcagcctccccaggggctgggactaca

SEQ ID NO: 145081 - DNA, 601 bp, Human
agtttaacaccctattttcagcaatggacagatcatttagacagaaagtcaacaaagaaacatcagatatgaactgtaccctagaccaaatggacctaacaaacatttacagaacattctatccaacaggtacagaatacacattcttctcaactgcacatcaatcattttccagtataaatcatatgttaggccacaaaataagtcttttaaatttaagagtatcaaaatcttgtcaagtatcttttctgaccacaatggtataaaactagacatcaataaaaggggaaaccttgaaaaytttacaaatacatagaaattaaacaacatgctcctaaacaatgagttaatgaataaatttaaagagaaatttaaaaatatcctgagacaaatgaaaacggaaacataacataccaaatcctatgggatagagcaaaaacaattctaagagggaagtttatagcaataaatgccaactctcaaaaataacccaaagcccaaactttgagaatgatctattaaatgcaaataccctgagaaaggatatcccttttattaaacattaattaatattttatgagaaacttgttttgttgttgtt

SEQ ID NO: 145082 - DNA, 601 bp, Human
tatttattgatcatctgccttcaagcatctgtttaacaaagcacatcctgcaccgcccttaatccattccactctgagttgacacagcacatgtttcagagagcacggggttgggggtaaggttatagattaacagaatctcaaggcagaagaatttttcttagtacataacaaaatggagtctcctatgtctacttctttctacacagacacagtaacaatctgatctctctcgcttttccccacaattatatgtcagcctctcccatgccttagtcatgattaaaaagctgcagcttttgtttatgccaacatctgcaccagtactagtcctctcatccagtaccggtcagggacccgtcgcagcgagagcacttgcaggccaacacgagaggggagcctgtacaaagcaaccacccggagaaacggcaagcactccagagatcagccacccgagaactgtgagagtgcacatttattactttggaaatcataaaaacttcaaaacagcaaatgtgtctatactctgtttcaattatttcacagaaaaataagatacttcagaaaaattccaatcctgattctctagtgcataaactgc

SEQ ID NO: 145083 - DNA, 601 bp, Human
acatgctgcatccctgccctgctgtctcctcagggccccctcagaacagggctgcacacactgctagttgcccacccagcagccctaagctctccatttcctctttgttaagagttttgtccaggaatctcaaggccatatgtcttagggagactgggatatccgccagtgccaggggtgaatcttgattcacacagagcaggtaatttcaaatgttttgttctcagggcccatttacatccttcaatgttactgaagaccccaaagagttttatttatatatatatgtgtgtgtgtgtggatgtatgtgtatatatatatatatctatatatatatagatatagatagatagatagatagatagatagatatttaccaccagaaactaaaactgagaacaattaaaaagacaaaatatacaaacacacattccattagctgtcagagagaggtcatcatcatctatcatgtaacctcttgacaacgccaccgcacactagtgagcgaatgcgagtcgaaaaggcaaatagcagcttagcattattataaaaatagttttacccttgtgaacctcctaaaagggtctcggggaccctgggc

SEQ ID NO: 145084 - DNA, 601 bp, Human
ttcttatgattctgcctagtgtatgtacctaaattcatttcattactagctcttagagaaatactgtttagcatttttaagaaataaaaaaggtaaatgttttataacatatttcctgaaaactcaggatgttaacaagtattttgtgcatacacgcacagcatatactaatgcagcaaaagcaattggcatgaaaaatcagaaggaaatccactttttccatttcttgcataatgtatcttttagtgcatttacccagtccctaaggaatcaaaacaaaccatgatttcaccttctccamgtatgcagactaaaaacaacagaagctgttagatccctcagtaagtatttccaggagaaaataaagaaattaaataaagaccttcagaaattcctatgcagaggggactaaagcaaagtcgtatgagcagagagatgcagacgctggaacagaaggcagtgtccagtgaaggacccacacatgcttgatcctgtccctgtttcctgccaggtgggagcggatccttcagaagcaggaagaggtgaggggctgggataaagtaccaagggaaaccagccatggggccatgcaaacatccaa

SEQ ID NO: 145085 - DNA, 601 bp, Human
tgtactacttttttatcgcaggtaatctacaaacctattagacaattgacagctgactatattttttgctcaataccaaaatcctttatcttgctccaaatgtaagtccttgactttcttatgattctgcctagtgtatgtacctaaattcatttcattactagctcttagagaaatactgtttagcatttttaagaaataaaaaaggtaaatgttttataacatatttcctgaaaactcaggatgttaacaagtattttgtgcatacacgcacagcatatactaatgcagcaaaagcaaytggcatgaaaaatcagaaggaaatccactttttccatttcttgcataatgtatcttttagtgcatttacccagtccctaaggaatcaaaacaaaccatgatttcaccttctccacgtatgcagactaaaaacaacagaagctgttagatccctcagtaagtatttccaggagaaaataaagaaattaaataaagaccttcagaaattcctatgcagaggggactaaagcaaagtcgtatgagcagagagatgcagacgctggaacagaaggcagtgtccagtgaaggacccacacatgct

SEQ ID NO: 145086 - DNA, 601 bp, Human
ataaagacatcaccccacaggcaaagaaaaaaggaaaaagtattatagtttataaatgtgaataaagatggacagtacttgatgaatacaacaaaattttgcaaattgttgaaatagtatgtattttctgtttgtttgtttttttaactgagttctctgtctggaaatattaaaaccacccaccaggatgggcagagataacagtcctagcacttgctccctccttttccttccagtcctcaaataatgactccatttttccagtcctggctctaaggaggggaaaatccaaaacctgctktctggaccccctatcttacctgtacggctactgctttgccccagagggctttgtcacaaagagggagagacgttcaattcattattcacggaggaataagacagtgtcacccgaagcagacatataaggtggcttccgtgcagctccaaaaaatgcatgccttgaaaaatggggctgattcttcagatttatggtaatttcaacttttttcacagatgtactacttttttatcgcaggtaatctacaaacctattagacaattgacagctgactatattttttgctcaataccaaaatcc

SEQ ID NO: 145087 - DNA, 601 bp, Human
tgcagggacgtggatgaagccggaagccgtcattctcagcaaccaacacaggaacagaaaaccaaacaccacatgttctcactcataagtgggagtcgaacaatgcgaacacatggacccagggaggggaacatcacacaccggggcctgtcagggggttgggggactaggaaagggataccattagcagaaatacctaatgtagatgacaggttgatgggtgcaggaaaccaccatggcacgtgtatacctggctaacaaacctgcacattctgcacatgtatctcagaacttaaaatawaaaaaaaaaaaaaaaacttccagatacacatttaccataaagacatcaccccacaggcaaagaaaaaaggaaaaagtattatagtttataaatgtgaataaagatggacagtacttgatgaatacaacaaaattttgcaaattgttgaaatagtatgtattttctgtttgtttgtttttttaactgagttctctgtctggaaatattaaaaccacccaccaggatgggcagagataacagtcctagcacttgctccctccttttccttccagtcctcaaataatgactccatttttccag

SEQ ID NO: 145088 - DNA, 601 bp, Human
gctctcttaatctagatccctagaggtatctgagctcatgttcttaataatgtaaggtgtttctctcaacattttaaatcaatatttttaaatatttcactccactctcttcttccttacatggtttctgaggagaagttgaatgttctgctcctctacaggtaaagtgcatttttcttccggcttccattcaaaataagaaagcttcctgtattagtggtatggtgtctgacattaacttggaaaattctcagtaattactgtttcagatatttctcttttaaaaaattttttattcccrtaggttttgggggaacaggtggtatttggttacacggtaagtcctttagtggtgacttgtgagattctggtgcacccatctcccattgcagaagacaattttttcatggaccagggcgggggcagggatgggggggatgtgtttgtgggatgagaaactgttccacttcagatcatcaggcattagtcacattctcatatggagcgtgcaacctagatcccctgcatgtgcagttcacaagaggattcatgcccctatgagaatctaatgccgccactgatctgacagggagcggagctc

SEQ ID NO: 145089 - DNA, 601 bp, Human
ggggctgggcgccgtggctcacgcctgtaatcccagcactttgggaggcagagacgggcggatcacgaggtcaggagattgagaccatcctggctaacacagcgaaaccccatctctactaaaaatacaaaaaattagccaggcgtggtggtgggcgcctatagtcccagctactcaggaggctgaggcaggagaatggcatgaacctgggagacagcttgtaagtgagccgagatcactccactgcactccagcctgggcaacagagcgagactctgtctcaaaaaaaaaaaaaaaaaaatgcaggcctggaacagtggctcatgcctgtaatcccagcatttggcaggcggtcacaggagcatcgcttgaggccaggagtttgagaccagcctgggcaacataccaagaccccatctctaaaaaaaaaaaatttttttttttaattagccatgcataatagcagatgcctatagtcccagctactctagaggctgaagcaggaggatcgcttggacccaggagttcaaggcctctgtgagctaggatagcaccactgcactccacactccagcctgtgtgagacagccagactgtctaa

SEQ ID NO: 145090 - DNA, 601 bp, Human; identical to SEQ ID NO: 18034

SEQ ID NO: 145091 - DNA, 601 bp, Human; identical to SEQ ID NO: 18035

SEQ ID NO: 145092 - DNA, 601 bp, Human; identical to SEQ ID NO: 18036

SEQ ID NO: 145093 - DNA, 601 bp, Human; identical to SEQ ID NO: 18037

SEQ ID NO: 145094 - DNA, 601 bp, Human
attgtaattctttcatggctctttccagtgatcttgtaacagatcagttcaaaataaaacaaaattctgggtagtcttaccttttagaaaaagagaagggaaaaaattctgaattattaaattttaaataattttatccattcagtagttttttattttgtgcctgctatgagttacaacacaaaacaaaaaagaacatgaacaaaaagacatggcccaactctgcggaatataatgtctgaaaagctgacaaatcctctttaaatggttgcttccttaattatttcagtaaaaaaaaaaatttttttaagtttgccattcagaaatcaatgcaggtatttctttaaagccacaatgaagacttagccctgtgccgtccccagcagttccagcctagtgaaagaggtctgtctgaggagccagggttccgtgcggtgtagtgcggctgcagtgcagtcacaccaccacctggagtgcaatctaactgttcctcataccagtgagtggtttcgagagctcaaggttcctttcaggggtgagatatctttggaagcacataccttgctttctatgctgcatctggcccatggatgaataaaga

SEQ ID NO: 145095 - DNA, 601 bp, Human
gagtaagagcagccaaggatgatgccagggcttttgacctgaggaaacaggaagaatgaagctgctttttaactgagttaaggaagcctggagggagaataaagttttggggaaaagatcaggaattaatctggaacatgtttagtttgagacactcatggtcacccaagtggagatgtcacacaggcagctgaaaatgtggggctcaggggaaaggttcgacctggagatgtggacttaggacctgtcagtgcttgtgtgcacacatgtacacacacacacacacacacacacacacacattgtaattctttcatggctctttccagtgatcttgtaacagatcagttcaaaataaaacaaaattctgggtagtcttaccttttagaaaaagagaagggaaaaaattctgaattattaaattttaaataattttatccattcagtagttttttattttgtgcctgctatgagttacaacacaaaacaaaaaagaacatgaacaaaaagacatggcccaactctgcggaatataatgtctgaaaagctgacaaatcctctttaaatggttgcttccttaattatttcagtaaaaaaaaaaa

SEQ ID NO: 145096 - DNA, 601 bp, Human
aagatactgcaatgttcctggagagggcaacagtggcgtggatgggggtagaagcagtgaggctggtaggaagtggtcagattctggacacgtgtcacagataaaatcaacagactggatggattgatagacttgaggtgagatgggagagtaagagcagccaaggatgatgccagggcttttgacctgaggaaacaggaagaatgaagctgctttttaactgagttaaggaagcctggagggagaataaagttttggggaaaagatcaggaattaatctggaacatgtttagtttgagayactcatggtcacccaagtggagatgtcacacaggcagctgaaaatgtggggctcaggggaaaggttcgacctggagatgtggacttaggacctgtcagtgcttgtgtgcacacatgtacacacacacacacacacacacacacacacattgtaattctttcatggctctttccagtgatcttgtaacagatcagttcaaaataaaacaaaattctgggtagtcttaccttttagaaaaagagaagggaaaaaattctgaattattaaattttaaataattttatccattcagtagttttt

SEQ ID NO: 145097 - DNA, 601 bp, Human
ctgggcacgatggctcacacctgtaatcccaacactttggaaggccaaggcaggtggatcacctgaggtcaggagttcaagaccagcctggccaacatggcaaaaccccatttctactaaaaatgcaaaaattagctgggtgtggtggcaggcgcctgtaatcccagctacttgggaggctgaggcaggagaatcacttgaatacgggaggtggaagttgcagtgagctgagatcacaccactgcacttcagcctgagcgacagggtgagattccttctcaaaaaaaaaaaaaaaaaaaaatccttctggttgagactctaggagagcacacacaaagatactgcaatgttcctggagagggcaacagtggcgtggatgggggtagaagcagtgaggctggtaggaagtggtcagattctggacacgtgtcacagataaaatcaacagactggatggattgatagacttgaggtgagatgggagagtaagagcagccaaggatgatgccagggcttttgacctgaggaaacaggaagaatgaagctgctttttaactgagttaaggaagcctggagggagaataaagttttggggaaaaga

SEQ ID NO: 145098 - DNA, 601 bp, Human
agggaaaggtctatcttcaaccacaaaacctcggcattccttcttagaggaagacaaactgcccgggttcccagagaagacagaataaactgcccaggttcccaaagacagaatgtccacccactccccaggagggcaaagcaggggaggaacaagtgcaatatctgtgaaggatgttgtgatttgacaaccatatcatattcagctgtctctgctttgcccaaggtcacacccccatcccatagtggccacatctcaaggactgatggatgtagagctacaaaggtccagccctcccgtyccagcacaggaaagctctgaggggtctctcgcttctacccccacaggcacagctgacggttctgtggagactgcagtgcagctaaactttttcctctgcacagtcctgtctccttcctttctactccatagctgttcctccccaaagcactccctgaacactaatctccatctcaaagtcagagttcctgagagcccgacctatgacatcatctctcaacccactctctctcctctctaagagaaatgatctacttggtcagttcgggagagaaaatttaaaatgccctgcccgccatag

SEQ ID NO: 145099 - DNA, 601 bp, Human
ataatatggcagtttgtattcactaaaaatagtagagaagtggtctctgaacacataaacatttaaactttgttcctacttgatgggtctttgcaaagtccctggcgtgtctcagaatcatagaatcacagattctagagctaaaaagcccgagagtgagcctgcctttaagtgtgctggtggcaacacatttttcaagtggctttacggacacatctaggcccaacatggtctgccacttcctagctagtaaactccatttaagttctctcacctataaacacggtgacaatatctaccytcatggagttgtgaatagttaacaagataatgcatgcataacacataccaagcattcagttaacagtaataccatccttttgaagattggttaaaaaaaaaaaacagaaaatttatcatcttaatcattcacactgttgtgcaacagatctcctgaaatttttcatcttgcaaaacctagactctgcatccattaaacaactcccctatcacccccgctccccagcttgttctactttctgtttctataaacttgactactttaggtgccttatttaagtggaatcatatagtatttgtt

SEQ ID NO: 145100 - DNA, 601 bp, Human
atcagtggctaactgagaccagagttgggagaaggactgactataaaagggcaagagagaactttctggggtgatgaacatgttttgtttcttgattgtggcggtggttataaagaggtatacatgtgtcaaaactatcaaattatacactttaagagtgcatttgatcgcacgtaaaatgttcctcaataaagttgatttttaaaaaataatataacacaataatacattgccacaattctatgtaataaaagcaacaaattaaaagattaaaagaaaaaagcccacttatgattccatwatcctaacaaagctttttcattttctgtgtttccttccaatttcagtctgatgcatatatatttcatacaactgttatcattttgtataaaaaattttcatccagcttatttatgttatatgcatttttcacatttcaaaggctatacaaaatgaccatacaatatttcatcaagtagttatgctataatttgttatacctggttattcaccaatgcctagatatttggattctcattttttctgattataaaaaatattacaataaacatcttcacatataaagatcatttcttaattt

SEQ ID NO: 145101 - DNA, 601 bp, Human
tgttatatcaataaacttgacaacaaagatggaataggtaattctttaaatgacaaaaattattaaaaccgactcaagaagaaacagagaacctgaatagaaactacctattttaaaaataaggaacctgcaatttaaaaacttcccccaaagaaaatctgaggaccataaagtttcactagtgacttcaattaaacatttaaggaagaaaaataagggcaggccgagtgtggtggcccatgcctgttatcctagcactttgggaggctaaggtgggagaatcgcttgagactaggagttsgagactagcctgggcaacacaggaaaacctcgttgccataaaaaatttcaaaattagccagctgcagaggtacatgcctgtagtcctagctacacagtaggctgaggtgggaggactgcttgagcccaggaggtcaaggctgcagtgagctatgattggccactgcactccagcctgcgcaacagaaggagaccctgtctcaaaaaaataataataagagtgaattaccctgatgtcgaaacaaagacactgtaagaaaacaacagatcaatatttctcatgaacatagacataaaaacc

SEQ ID NO: 145102 - DNA, 601 bp, Human
gggtggatcatgaggtcaggagatcgagaccatcctgcgtaacatggtgaaacaccatctctaccaaaaatacaaaacattagccgggtgtggtggtgggcgcctgtggtcccagctactcgggaggctgaggcaggagaatggcatgaacccaggaggcagaggttgcagtgagccagattgtgccactgcactccagcctgggtgacggtgagactccatctcaaaaaaaaaacaaacaaaaaacacatttctaaataaccaatggtcaaaaaaagaaatcacaaggaaaattagtaawttttttttaactaaatttaaataaaaacacaatgtatcaaaattcagtggatgcacataaagcagcgactgagggaaatttatagctttaagtctcatggtgtaaataaagaaggtctctgagcaagtatttgtcaccagcttaagagctagggtaagaaagatcaaattaaatataaagtaagtagaagaaagaaaatcataaagagcaaaaatcaaagacatcacaaacaatagataaaatcaataaacccaaaacctggctatttaaaaaaatttaatttgttaaaccgttgctcag

SEQ ID NO: 145103 - DNA, 601 bp, Human
cttcgataattatcaaccatcttaacccaactgacatttagaaaatattccacccaacattattttgaagtttacatggaacaattactgaaacaaaccaaattcagaaccataaaacaattctcagtgaatttgagaagactgaaataatacaaatatataatcagacacaacaaaattaaattatacatcagtaacagaaagatatgtggaaaagcctcaaatatttgttaatttaaaaacacatttctaggccgggcctgggggctcacacctgtaatcccagcactttgggaggccraggtgggtggatcatgaggtcaggagatcgagaccatcctgcgtaacatggtgaaacaccatctctaccaaaaatacaaaacattagccgggtgtggtggtgggcgcctgtggtcccagctactcgggaggctgaggcaggagaatggcatgaacccaggaggcagaggttgcagtgagccagattgtgccactgcactccagcctgggtgacggtgagactccatctcaaaaaaaaaacaaacaaaaaacacatttctaaataaccaatggtcaaaaaaagaaatcacaaggaaaatta

SEQ ID NO: 145104 - DNA, 601 bp, Human
tgataaaaatagacagaaaatcagaagactatagggacctgaacaacactattattggtagacaattctccatgggtctgctgcatttctgcttttgctccagactatattttcaatgatatttgtacagccaacccctttggaaaagagacagggtctcattcagaagaaatgggacaggtttgctaactgtccaacaataagaataatgtcttcctccacgaaaaaggaagtttgtttgcagcctattataaaagatttgagcaatacaagctgtaggttcctcagctgtgacacaaayccacatgtgcacagtatttatctaggactctctgcatctctcccataggtcttctgggaccagaggagcagatacaaacaccaaactcttgtggcttgctgtgctgtgattataaaatcctttgtctctgacccagaagtcctatgtcttcagccagcatgcatgaaacagtggcagtctaacttgttaccttccaaaaaggaaggaaaaaaaaatctcagaccggccacagtcttcgataattatcaaccatcttaacccaactgacatttagaaaatattccacccaacattattttg

SEQ ID NO: 145105 - DNA, 601 bp, Human
ctggcctactgcaataacctacttccactctggcctgctccagcgagcagcctgctaaagattgtaacctgaaatgtctgcatccagacatatacccagagaaactcttgcacatgtataccaggaaatatgcacagaaatattcagagctctactgtttgtaacagcaaaacctggaaataaacacactctaccctggtacaaatgaatgcacacgactacatgcaccaacatgaacaaatctcaaaaaaatacaccatcaagcaaacaagcaggtggcagaagaatacatgtcattatrtctatataaaattttagaaacaggaaaaattaatatatattatttatgactaaatcaatacatagcaaaactatttttaagaaagcaaggtgacaataaatagaaaattcaagataggaagagagaataggatatgtgagcagggacagttatgtggatgatattgaacatatcagtaacattctattcctaacactggatgatagatatgtgttatttattattttttaaattataaaatgatatacttggttaaaaaagcaagagaagtctcaattaaaatggtaaaaaaaaaattca

SEQ ID NO: 145106 - DNA, 601 bp, Human
tctatctgttgggagcagttctcatttcagtaaatggcaacttgatgtaaaatcctgggagtctccttgatgttctttctcatccggccccctttataaaatacaccatcaatatctattgattatatttccagacaaaatctccaattcatctgcttccctccattccaaggtaatcactctggttcaagccctcataaccccttgcctggcctactgcaataacctacttccactctggcctgctccagcgagcagcctgctaaagattgtaacctgaaatgtctgcatccagacatayacccagagaaactcttgcacatgtataccaggaaatatgcacagaaatattcagagctctactgtttgtaacagcaaaacctggaaataaacacactctaccctggtacaaatgaatgcacacgactacatgcaccaacatgaacaaatctcaaaaaaatacaccatcaagcaaacaagcaggtggcagaagaatacatgtcattatatctatataaaattttagaaacaggaaaaattaatatatattatttatgactaaatcaatacatagcaaaactatttttaagaaagcaaggtg

SEQ ID NO: 145107 - DNA, 601 bp, Human
accttcggtaggtgaatggataagctgtaatatatccagacaatggaatgttattttgcactttaaaaatgagctactaaatgatattactaaatgaaagaagccaatctgaaatggctagataatctatgattccaactacaggacattctggggaaggaaaaaatgtggatacagtaaaaagatcactggctgctagggattagggagaagaggggaatgaacagggagagcacgaataatttctagggcagtgaaactacgctgtatgatactgtaatggtggatatgtgtcattgcwcatttgcccaaacccatagaatgtacactacccagagtgagccctaatgtcaactacagactctgaatgataacgatgtgtcaggacaggttcatcagttgtgaccaatgcatccctctggaggggactgttgataacaggggaggctgtgcatgtgtaggaatgggtagatatgggaaatacctgtaccttccactcaattttgctgcaaacctaaaactgctttaaaaaataaagtttattctttttaaaagcccatgtatgaattaaaacaaaataaaatatgtctatctgttggga

SEQ ID NO: 145108 - DNA, 601 bp, Human
tttatgaatggagttcaagaagcttcatctatatagacccatggatatccatcacaaggacattaattaggcattggtaactgggagatgttctgagagcatgcctgtgaatagaaatctgctaaacttccactgggtctcaggcagcccacttggtgggaaccacaacatgagtctgaaatgagggattaagaactttcaaaacacaatttttgtgtgtaggcgggttggccttggtgtcttaatgcaaatctgacacccatcaggaagctcaggaaaggggagactaaacacttagtcrtaagtatatgttaaccagtaatatgaaaattaaatctgtcaaaatcctcgcttttgatatggttaccaaactccaaatgttgacttcgaaaatcaaacccaatctgccttacccctactccatctaaaattaaatgtaatccttcaatttatatagaagaaacacaaatccaagagcaagttaaattcagcatccttaacttgtcccagttgcacccagactctggagttccaatctcctctgccacagggtcccacatcaaacacccgatggctccccataaacagaatggaacgtacc

SEQ ID NO: 145109 - DNA, 601 bp, Human
gggataactgtaaatatccccaggagcaaagaagcactgtgtccaataataagacacggttagtatatgctaatgtgttctttatagacaaaaggccaggaaagtaaaataatttcaacaatagtagtttaaacttacgtaaaacattgatcctttaatttcactgaaggaaccacaaaaaacaatacatagaacatttagtcttctaggcgtccattactcatgtctattatatggctatatatctgttttatgaatggagttcaagaagcttcatctatatagacccatggatatccawcacaaggacattaattaggcattggtaactgggagatgttctgagagcatgcctgtgaatagaaatctgctaaacttccactgggtctcaggcagcccacttggtgggaaccacaacatgagtctgaaatgagggattaagaactttcaaaacacaatttttgtgtgtaggcgggttggccttggtgtcttaatgcaaatctgacacccatcaggaagctcaggaaaggggagactaaacacttagtcataagtatatgttaaccagtaatatgaaaattaaatctgtcaaaatcctcgc

SEQ ID NO: 145110 - DNA, 601 bp, Human
aaaatccagcataataaaattacatagctggaaaagggaggaccttgtaggcctcctgaaatagtcttgaagaccccagagtccttggaccacattttcagagctgttaatctataacacaaaaacacaacaatgtatacttacacttaggacagagtggaggggataactgtaaatatccccaggagcaaagaagcactgtgtccaataataagacacggttagtatatgctaatgtgttctttatagacaaaaggccaggaaagtaaaataatttcaacaatagtagtttaaacttacrtaaaacattgatcctttaatttcactgaaggaaccacaaaaaacaatacatagaacatttagtcttctaggcgtccattactcatgtctattatatggctatatatctgttttatgaatggagttcaagaagcttcatctatatagacccatggatatccatcacaaggacattaattaggcattggtaactgggagatgttctgagagcatgcctgtgaatagaaatctgctaaacttccactgggtctcaggcagcccacttggtgggaaccacaacatgagtctgaaatgagggatt

SEQ ID NO: 145111 - DNA, 601 bp, Human
aaagacacatgaggccaggcacagtggctcatgccactttgtaatcccagaactttgggaggctgaagtgggcagatcacttgagctcaggagttcaagaccagcctgggcaacatagcaagaccccatctttacaaaaaaatacaaaaatatagctgggcatggtggcatgtgcctgtggttccagctacttggaaggctgaggtggaaggatcgcttgagcccagagctggagggcacttcagcctcgtggctgggtgacagaacaagaccctgtctcaaaaaaaaaaaaaaaaaaaaacacctgaaaatgtgaaggagacagttcattaaaacctcgtaaccgcaggctaatttcactacattttatatgctcacttggctaaaactctcagagaagccaatggaagtttgattttagaaccacagcaataatcccaattgtatatattagcagttcttaagttttctggtcttgggatcccaaagcactttttattttggttttacctatcactatttactgtacttgtaatcaagcctcagaaaaatttaaaatatttatctagtaattaatatgagataataaccctttacatgt

SEQ ID NO: 145112 - DNA, 601 bp, Human
gctggggttcacattagtacccaccacttactggctacattaccctaggaagctcaactcacctatctaatgaacctgagttttctcaaccacaaaatagggatataataatagttcctaactcagagagttggtgagggaattaattggggtaagtctcatttcaaaatgtgcgaaactttgtaagcagtcaataagtgtgtgttataaacaattttatggcagttgtccatccacaagccatggtgtaaactatcaaggaggtctaagcagctgtttacgggagagtggcaagacgaasagcagagtcagggatgtgaggacttgatccagctccttcatttaccaaatggggaatttcaggcaaatgccttacatttctcatctcatctataacatggagataattatatctgccctggggtatcatgaggttgttgtgagaattaaatgagatatatgaatttgcttcaaaatttacaaaacagcattaaaatctaaagtattaatgtaattgttattttcattagaaattcactattcttcaagtaacttatgcatataacaagcggatgacatataaataacagaccatgttttc

SEQ ID NO: 145113 - DNA, 601 bp, Human
gatctcagagcaaagctgctggggttcacattagtacccaccacttactggctacattaccctaggaagctcaactcacctatctaatgaacctgagttttctcaaccacaaaatagggatataataatagttcctaactcagagagttggtgagggaattaattggggtaagtctcatttcaaaatgtgcgaaactttgtaagcagtcaataagtgtgtgttataaacaattttatggcagttgtccatccacaagccatggtgtaaactatcaaggaggtctaagcagctgtttacggragagtggcaagacgaagagcagagtcagggatgtgaggacttgatccagctccttcatttaccaaatggggaatttcaggcaaatgccttacatttctcatctcatctataacatggagataattatatctgccctggggtatcatgaggttgttgtgagaattaaatgagatatatgaatttgcttcaaaatttacaaaacagcattaaaatctaaagtattaatgtaattgttattttcattagaaattcactattcttcaagtaacttatgcatataacaagcggatgacatataaa

SEQ ID NO: 145114 - DNA, 601 bp, Human
agatcttcaagattacagatgaatgcaaacagatgctattacaaataccagtgaatacctggcgtttgaaaatccggcacatgaaccactgggagttcatgcacggtagcagtcagggaccctggatctcagagcaaagctgctggggttcacattagtacccaccacttactggctacattaccctaggaagctcaactcacctatctaatgaacctgagttttctcaaccacaaaatagggatataataatagttcctaactcagagagttggtgagggaattaattggggtaagtctyatttcaaaatgtgcgaaactttgtaagcagtcaataagtgtgtgttataaacaattttatggcagttgtccatccacaagccatggtgtaaactatcaaggaggtctaagcagctgtttacgggagagtggcaagacgaagagcagagtcagggatgtgaggacttgatccagctccttcatttaccaaatggggaatttcaggcaaatgccttacatttctcatctcatctataacatggagataattatatctgccctggggtatcatgaggttgttgtgagaattaaatgagatata

SEQ ID NO: 145115 - DNA, 601 bp, Human
taaaattttttttgtgtgtgtgggggaggggagacagagtcttactagaaacaggtccagactggagtgcagtggcgccattacagcttattacagcctccacctcctgggctcaggtgatcctcccgcctcagcctcccaagtagctaggacaacaggtgtgcgccagcatacctggctaacttttaaactttttttgtagagccagggtgtcgctatgttgcccaggctggccaggaactcctgggctcaagtgatcctcttgcagtactgagattacaggtgtgagctactgtgcctracctagttttctttatattgtagtaaaggcaatatatgaattttttttgaaagagtattttgaatttcatttcaggatctccaaccaggtattataaaacatctgttattaaaaaccggtgttggatctgaatgggtttagaccttgccatgtatcaaatccttaaaacaatctgttccacagactgcactctggccagttttcgaagccccccacctcacccctagtacttaaaatcctttcctcctgctgctgcttagatatagagaagccttcccaggattgactctgcagccccac

SEQ ID NO: 145116 - DNA, 601 bp, Human
tctcaagcctggacatgttctgaactgatgaagccatccaaaaagcccttctgagtgggtggaacaacacagcagaggtccccacaggacccaaaaatagtagtcaagtaggcatcagtggccaaattccaggagtccctagagaaagggttgatctcatcaggggagaaggtctacaatcaagaatataatcacgggttgagactcaagactcctaggatgggcaaagggctccatgccagagtcttggctcagaggtgttaaaggcccctaagccagcactcgcaggagtgagacacaygtcatgacccagcagctagtggagatggaatttctgaaatgctaccacaattcactgtctttagcttgggacttaggtgggaaagggctatagaacacaacagtgactcttgatggggccaattcaaaatccactaatctgctattaaaacatttttgtggctttactggcatttagtggttaaggaaaactagaaatataccatataatagcaaactgtcacacacaattttcagacgttccactgtatcatcatgtatgtggaaccttcttttagagcctaaagctgttttacataga

SEQ ID NO: 145117 - DNA, 601 bp, Human
gctcacctcctgtggcctctacctttccctggactctgactgagaacatatttactatatcatgagctttttcaagctttgaagcatatttttcatatttagtctgagttttctcatccttaggaggaggtgtcacttgatttctgagtttgcaattgctaaaaacagaagtccctcatgacctatcctgagtacctgatgaaagttgtgaaccctcttccaggaaaactatatatgcctacaatatttccacacaatttcatggagttttctgaccctttgaagcccatccatgaacacmagggcccaaggtcctcaagttaaaaaagccaactatagccaagtgcagtggctcacacctgtaatcccagcaccttgagaggccgaggtaggaggactgtttgagcccagaagttccagaccagcctgggtaacaaagggagaccctgtctttacaaaaaaactttttaaattagccgggtatggtggcacgcatctgtagtcccaactacttgagaagctgaggttggaggactgcttgggtctgggaggtcaaggctacaatgagccatgattgtgccactgcactccagcctgggtg

SEQ ID NO: 145118 - DNA, 601 bp, Human
agtcttcaatgcatcatcactaaatatctctccatttatttcagtctttaagcatttatttcatcagcactttgtaactttcattaaacagatcccattttgttatgtatatacctaagtattttattttctttggagtgactctaaaatatattgtgtttttagttttggttttcaaatgttcattgatagtatacggagatggagttgactgttgtgtgttgatcttgtatcctgcagctctgctgacctgatttatcaattctaacaattgatttattttggtttttggtagattctytaagatattctatgtaaacgattatatcatttgcaaatagcaatggtttttcttcctttacaatatgcaggccttttatttctttttcttgactgataacagtgtcttgaacttccagtgttataagaacgaatctccttgccttgtttctggtcttggggggaagtattcaatctttcactattaaatatgatattcactctacgtgtttgggaggtgccctttatgaagttgaggtaattccccactattaatttattgggagattttttttttaaatcatgaataggtattggatct

SEQ ID NO: 145119 - DNA, 601 bp, Human
ttgagttaatttttgtataagttgtgaggtttaggttgatgtccaactgcaaaagcaccatttgttgaaatttctccattgaattgcttctgtacctttgtcaaaaaccagttgaacttatttgtgtgggtctatttccaggttctctgttctgttccattcatctatgtgtccacgcctctgtcaatatcacaggatctaattattgcagctatcacagtaaagacttagtattaaatacagtgatttctccccgttttcttgtcaaaattgttatagctattctagggcttgtgctttwccctataaattctagaataagtctgcctatgaatataaaaagccttgctagaattttgataggaaatgctttaaagttatagatcaatttgagaagaactgacatctttactaagttgagtcttcaatgcatcatcactaaatatctctccatttatttcagtctttaagcatttatttcatcagcactttgtaactttcattaaacagatcccattttgttatgtatatacctaagtattttattttctttggagtgactctaaaatatattgtgtttttagttttggttttcaaatgt

SEQ ID NO: 145120 - DNA, 601 bp, Human
ggaggctgaggcagacagatcacgaggtcaggagatggagaccagcctggccaacatggtgaaaccccgtctctactaaaaatacaaaaattagcttggcgtggtggcacgtgcctgcagtcccagctacttgggaggctgaggcaagagaatcacttgaacccgggaggcagaggttgcagtgagccaagatggcgccactgcactccagcctggcaacagagtgagactccgtctcaaaaaaaaaaaaaaaaaaaaaaaaaccaactatgcctagttccagagccttttttttttttttgaaaagttttatagttttacattttacatttaaatccctgatccatttgagttaatttttgtataagttgtgaggtttaggttgatgtccaactgcaaaagcaccatttgttgaaatttctccattgaattgcttctgtacctttgtcaaaaaccagttgaacttatttgtgtgggtctatttccaggttctctgttctgttccattcatctatgtgtccacgcctctgtcaatatcacaggatctaattattgcagctatcacagtaaagacttagtattaaatacagtgatttctccc

SEQ ID NO: 145121 - DNA, 601 bp, Human
tgctttcaccgtgatcccagccaccatgatctctcacctgcatgctgtcacagcctccagtctcgtttttctcattttattcttgcttcctcccccgagatccattttccataaggcagcaagaggagggaatgttaggacatatctctcttaaggccaaaacaatttttatgagtaagaaatgtgagttgttctgaatgcagtaatacttttgatgagacttatttcctttttaagaatgaagatgcagggaacaatgggaggaacaccttggatgtgatatctaaaatcgattcccacrgtgcttcagccatgtcaagctggacaactacatctgctgggaccaacgacaggaggagcagggacaacgaccaaggacatcaccaggtagacatcgtgttgctatgtgaaggtgacctggtggtagtcaccttcacttgttcccagatttgagagacaagcaagtctgttacatctccagttcctgccacaggtactttcagttgaaacttgacgccccagggatgggaaacccagtagtgacacagaaactggattagacattcaaagacctcagtcccagtttcccaacttaactagc

SEQ ID NO: 145122 - DNA, 601 bp, Human
gcccactcagcggtgccctgggctgcctctcccccagggctgcacctgtacatctccaggatgcacacacactgcccgccctggcactgtgtgggtgagaccagagcaggtcagcagggtggccctggtttctgctgctggtacaccgcatgctacacatttttcttttcatctagtctaacttagctggtactttctcttcaaccccatttttagacactggagacctgggagctcaagtgatccccaggagattttgtacagtcccatgattttagatgccatttctatgctgaggtcytctgtcatgaagggctggactccaggaaattttgtatagtcccgtggttttggatgccatttctgtgctggggtcttctgtcacaaaggttgcaccccaagagattttgtatagtcccgggattttggatgccatttctatgctgaggtcttctgtcatgaagggctggactccagtcttgaggtgtcaggacagtggctttcaagtccatgagattttgtacagtcccatgattgtggatgccatttctatgctggggtcttctgtcataaaagactgaactccaggccaacttcccct

SEQ ID NO: 145123 - DNA, 601 bp, Human
tccctccttctaattactcctcatctctgtgttctgcatttagcacaatttcctgagaaagctgtctaaacttgccttctttgcttctgcaactcacattcattcttcaggcttctctaatctggcttctatccctaccagttcaccagtcagaactccatgctacaaaccgtgggatccacccctgcaccctcttgcttgcccactcagcggtgccctgggctgcctctcccccagggctgcacctgtacatctccaggatgcacacacactgcccgccctggcactgtgtgggtgagascagagcaggtcagcagggtggccctggtttctgctgctggtacaccgcatgctacacatttttcttttcatctagtctaacttagctggtactttctcttcaaccccatttttagacactggagacctgggagctcaagtgatccccaggagattttgtacagtcccatgattttagatgccatttctatgctgaggtcttctgtcatgaagggctggactccaggaaattttgtatagtcccgtggttttggatgccatttctgtgctggggtcttctgtcacaaaggttgcaccccaa

SEQ ID NO: 145124 - DNA, 601 bp, Human
gcaaaactgcctcagctgagcagctcttctttaaacacacacccatttttagaagtgagtttggattaccgtttttgaacattcatcttgtctttgggataaagatagatattggcaatataaaggagacttgtgtggctgctacagaaacagtccaggagttactgtcatgtgaagaaagcaagtcacagagtaagagtcagtataattccacctatgtgaaaacaaacataaaacaaagttattttcatatataaaggcaaagaagactataagaatctgcacagcccactgataccargttacttctgaggaggcttttgaggttagggggagactgctgcgctcggactgttggattttttttttttttttttttgagaaagagtctcactctgtggcccaggctggagtgcagtggcgtgatctcagctcatagcaacctctgcctcccgggttcaagagattctcctgcctcagcctcctgagtagctgggattacaggcatgcgccaccacgcctggctaatttttgtactttcagtagaaacggagtttcaccacatggtctcaaactccttacctcaggtgccttgacctcc

SEQ ID NO: 145125 - DNA, 601 bp, Human
taattaaatgaattttatttatttacataattatggcattatatgtaaacatctaggaaagcatttatgttattatactggaattgtttacttaatatcaaaatgcccaaactgactaaattacctgcaagtgacttatatttttctaaattaaataccatggtgaaaattggccaattttcttacaacacaattttaaattatcacttccccctgcaaacaaagacaaactagaaattaaaacaactcataagcaccacctacatttacttcactaaaaaaagaaagaaatgtcctctayagagtaagatggaccaccactccccggcaaagcattacatgacaagacagcaaagaagattcgtgttacaaaactgttaaaaatacatgtgaaaggtctgcataaaggaagaccttggatcttagcaagaaaaattcaatgtcacaaagatgtcagttctctggcatagaaactcaatgcagtaccagtaacaattccaaatagggtttttggtggaacttcagaagcttttccaaaattcacatggagaagcaaggggccaagaacagcacatgctaagggaaagaagaaaattataga

SEQ ID NO: 145126 - DNA, 601 bp, Human
catgtcgaatacctggagggctctctgaccatgaccatataaaatacttgtgcccgaatgctgaattagttgcttctccccccctttttttaatgtaaacattaaaaaaatttaatgtaattaaatgaattttatttatttacataattatggcattatatgtaaacatctaggaaagcatttatgttattatactggaattgtttacttaatatcaaaatgcccaaactgactaaattacctgcaagtgacttatatttttctaaattaaataccatggtgaaaattggccaattttctwacaacacaattttaaattatcacttccccctgcaaacaaagacaaactagaaattaaaacaactcataagcaccacctacatttacttcactaaaaaaagaaagaaatgtcctctatagagtaagatggaccaccactccccggcaaagcattacatgacaagacagcaaagaagattcgtgttacaaaactgttaaaaatacatgtgaaaggtctgcataaaggaagaccttggatcttagcaagaaaaattcaatgtcacaaagatgtcagttctctggcatagaaactcaatgcagt

SEQ ID NO: 145127 - DNA, 601 bp, Human
tgctctgtcacccaggctagcaatcacagttcgctgcaactttcaactcgtgggttcaagcaatcttcccgcctcagcctctcaagtagctgagactgaataagctgaggcttattttttaaatttaattttattttttgtagaggtaggtctcagtatgtcactcaggctggtctcaaactcctggcctaaagtgatccttctgccttggtctcccaaagcactgggattataggcatgagccaccacatctggccaactttttttttttttaaataagtagtacactctaaaataacaraaagtatagtatgttaagtacataaaccaataacacagccatttattattatcaagtaattatgtactatatataattatatgtgttatccttttctatgactagcagcacaggatgtttgtttacctagaatcaccacaaacatgtgaacaatgtgttatactacattataacacctatgatgtccctaggtcatagacacttttcagctccattataatcttatgagaccactattgtacatgcaggctgttgttgatcaacatgtcattataaggcacatgactaaacttccaatgt

SEQ ID NO: 145128 - DNA, 601 bp, Human
tgattctcctgcctcagcctccagagtagctgggattacaggtgtgtgccaccacgcccagctaatttttgtgtatttagtggagataaggattcaccatgttggccaggctggtctcgaactcctggcctcaagtgatctgcccacctcagcctcccaaagtgctaggattacaggtgtgagccaccatgcccagccggtattctattcttaagaggataaaaagttatatgggtgtactgatttgtcaaaaaggtacaataaagattatacatgtcaatgcacatacatcttatcttayaaaaataaaaaaataaagggatggggaatgagctgaagtatagatgaagcagaaatagcacatgatgagtagttgttgaggctgagtgtcaggtctattacaccattttgtttattttgtatatgtttaaaatgttctgtaataaaacacttgtctaaaaagacaaagtttatccataacattagctcttaagattttggctacctttggagaggaagaaggaagaaagtggatgtcagaagcatgaacaaggctgattctatcttgtggttacaaaaatgtatttgccttgtaataatt

SEQ ID NO: 145129 - DNA, 601 bp, Human
tcagaatggccgccttatccctgacttctgagaggtctgtacctgctggttggagccctcactccttaggaggcttggcccatgtcccaggaagtgccccctaaaacgaccttccggtctcttcctcctctgaggggagcgccctggaatgagtccctctgtgctaaggaacacgacctccattcgcacaaccaggctgactggcgccctgtgcccggaggcaggaagagacgcaggatccagcttgtgtctgtgcgtctgtgtttctccagctgtggtgcctgtgcaaagagtggaaccycaaagaacactgggtggtcaacacacggacacagcacccaatacaagtatgtatgtttaagctgaataacaatgtcatataaaaatgttatttcattttataagaaaattgagttaaattttgtaagggcgttaaaatataattttaataggaagctatgaaaattatctacacttggtgtacaaatgactgaattttgggtaactctgtaaaagccacttatgggtgtaaagaggggtctgtcacttactttataagacatcgacttccaaatctgtggtgtttttaaccagtgccctc

SEQ ID NO: 145130 - DNA, 601 bp, Human
ccagatgctgagcatcaacctcctgcctccctggaacagaccttatctgaatcccatcaaagcccacattgtcctccagcctctaacgtccagacatgtgccagaatagcccctcagaactgtcttgatgagatgggacaaggggtggtggagatccaggttcagaatggccgccttatccctgacttctgagaggtctgtacctgctggttggagccctcactccttaggaggcttggcccatgtcccaggaagtgccccctaaaacgaccttccggtctcttcctcctctgaggggagygccctggaatgagtccctctgtgctaaggaacacgacctccattcgcacaaccaggctgactggcgccctgtgcccggaggcaggaagagacgcaggatccagcttgtgtctgtgcgtctgtgtttctccagctgtggtgcctgtgcaaagagtggaaccccaaagaacactgggtggtcaacacacggacacagcacccaatacaagtatgtatgtttaagctgaataacaatgtcatataaaaatgttatttcattttataagaaaattgagttaaattttgtaagggcgttaaaata

SEQ ID NO: 145131 - DNA, 601 bp, Human
aatggacttgtacccaaagaggcaactcactgtccacaaggacaccatcccagatgctgagcatcaacctcctgcctccctggaacagaccttatctgaatcccatcaaagcccacattgtcctccagcctctaacgtccagacatgtgccagaatagcccctcagaactgtcttgatgagatgggacaaggggtggtggagatccaggttcagaatggccgccttatccctgacttctgagaggtctgtacctgctggttggagccctcactccttaggaggcttggcccatgtcccagtaagtgccccctaaaacgaccttccggtctcttcctcctctgaggggagcgccctggaatgagtccctctgtgctaaggaacacgacctccattcgcacaaccaggctgactggcgccctgtgcccggaggcaggaagagacgcaggatccagcttgtgtctgtgcgtctgtgtttctccagctgtggtgcctgtgcaaagagtggaaccccaaagaacactgggtggtcaacacacggacacagcacccaatacaagtatgtatgtttaagctgaataacaatgtcatataaaaatgtta

SEQ ID NO: 145132 - DNA, 601 bp, Human
ggaattctagcaattgtgacaaccacaatttaccaagtgcttacaatgtgtgaggcactatgttctctaagtgtggcatctcactgaaaatcccaggctcagtttttaatcaaattcaattcagcaaagtttcaattaagccacccataaacaggtggctactgttattgtatatcacaatccacccttaaaaaattagagcgcaaggcgctacaaacctggttgagatggaaagtaatgtagtatgtaattgaaggaaaccagttttgagcagtaacagctaagggtcagttaagattgyagatgttaaacaaaaccatgcccaggctttcccctaacccacagcctcccagaagcactcacaccctgggcctgggaccagctcacggagggtgacttcccaatactgtatgagctccgtcttgacatttgatagattcagagggtgagatgagagattgtaaataattcttaagtaatgtttaaaatagccacaaatagttccctagatattacagtcatgtatcacttagcaactgggatacattctgagaaatgcttcgttaggcagtttctttgcgtgcaaacatcacagagtgta

SEQ ID NO: 145133 - DNA, 601 bp, Human
ttacagcttccagttactcttactgtgaagcccaaacttctcaaagtgaagcagcctggctcaccagcacaccccacacccgccaccaggcttgacttctccttacaagcctgtttgcgaccctggagggccacaggctttttgggccatcaggacttcagtatgtccaatcccctctgcctggggagctctcctatgcccctcacttgtgagaattgacttcttgaaggaattctagcaattgtgacaaccacaatttaccaagtgcttacaatgtgtgaggcactatgttctctaagtrtggcatctcactgaaaatcccaggctcagtttttaatcaaattcaattcagcaaagtttcaattaagccacccataaacaggtggctactgttattgtatatcacaatccacccttaaaaaattagagcgcaaggcgctacaaacctggttgagatggaaagtaatgtagtatgtaattgaaggaaaccagttttgagcagtaacagctaagggtcagttaagattgtagatgttaaacaaaaccatgcccaggctttcccctaacccacagcctcccagaagcactcacaccctgggcc

SEQ ID NO: 145134 - DNA, 601 bp, Human; identical to SEQ ID NO: 18038

SEQ ID NO: 145135 - DNA, 601 bp, Human
gtgtgtgtgttgggagcagaagaaggcagagccagggcaggctagtgtgagagcatacacttgcatctgtgcacattctcctcttgcagagtgagcaatcccagggtaaaactaagtactgctctttcttttatgctccctactgtgtatgtagggctttctacctaatgggcccacaaaagacattgtatgatttacttactgctctgtgagagttgagaaaatagtgatttttaaaagagtttgaaaaaactcaccaatttgctatgtattccactaaaataatctttctatataaaayacaaccataactgaacatccatttcctatgaattgtaaaattttcctctcataaccaaactgatacattttgaaacctgagaagaaggatgtttagtttaacacctaccgcctttgagtgttaaatccattaagatgattctctctgagttcagacgctaatgataaaaccatctgtaaaacaaaatcagttgcaggttaactcacgctgcaaacaggattacatcagttctatttttcttggtgtgagtgatatttccgttgagattcccccaacccccatcttctcatgtttcactct

SEQ ID NO: 145136 - DNA, 601 bp, Human
catgggcattacattaaacatcttagagttctaacaacctaacgagataacttcaatcacatactaaaactctactcatttacatttccctccccagtttatgttatcaatatcacaaattacatccttttctattttgtatctatcaacacagtttaatagttatttttacacttttatcttttaagttctataccagaattaaaaagtgatttatgtacactcagccctctatatctatgggttctgtatccatggattcaactaaatcatggatcaaaaatatagtatttgcaggatrtagaacccaaagattgaacgtttgtatctgtaagttccatacagtttactatgggactggagcatctatagattttggtatgtgtgggaagtcctggaaccaatcctctctggatactgagggacaactgtactatacaacacggtattataagattttgtgtttgtctgtatatttacatttaccagaaggctttatatttttgcatgctttcatgttgctaatattctttcatttcaacttgaaggactccctttagcaattcttgtaaggcaggtctaatggtgatgaactccttca

SEQ ID NO: 145137 - DNA, 601 bp, Human
agctagaatatagttggatcttgttttctgatctattttgctattccacatcttttgaatggggtgtttaattcatgttcacctaaagtaattactgatagagaaggacttactattgccattttgttgttttccatatacctagtagttattctgttcacgattttctcttattcccttcctttgggtttcattgatttttttcatagtgacatgctttccttctcattttccattgtacatctcctacaggtattttcttgttgttaccatgggcattacattaaacatcttagagttmtaacaacctaacgagataacttcaatcacatactaaaactctactcatttacatttccctccccagtttatgttatcaatatcacaaattacatccttttctattttgtatctatcaacacagtttaatagttatttttacacttttatcttttaagttctataccagaattaaaaagtgatttatgtacactcagccctctatatctatgggttctgtatccatggattcaactaaatcatggatcaaaaatatagtatttgcaggatgtagaacccaaagattgaacgtttgtatctg

SEQ ID NO: 145138 - DNA, 601 bp, Human
tgggggcttttggtgacccatgaattctgagaaaagcttgatggtaggtaggtgggatctttttgaaggaaaataccacagccctaaaagcttgccaagagaggactactataaaagataagagttactttggggatgaattcaaggaacagggggcaacctgacagccagctgccaaggccttatacattatacactctttcttcttatccactgtctttaggcaagagataacagaaatgtcctgactccaacaggaaggaggaaggaggaaggaggcctggaaggagaagccagcccraaatggctatcaacctccaggaaatatgggagtcctctaaggcccagaatacaatttactggcaacctcaatcaacactacctcttgatcttcccataattattggaggctacagtaaacagagcactcatcgagagactaacaaggaatcccaaattccaggaagaccaaattgttctgcaaagtggttgtgcctatttatgttcccatcagcaacctcctaaagctcaccataacctaatggatgtctaactgatgttgttagtttacactttcctgaaaatgcacagaaaagctcat

SEQ ID NO: 145139 - DNA, 601 bp, Human
gcaggtttgttacataggtatacacgtgccatgttggtttgctgcacccattacctcatcatttacattgggtatttctcctaatgctatccctccccttgccccccactccacaacaagccccagggtgtgatgttccccaccctgtgtccaagtgttctcattgttcaattcctacctgtgagtgagaacatgtggtgtttggttttctgtccttgtgagagtttgctcagaatgatggtttccagctacatccatgtccatgcaaaggacatgaactcatccttttttatggctgcayagcattccatggtgtatttgtgccacattttcttaatccagtctatcattgatggacatttaggttcattccaagtctttgctattgtgaatagtgccgcaataaacatacgtgtgcatgtatctttatagaagcatgatttataatcctttgggtatatacccagtaatgggatagctggatcaaatggtatttctagttctagatgcttgaggaatcgccacactgtcttccacaatggttgaactagtttacactcccatcaacagtgcaaaagcattcctatttctccacatcctc

SEQ ID NO: 145140 - DNA, 601 bp, Human
agtcaagacctaatgcttagtgtaattcaatctggaaagtgttgcgtaactctccacttgaacttggatctccacactctgacaaacttcagaccaaaagaggagccatgaaggctgcgtgcaccttgaagttcttgggaaggttatcagttggcctgcccaaattttggtatacccaagaactacctgtctttatgagattttttaaatttttcaggaaaattatcctggatcatttccagcctaaacagaagatataatctgcagccatgaactgcaatacttgataaatgtccccagmaccacagtctttccacccactcagtccccagtaataatctctgactcttctcatttcctcttttcagatgagagaaaagttgcgcttagagatcttttagggaggaagattgatgagtcaggctggagacctgcctgcctatttgagacgctacatgagtgatgcacacaggcaactctccggcctacctttcaattgcacaaacatccatcccgccctaactctatgcaatatattctgctaggctatgtgcaaagtatacacctttcacacacacccccacatacctcttcctctacc

SEQ ID NO: 145141 - DNA, 601 bp, Human
gtgtggtggctcatgcctgtaatcccagcactttgggaggccgaggagggcagatcacctgaggtcaggagtacgagaccagcctgatcaatatggtgaaaccccatctctactaaaaatacaaaaattagccaggcatggtggtgggcacctgtagtcccagctactcaggaggctgagacaggagaattgcttgaatccaggaggtggagattgcagtgagctgacatcacgccactgcattccagccagggtgacagagcaagactccgtctcaaaaaaaaaaaaaaaaaaaaaaaaattgtagtgggaaatccatcagattacagagaaaagagaactccaggatgtttctgataggaacataaataaataagcacaaacactttggagaacaactggtagcaacgtgctaccatttcttcttacaggttagggagacaaacaggactgtttgtaaaaggtagattcaatcttgctgtgaatttgtacagaaatgaataaatgattatttatttacagaatggaatgctatatggcagtttaaatgaataaactgtacctacattatctgcatacataaatctcaaaagttgaatga

SEQ ID NO: 145142 - DNA, 601 bp, Human
aacaaacacatttttaaaaatttagtttcaaatatgataaatattaataagggtttaacagatttttaaaactcttgggaatgtatgaacacaaagaaggaaacaatagtcgctggggcctacctgagcaacggtaggagggagaggagcagaaaaggtaactactggggactgagcttaatacctgggtgatgaaataatatgtacaacaaaaccctatgacatgtgtttacctatgtaacaaaccttcacatgtacccccaaacctaaaataaaagttaaaaataaaaaaataaaatgytttgggatcctcagtaattttttttttttttgagatggagtctcgctctgttgcccaggctggagtgcagtggcacaatctcggctcactgcaatctccgcctcccaggtggaagcgatcctcctgactcagcccccctagtagctgggattagaggcacacaccaccatgcttgactaatttttgcatttttagtagagacagggtttcaccatgttggccaggctggtctcaaactcctgacctcaggtgatccacccgccttggcctcccaaagtgctgggattacaggtgtgagcc

SEQ ID NO: 145143 - DNA, 601 bp, Human
tagattattattttggaattttacaatattctatttgaaaagtaacatttatttatgatgtattttcttgcatttaagaatggatcactggctttaaaaatgaggattaaaagattcaatttctcatcctacagatgtttcatcaagaaaagatgaaactggctggcgcagtggctcacgcctgtaatcccagcactttgggaggccgaggtgggtggatcacctgaggtcgggatttcgagaccagcctgaccaacatggaaaaccctgtctctactaaaaacacaaaattagctgggcrtgatggtgcatgcctgtaatcccagctactcgggaggctgaggcaggagaatcacttgaacccggaaggcagaggttgcggtgagccgagattgcaccactgtactccagcctgggcaacaagagtgaaactctgtctcaaaaaagaaaagaaaagaaaagatgaaactgacacatcagagaattctctgactcatgagatggagacatctgctacagagaaagtgggctaaactgtaaataaagacaaaaaatgtgaggaaagttatttttcccttgcctttacagatgttaatgattt

SEQ ID NO: 145144 - DNA, 601 bp, Human
agcccaggagttcaagaccagcctaggcaacatggtgaaatgccgtctctaccgaaaatacaaaaaattagccaggcatggtagcacacacctgtggtcccagctactcaggaggctaaggtgggaggatcgcctgagcctgggagtttgagactacagtgagccaagactgcaccactgcactccagcctatgtgacagagtgagaccccatctcaaaaaaaaaaaaaaaaaaaaaaaaaaattgaaaacgtaaatagtattaataaaatgatttaaaaaccacagtattcttaacaaaatgtcaagtttataagcagtaagtatcattttaaaatcacattgcatgtataccttgaattcggaaatgtgaatgctttggatctcattatctgagacggagagggctctgcaaattataccacacagtggattcacagtgttttcaaacactgcagacagagccactcgtaacttggagtcatgactacagcagtagtcagaggccatgcaacaattttcaaagtggggttcaaagaactgtttccagagagggagggaagaactgagatgcgttaaaagaaaaaatcattatttaaaaa

SEQ ID NO: 145145 - DNA, 601 bp, Human
acagtggctcatgcctataatcccaacattttgggaggccaagacaggcagactccttgagcccaggagttcaagaccagcctaggcaacatggtgaaatgccgtctctaccgaaaatacaaaaaattagccaggcatggtagcacacacctgtggtcccagctactcaggaggctaaggtgggaggatcgcctgagcctgggagtttgagactacagtgagccaagactgcaccactgcactccagcctatgtgacagagtgagaccccatctcaaaaaaaaaaaaaaaaaaaaaaaaaaattgaaaacgtaaatagtattaataaaatgatttaaaaaccacagtattcttaacaaaatgtcaagtttataagcagtaagtatcattttaaaatcacattgcatgtataccttgaattcggaaatgtgaatgctttggatctcattatctgagacggagagggctctgcaaattataccacacagtggattcacagtgttttcaaacactgcagacagagccactcgtaacttggagtcatgactacagcagtagtcagaggccatgcaacaattttcaaagtggggttcaaagaactg

SEQ ID NO: 145146 - DNA, 601 bp, Human
agatgtaataatggtattgtagttttgtttttttaaaatgcattgtatagcaaggaagggtctacatatgtaacaattctccaatttctcactgaaagtatttaaataaagaattgggcctgtcacagtggctcatgcctataatcccaacattttgggaggccaagacaggcagactccttgagcccaggagttcaagaccagcctaggcaacatggtgaaatgccgtctctaccgaaaatacaaaaaattagccaggcatggtagcacacacctgtggtcccagctactcaggaggctraggtgggaggatcgcctgagcctgggagtttgagactacagtgagccaagactgcaccactgcactccagcctatgtgacagagtgagaccccatctcaaaaaaaaaaaaaaaaaaaaaaaaaaattgaaaacgtaaatagtattaataaaatgatttaaaaaccacagtattcttaacaaaatgtcaagtttataagcagtaagtatcattttaaaatcacattgcatgtataccttgaattcggaaatgtgaatgctttggatctcattatctgagacggagagggctctgcaaatta

SEQ ID NO: 145147 - DNA, 601 bp, Human
accgtattatttcaacaaataatttcaaaacaaaaaacaaagagggattgaaagagacttaaaagaaccataaaccaaaggcaatgtgtagatctgaactctgattctttatttttttttatttgaactctgattctaacaaaccaactggaagaaaaattctaagacaatcaggataatttaattcctgactagatatgtgatgatgataaggaactaatgtcaattttaagatgtaataatggtattgtagttttgtttttttaaaatgcattgtatagcaaggaagggtctacatatktaacaattctccaatttctcactgaaagtatttaaataaagaattgggcctgtcacagtggctcatgcctataatcccaacattttgggaggccaagacaggcagactccttgagcccaggagttcaagaccagcctaggcaacatggtgaaatgccgtctctaccgaaaatacaaaaaattagccaggcatggtagcacacacctgtggtcccagctactcaggaggctaaggtgggaggatcgcctgagcctgggagtttgagactacagtgagccaagactgcaccactgcactcca

SEQ ID NO: 145148 - DNA, 601 bp, Human
tttcacaaaatcctggattataacctttcatataaactgaaattaaaatatgtatcctaatttttaagagttatagatttaaaaaatggaaatactctgaactgtaagaacaacggtggttttgagcctgttttgttttccaaacgcaacaaacaacacaatgaaaatctatttgaagatggaggagaagatccatttatgacagtgaaaacattgaaaacacaaatacaacaaaacattaggaacaagaaatgtgtaaatccaatgtgtgaaaaatatatacaacactcccttcagatcmcaaaagcttaacaaatggtaaaacgtatgtgttcttgaacaggcggacagacagccttaacatcatgaaaacgccagctctctcgataatctatatacttacaggagtcttcccccaacaacactgggtgtcttccctgcaactagaaaaattggtttcaaagtttatgtggaatataagacaagcaatgatagcaaaacaaactaataacaaccctagtaaagaagagaaatcaaagggaatgatccttattttgtattgaacacagttgatgccagcactaaagcagtgatactgccg

SEQ ID NO: 145149 - DNA, 601 bp, Human; identical to SEQ ID NO: 18039

SEQ ID NO: 145150 - DNA, 601 bp, Human; identical to SEQ ID NO: 18040

SEQ ID NO: 145151 - DNA, 601 bp, Human; identical to SEQ ID NO: 18041

SEQ ID NO: 145152 - DNA, 601 bp, Human; identical to SEQ ID NO: 18042

SEQ ID NO: 145153 - DNA, 601 bp, Human; identical to SEQ ID NO: 18043

SEQ ID NO: 145154 - DNA, 601 bp, Human; identical to SEQ ID NO: 18044

SEQ ID NO: 145155 - DNA, 601 bp, Human; identical to SEQ ID NO: 18045

SEQ ID NO: 145156 - DNA, 601 bp, Human; identical to SEQ ID NO: 18046

SEQ ID NO: 145157 - DNA, 601 bp, Human; identical to SEQ ID NO: 18047

SEQ ID NO: 145158 - DNA, 601 bp, Human; identical to SEQ ID NO: 18048

SEQ ID NO: 145159 - DNA, 601 bp, Human; identical to SEQ ID NO: 18049

SEQ ID NO: 145160 - DNA, 601 bp, Human; identical to SEQ ID NO: 18050

SEQ ID NO: 145161 - DNA, 601 bp, Human; identical to SEQ ID NO: 18051

SEQ ID NO: 145162 - DNA, 601 bp, Human; identical to SEQ ID NO: 18052

SEQ ID NO: 145163 - DNA, 601 bp, Human; identical to SEQ ID NO: 18053

SEQ ID NO: 145164 - DNA, 601 bp, Human; identical to SEQ ID NO: 18054

SEQ ID NO: 145165 - DNA, 601 bp, Human
ctctcacctcctctgcccaaattctgtcagcactaggaggagagcatttggacttagtgtccaggagattgattgtgaggactcacaaatgattggtcaataataatcgtttaaaaatggtttctacatgtcatataggtatatagatagatgtggtttactgggaaacctccacagtcatgatgatcatgaattacagtctcgagtcaacttaccatctgtgagcccaagaagcagatgaaatgatatatcatgaaaataacatggtcttaatatttgcacctgactttgaattttggtsttgccactcaatctcaacccaacctctctgagccacaatctcctcatccacaagggatgatattagggcctatcttacattgtggttgtgaagaccaaatgagataacatatgcagaactcctgacacagaacccagaccctcaataagaggctgctgccatgattcctattaagtttccctcagatcaaccagaaggaaaccaggcagaggactatggtggtcagcaacagtgtgaccccaaagactctatcttgggaccagcatgacctcccatggggccctacaccatatggagcag

SEQ ID NO: 145166 - DNA, 601 bp, Human
cccaaaggaaacagaactgacactgtcagtaattgtctcttccaagtgggattttgtgtggatagggcttcatggaaacacttgggaggatttgacttggcctcccaaaggccactgttctcaagtggctcccctataaggtagtccagggtcctctcacctcctctgcccaaattctgtcagcactaggaggagagcatttggacttagtgtccaggagattgattgtgaggactcacaaatgattggtcaataataatcgtttaaaaatggtttctacatgtcatataggtatatagakagatgtggtttactgggaaacctccacagtcatgatgatcatgaattacagtctcgagtcaacttaccatctgtgagcccaagaagcagatgaaatgatatatcatgaaaataacatggtcttaatatttgcacctgactttgaattttggtcttgccactcaatctcaacccaacctctctgagccacaatctcctcatccacaagggatgatattagggcctatcttacattgtggttgtgaagaccaaatgagataacatatgcagaactcctgacacagaacccagaccctcaata

SEQ ID NO: 145167 - DNA, 601 bp, Human
tagtgaatgtcctgacaccattactgtcattcacctaaccctcctttacgatctcctcaaaggcccttacagtcccaagtgggtccaggaaagaaccacgtggttcatttgaaaacacacccaaaggaaacagaactgacactgtcagtaattgtctcttccaagtgggattttgtgtggatagggcttcatggaaacacttgggaggatttgacttggcctcccaaaggccactgttctcaagtggctcccctataaggtagtccagggtcctctcacctcctctgcccaaattctgtcagcactaggaggagagcatttggacttagtgtccaggagattgattgtgaggactcacaaatgattggtcaataataatcgtttaaaaatggtttctacatgtcatataggtatatagatagatgtggtttactgggaaacctccacagtcatgatgatcatgaattacagtctcgagtcaacttaccatctgtgagcccaagaagcagatgaaatgatatatcatgaaaataacatggtcttaatatttgcacctgactttgaattttggtcttgccactcaatctcaacccaacctctc

SEQ ID NO: 145168 - DNA, 601 bp, Human
tctctactaaaaaagatacaaaaattagccgggtgtggtggtgctcgcctatcatttcatctacttggaaggctgaggcgggagaatcacttgaacccaggaagcagaggtttcagtgagccgagactgtgccactgcactccagcctgggcaacagagcaagacttcatctcaaaaaaacaaaaaacaaaaaagaaaaagaaaaagaaaaaaaaaagaaatatgaataaaggaaggttggaacaccaggtggctgtcggcctgttgaagaagctattgtaaggtggaaaatgcataccakcaagtgtgaccctaatgcacacatacattcctgacattctgtagtcacttggttccccgcctcctgcgtaaaggaattgattcctctgttggcaattcttgcatcccatctccaggtctcatttccatctgtaggctatgcagctataatcacacctggcatctcaactgctaatgcatcagccagtctgactctgtcccaaccctggatgaaggagactgagtgacttacataatgactttgctcttcttctctgaggtgggtgagccaccaaacacccagcaataatgggatagattt

SEQ ID NO: 145169 - DNA, 601 bp, Human
taaatatggacttgagctttttccaataacctgactggaaagtcatttttcttatccccaatatagcaccagcatgttaagttacagagaatataattctttcatcagcctgacaaataaacaagtgtataggctacctatgctagaaggaggcgataagataaactccaaatctgactctatttagaaatatgaataaaggggctgggcccggtggctcatgcctgtaatcccagcactatgggagaccaagacgggcggatcacctgaggtcaggagtttgagactagcttggccaacrtggtgaaaccccgtctctactaaaaaagatacaaaaattagccgggtgtggtggtgctcgcctatcatttcatctacttggaaggctgaggcgggagaatcacttgaacccaggaagcagaggtttcagtgagccgagactgtgccactgcactccagcctgggcaacagagcaagacttcatctcaaaaaaacaaaaaacaaaaaagaaaaagaaaaagaaaaaaaaaagaaatatgaataaaggaaggttggaacaccaggtggctgtcggcctgttgaagaagctattgtaaggtgg

SEQ ID NO: 145170 - DNA, 601 bp, Human
tgacactgatgtgaatgtggagagcgacatattattttcttccggtctcataagaaatgttttctccatttacccaaatctcttgtctgaataatacaccagttgatcagcactgatctctagtgagcacctatcatgtcttgaagagagcatttactacaggctgagctctcttcaagacatgataggtatgattccagccagcccatgtggtcagcattattatgatttccacagacaagaacatggagacacagaaagtttgcataagttgccaagagcacacagctaattacaaggraagccaggttttgaagtctagtagtctgactctggactctgtcctcagtccctacggctatgactacctcctaactctactacctagttatttttattccctggttaaagagaagaaatgaccatagatctggagggatccaggcagacacaggttcaaatctcagcccctgtgtgagttgtttcaccttgctaatccctagtatccccagtggtgtagggggataatacaatctaaatctttcataaatatctatctcaaagtcatgtatcctggatctgctgagacaggttcccacca

SEQ ID NO: 145171 - DNA, 601 bp, Human
tttcccgttaggatatgagttacaattccctgagaatcttcagggctgacaaaaagcagagctcttaatgctcagtgtttaggttagggaaggcagaggatagaatgaagaaaggatggatggaagcaaggagaaaagtgttgcaaagccaggattcaaatctaggttgatctgactcctaaactagctctacgccatatggaaataaccccgggccaagaaaacctggaaatatggttgcaaatcaggataacaatgataataaaagcaaacctttaaataatacttaccatgggccagrctctattctaagcatgcaatccttaccacagccctaggagataggtacccttattataaccatcatatagatgaggaaactgaagcacagtgaagtctgtaatgtgcccagaatcacatagccaacattattaaaagtaatctgtaacgtgcaacgtctaacgtggcaaaacaacatggttccaattctactattgtggctggaaacttatagcacaaaggacctgaagcggcttggaaatcacctagctcaatctctgccttctagagataagggaccttgggctcaggtggcaggtga

SEQ ID NO: 145172 - DNA, 601 bp, Human
gctcctcccatcagattgtgagggcctttcccgttaggatatgagttacaattccctgagaatcttcagggctgacaaaaagcagagctcttaatgctcagtgtttaggttagggaaggcagaggatagaatgaagaaaggatggatggaagcaaggagaaaagtgttgcaaagccaggattcaaatctaggttgatctgactcctaaactagctctacgccatatggaaataaccccgggccaagaaaacctggaaatatggttgcaaatcaggataacaatgataataaaagcaaaccwttaaataatacttaccatgggccaggctctattctaagcatgcaatccttaccacagccctaggagataggtacccttattataaccatcatatagatgaggaaactgaagcacagtgaagtctgtaatgtgcccagaatcacatagccaacattattaaaagtaatctgtaacgtgcaacgtctaacgtggcaaaacaacatggttccaattctactattgtggctggaaacttatagcacaaaggacctgaagcggcttggaaatcacctagctcaatctctgccttctagagataag

SEQ ID NO: 145173 - DNA, 601 bp, Human
ctgtttcacctgcccctgtgtctctaacatctccctgccagcacccccgacactacattgttcttttcagctgacacatctgctcctcccatcagattgtgagggcctttcccgttaggatatgagttacaattccctgagaatcttcagggctgacaaaaagcagagctcttaatgctcagtgtttaggttagggaaggcagaggatagaatgaagaaaggatggatggaagcaaggagaaaagtgttgcaaagccaggattcaaatctaggttgatctgactcctaaactagctctacrccatatggaaataaccccgggccaagaaaacctggaaatatggttgcaaatcaggataacaatgataataaaagcaaacctttaaataatacttaccatgggccaggctctattctaagcatgcaatccttaccacagccctaggagataggtacccttattataaccatcatatagatgaggaaactgaagcacagtgaagtctgtaatgtgcccagaatcacatagccaacattattaaaagtaatctgtaacgtgcaacgtctaacgtggcaaaacaacatggttccaattctacta

SEQ ID NO: 145174 - DNA, 601 bp, Human
gcttgcagggaggaggagcctggcctctcctgttcctaggtggtgacctgggattccaactgagagatggaaacctgttaacgggaacccctctcactttgctgtgttgtttttcttttttccttttcacccaatatattttgtaacctctcactcttcaaagtgcctgcatgcctaatctttcctggtcatgtgagaagaactcatttttttcctacaacagaatcaggtgattggagaaaagatcacaggcctaggcacccaaggcttgaaggatgaaagaatgaaagatggacggaasaaaattaggaccttaattctttgttcagttcagtgtaaatctacttagcccttgagaggacaaaagaaaggtcttcagtggattcttccctgttctctcgtttctggtagagcttaagagtttccttcctttgtgcctgtttcacctgcccctgtgtctctaacatctccctgccagcacccccgacactacattgttcttttcagctgacacatctgctcctcccatcagattgtgagggcctttcccgttaggatatgagttacaattccctgagaatcttcagggctgacaaaaagc

SEQ ID NO: 145175 - DNA, 601 bp, Human
tctagatgagtagccattcatcttcagtctgtacccctttcaaatgcatcctgaacccctgggacgcctttgaaaaaaatgccattttttttcctttttcctcctgtcctctcttcattgataggtaattgtgtctctgtattatgggacactcccttcagatggatcctccaaactgggaaaagttaatgtcccaaaccttaagctggttggcttaggactaggctcagcggaagggaacccagaagcctgatgtaccatcaaaagggtaaaagttttttttttttttttttttttttarccaatcaggctttttgcccccttctccccatacaaactggtaaaagcccctgggatttttgagctgtccttaccacacactcttatttcatatttatacgtgttttctaataactcagtttgtctcttcttcaggccatgaaactccagtcatgcaactggagccttgggcaatggccccttctcgtgggaacccttggataggcccctgagggcaatttgactgccgttttcccaaaacagcaccccctgtcaacaggaagcagttaagatctgtcctcatccttatccttatccttat

SEQ ID NO: 145176 - DNA, 601 bp, Human
caggtaagcatgactgattcctgctgattaagccaagcttcccatttcatggataaaaacaccctcttatatcacactagtattcatggcataaatgaggtctaggtaattcaaggctattgacagcaggagaaagagggcatatgtgggtaatagtggatactcctaccccgcaagcccccccccattaacatgggtgaaagcctctttaacacccatgggtggcacccttcatggtcaccaggactcagagatagaaggaggaaggagagaaaaaggaatgcctcattttccctccctyatgtaccctaggtatttgctaggaagagaaaggagccagggacacctattcccctctttctagatgagtagccattcatcttcagtctgtacccctttcaaatgcatcctgaacccctgggacgcctttgaaaaaaatgccattttttttcctttttcctcctgtcctctcttcattgataggtaattgtgtctctgtattatgggacactcccttcagatggatcctccaaactgggaaaagttaatgtcccaaaccttaagctggttggcttaggactaggctcagcggaagggaacc

SEQ ID NO: 145177 - DNA, 601 bp, Human
ggatctgagggatccagaggcagatgataacagcagttaaaaggcacagcacaggtaagcatgactgattcctgctgattaagccaagcttcccatttcatggataaaaacaccctcttatatcacactagtattcatggcataaatgaggtctaggtaattcaaggctattgacagcaggagaaagagggcatatgtgggtaatagtggatactcctaccccgcaagcccccccccattaacatgggtgaaagcctctttaacacccatgggtggcacccttcatggtcaccaggactcrgagatagaaggaggaaggagagaaaaaggaatgcctcattttccctccctcatgtaccctaggtatttgctaggaagagaaaggagccagggacacctattcccctctttctagatgagtagccattcatcttcagtctgtacccctttcaaatgcatcctgaacccctgggacgcctttgaaaaaaatgccattttttttcctttttcctcctgtcctctcttcattgataggtaattgtgtctctgtattatgggacactcccttcagatggatcctccaaactgggaaaagttaatg

SEQ ID NO: 145178 - DNA, 601 bp, Human
caaccccccaagacacatttttgttccaaactcaattccaagctttgggtcaaagccctaggaaagaaaactggatctgagggatccagaggcagatgataacagcagttaaaaggcacagcacaggtaagcatgactgattcctgctgattaagccaagcttcccatttcatggataaaaacaccctcttatatcacactagtattcatggcataaatgaggtctaggtaattcaaggctattgacagcaggagaaagagggcatatgtgggtaatagtggatactcctaccccgcaagcccccccccattaacatgggtgaaagcctctttaacacccatgggtggcacccttcatggtcaccaggactcagagatagaaggaggaaggagagaaaaaggaatgcctcattttccctccctcatgtaccctaggtatttgctaggaagagaaaggagccagggacacctattcccctctttctagatgagtagccattcatcttcagtctgtacccctttcaaatgcatcctgaacccctgggacgcctttgaaaaaaatgccattttttttcctttttcctcctgtcctctcttcatt

SEQ ID NO: 145179 - DNA, 601 bp, Human
gagaaggactcaattccacagcttcactttagtattcagcttatgataaggagtccatgcaaccccccaagacacatttttgttccaaactcaattccaagctttgggtcaaagccctaggaaagaaaactggatctgagggatccagaggcagatgataacagcagttaaaaggcacagcacaggtaagcatgactgattcctgctgattaagccaagcttcccatttcatggataaaaacaccctcttatatcacactagtattcatggcataaatgaggtctaggtaattcaaggctrttgacagcaggagaaagagggcatatgtgggtaatagtggatactcctaccccgcaagcccccccccattaacatgggtgaaagcctctttaacacccatgggtggcacccttcatggtcaccaggactcagagatagaaggaggaaggagagaaaaaggaatgcctcattttccctccctcatgtaccctaggtatttgctaggaagagaaaggagccagggacacctattcccctctttctagatgagtagccattcatcttcagtctgtacccctttcaaatgcatcctgaacccct

SEQ ID NO: 145180 - DNA, 601 bp, Human
tgtgaaccaaccagcaatctctggctgcagctcagaagaaacaagagggatgggtaatgtaaaaatctggatcaatattctagttctgagccattatcttgcaaatcccgccagatgacaggaataaatagagtgcccctaacccagaggtttcctttttgggaaagtaagaccaagagagaaaaccaaagccaagcacatgcatccaaagagatccttttctctgcctgtatgtgtcataagacatccttttctctcccttgttagagaaggactcaattccacagcttcactttagtaytcagcttatgataaggagtccatgcaaccccccaagacacatttttgttccaaactcaattccaagctttgggtcaaagccctaggaaagaaaactggatctgagggatccagaggcagatgataacagcagttaaaaggcacagcacaggtaagcatgactgattcctgctgattaagccaagcttcccatttcatggataaaaacaccctcttatatcacactagtattcatggcataaatgaggtctaggtaattcaaggctattgacagcaggagaaagagggcatatgtgggtaa

SEQ ID NO: 145181 - DNA, 601 bp, Human
ttgtcattaaattctcaactcattagttgtttttaaaagtttttgcctacattttagactaaccctgattgttcctgtgaaccaaccagcaatctctggctgcagctcagaagaaacaagagggatgggtaatgtaaaaatctggatcaatattctagttctgagccattatcttgcaaatcccgccagatgacaggaataaatagagtgcccctaacccagaggtttcctttttgggaaagtaagaccaagagagaaaaccaaagccaagcacatgcatccaaagagatccttttctctscctgtatgtgtcataagacatccttttctctcccttgttagagaaggactcaattccacagcttcactttagtattcagcttatgataaggagtccatgcaaccccccaagacacatttttgttccaaactcaattccaagctttgggtcaaagccctaggaaagaaaactggatctgagggatccagaggcagatgataacagcagttaaaaggcacagcacaggtaagcatgactgattcctgctgattaagccaagcttcccatttcatggataaaaacaccctcttatatcacact

SEQ ID NO: 145182 - DNA, 601 bp, Human
cataattattctagctgcactttatgcaaataatcaggccaagtataagactaaaatgtattttgcaaacaactctatcccatcatgatttttttaaacaaaaatgagtattggagagagaggaattatgtttcaaaacctgttataagtttgtcattaaattctcaactcattagttgtttttaaaagtttttgcctacattttagactaaccctgattgttcctgtgaaccaaccagcaatctctggctgcagctcagaagaaacaagagggatgggtaatgtaaaaatctggatcaayattctagttctgagccattatcttgcaaatcccgccagatgacaggaataaatagagtgcccctaacccagaggtttcctttttgggaaagtaagaccaagagagaaaaccaaagccaagcacatgcatccaaagagatccttttctctgcctgtatgtgtcataagacatccttttctctcccttgttagagaaggactcaattccacagcttcactttagtattcagcttatgataaggagtccatgcaaccccccaagacacatttttgttccaaactcaattccaagctttgggtc

SEQ ID NO: 145183 - DNA, 601 bp, Human
gtctgcctgcttgtcctagaatttggaaactagttgtgagtattctcttctcatggcaatacaattgtttgcatcactgcaataagaatccattttcttttgcaacaggaaacaattgtagaaactggttgttttaccaaggctttgactggaagggtattcttctctttaaggagtcaagcttgacttgcagagccaatacaagccccttggaaaaaaactggcctcatacctttgcctacacagtccctgtacagggttcctgacctgtggtcagtaaaaaatgtcattttctaacagrcccaggagttccaagtttatcttgggaccttaagaggagaggatcacccaactcacaagtatttgaggatacaaacccatggctgggctctgctttaaaaggtcttatctgagattccttgtgggacagagttccctcaaagccaatctaaaaggcctatgtagacataattattctagctgcactttatgcaaataatcaggccaagtataagactaaaatgtattttgcaaacaactctatcccatcatgatttttttaaacaaaaatgagtattggagagagaggaattatgtttca

SEQ ID NO: 145184 - DNA, 601 bp, Human
ttgtgccattggaataaggaaaaaatgtacaggactcatgaagagctaaaatgttcatgaatatcaagcaaaacaagagctaaccgaatgaactcacagaaaaccaaagcaatctttttgacttttgcttggaatattgctgggttttgttttgtttttcagagtcaaggaaacttattttgaactatttacagcctttaacaactgagtaaggtatactctgtgaacaaaatttggagcatgtttctttctgtctgcctgcttgtcctagaatttggaaactagttgtgagtattctctwctcatggcaatacaattgtttgcatcactgcaataagaatccattttcttttgcaacaggaaacaattgtagaaactggttgttttaccaaggctttgactggaagggtattcttctctttaaggagtcaagcttgacttgcagagccaatacaagccccttggaaaaaaactggcctcatacctttgcctacacagtccctgtacagggttcctgacctgtggtcagtaaaaaatgtcattttctaacaggcccaggagttccaagtttatcttgggaccttaagaggagaggatcacc

SEQ ID NO: 145185 - DNA, 601 bp, Human
tgttaagttattggataccatgagataatcaaacttcgttgtcaattgtgtttctaactctaacgaccccggacatttgataattgttgtcttgttttaatctctttcaaaagacggtttataataagctacagaactttggcagacactctcaaatacaggtttctgataactttggagattgtgccattggaataaggaaaaaatgtacaggactcatgaagagctaaaatgttcatgaatatcaagcaaaacaagagctaaccgaatgaactcacagaaaaccaaagcaatctttttkacttttgcttggaatattgctgggttttgttttgtttttcagagtcaaggaaacttattttgaactatttacagcctttaacaactgagtaaggtatactctgtgaacaaaatttggagcatgtttctttctgtctgcctgcttgtcctagaatttggaaactagttgtgagtattctcttctcatggcaatacaattgtttgcatcactgcaataagaatccattttcttttgcaacaggaaacaattgtagaaactggttgttttaccaaggctttgactggaagggtattcttctct

SEQ ID NO: 145186 - DNA, 601 bp, Human
ctttaggctatattttggtgaataacatcaatatatgttccagaattgtatgggatttctaaaattctaatgtctaagtatatgctatcataattaaggttatgttaagttattggataccatgagataatcaaacttcgttgtcaattgtgtttctaactctaacgaccccggacatttgataattgttgtcttgttttaatctctttcaaaagacggtttataataagctacagaactttggcagacactctcaaatacaggtttctgataactttggagattgtgccattggaataargaaaaaatgtacaggactcatgaagagctaaaatgttcatgaatatcaagcaaaacaagagctaaccgaatgaactcacagaaaaccaaagcaatctttttgacttttgcttggaatattgctgggttttgttttgtttttcagagtcaaggaaacttattttgaactatttacagcctttaacaactgagtaaggtatactctgtgaacaaaatttggagcatgtttctttctgtctgcctgcttgtcctagaatttggaaactagttgtgagtattctcttctcatggcaatacaatt

SEQ ID NO: 145187 - DNA, 601 bp, Human
aaactgtgtttcctgatatctggatttttggatgtttcagagggcctctggagtatccagaaaagagaagtaaataggattatttgacatgtttacgtacatgggattgctacagtggtatacaatcttctttaggctatattttggtgaataacatcaatatatgttccagaattgtatgggatttctaaaattctaatgtctaagtatatgctatcataattaaggttatgttaagttattggataccatgagataatcaaacttcgttgtcaattgtgtttctaactctaacgacccyggacatttgataattgttgtcttgttttaatctctttcaaaagacggtttataataagctacagaactttggcagacactctcaaatacaggtttctgataactttggagattgtgccattggaataaggaaaaaatgtacaggactcatgaagagctaaaatgttcatgaatatcaagcaaaacaagagctaaccgaatgaactcacagaaaaccaaagcaatctttttgacttttgcttggaatattgctgggttttgttttgtttttcagagtcaaggaaacttattttgaactatt

SEQ ID NO: 145188 - DNA, 601 bp, Human
gcctaaaagaaggtaagtgcttggatcaaatattttttaaagggaagataaaagctgtggtaatttcacgtggctttaatcgttgaaaaataaaaacattgttggttataaaaaataattattggtaagaagcagatgtcatcaaaatataaataggtggactaaattatgcaggtcagatcctaggttggctaaatgttttaaggttataggctgcttttttggcttttgagaacttttcaatttgccagcttcacaactggtaaggcctggggacatgtggaactaaccacacccttarttatgctggaaggagtcaaaccttggctgcatctagcacataatcaaaacaaattaccaggttctacattaaaaaattgctaactgttaccattatgacatgtaattgagactactggaaatagatttatgtgcaaggcgtgtaagaacagtaaaatgtgtttttaataaaaggttagaaaaaggcataaaaatataaattcttgcctaaggctaaataattgttttaaattagatataataaagctaaaagtttaaacaaatggtggaaggattgtaaaaattaatcttacaaaattcc

SEQ ID NO: 145189 - DNA, 601 bp, Human
tttaatgcacatatgagaggggagagacctctgttttcttcatggaaccccaggaattaatagtacctggaggtcaataatccaaataggagattggcaaacaaaagatcttatggggactgggttttcttctgcctgtctgtgtagttatatatgtgttgtgtgtgtgtgatgtctgtaaaaagatctttaattaattggcctaaaagaaggtaagtgcttggatcaaatattttttaaagggaagataaaagctgtggtaatttcacgtggctttaatcgttgaaaaataaaaacatttttggttataaaaaataattattggtaagaagcagatgtcatcaaaatataaataggtggactaaattatgcaggtcagatcctaggttggctaaatgttttaaggttataggctgcttttttggcttttgagaacttttcaatttgccagcttcacaactggtaaggcctggggacatgtggaactaaccacacccttagttatgctggaaggagtcaaaccttggctgcatctagcacataatcaaaacaaattaccaggttctacattaaaaaattgctaactgttaccattatgaca

SEQ ID NO: 145190 - DNA, 601 bp, Human
cttttgcccactaagttccgtaacccctctcccttcaaagtgtctgcatgcctaatctttcctggtcatgtgacaagaacccggtttcttcctacaacatttttttggtgcccagaacatgggatctgaggaaaggagggtggaatggggacccaaaacctttaacttttgcttctgagccttttggttctatggcatttatcttctttgttttggaacagtaatgacaactatctttccttttacaatacaatactggaggtggtccacacccaccccaagggccacagacacgcgcgcrggacagttgggccaggcagctgcctgtccctgcttccctaccgactggagtgcatggctgtagtgtgtgcctcatgtgtgtgcagtgtccaacggccatgcagggtaagtatgagccacaactgctgcctgggccccaagcaactggctggcattccctgccacgtgtccacagagttcccccctcccccagccagagagtccagctctgtcccacaatagtttagcttctctccctggtgcagaaaccatttgccataagaataagaggttcttcccccagtcatccttttctcttctc

SEQ ID NO: 145191 - DNA, 601 bp, Human
atggttgtgcttcttagctgatctaaccaattgacatttctagagatttttcatatagaattgatagatgcaggaggcagatgagggggaaggtcccagggaatctctaacaggcctgtgcactgggaggacagggtggggccgcaaaaagttcctgctgcttgcagcggggaggagcctggcctctcctgttcctgggtggggacttgggatgctatctgtgagatggcggcctgttaataggaacccttctcgctttgctgagtggtttttcctttttccttttgcccactaagttccrtaacccctctcccttcaaagtgtctgcatgcctaatctttcctggtcatgtgacaagaacccggtttcttcctacaacatttttttggtgcccagaacatgggatctgaggaaaggagggtggaatggggacccaaaacctttaacttttgcttctgagccttttggttctatggcatttatcttctttgttttggaacagtaatgacaactatctttccttttacaatacaatactggaggtggtccacacccaccccaagggccacagacacgcgcgcgggacagttgggccaggcag

SEQ ID NO: 145192 - DNA, 601 bp, Human
tagaaacaaagatttgccgttcatgtaggttttctgtgcgtttttcttgggacatggttgtgcttcttagctgatctaaccaattgacatttctagagatttttcatatagaattgatagatgcaggaggcagatgagggggaaggtcccagggaatctctaacaggcctgtgcactgggaggacagggtggggccgcaaaaagttcctgctgcttgcagcggggaggagcctggcctctcctgttcctgggtggggacttgggatgctatctgtgagatggcggcctgttaataggaacscttctcgctttgctgagtggtttttcctttttccttttgcccactaagttccgtaacccctctcccttcaaagtgtctgcatgcctaatctttcctggtcatgtgacaagaacccggtttcttcctacaacatttttttggtgcccagaacatgggatctgaggaaaggagggtggaatggggacccaaaacctttaacttttgcttctgagccttttggttctatggcatttatcttctttgttttggaacagtaatgacaactatctttccttttacaatacaatactggaggtggtc

SEQ ID NO: 145193 - DNA, 601 bp, Human
agattagcagttgaatcagtagactgagaaaagatcagccttcaccaatgtggatggacgtcatctaatcctttgagggcccaaataaatcaaaaggagggaaaagggtgaattcactctctttgtttgagctgggacattcatattctcttgcccttggagattggagctcctggttctcaggcctttgaactccaggacttacaccatttgggctcatggttctcaggcctttggacttggactgaattaaactgctggctttcctggtgttccagcttgcggacagcagattgtgagwtttctcagcctctgtaattatgtgagccaattcctataataaatctcctgttataaacctcgctatattccattggttctgttttactggagaattctgaccatacactttatttctctacagaggaatttattattttgtagctagaaacaaagatttgccgttcatgtaggttttctgtgcgtttttcttgggacatggttgtgcttcttagctgatctaaccaattgacatttctagagatttttcatatagaattgatagatgcaggaggcagatgagggggaaggtcccagggaa

SEQ ID NO: 145194 - DNA, 601 bp, Human
taattttatgtgtcaacttgactgagccaagggatcctcagacagctgataaaacttcatttctggatgtgtctgtgagggtggaagagattagcagttgaatcagtagactgagaaaagatcagccttcaccaatgtggatggacgtcatctaatcctttgagggcccaaataaatcaaaaggagggaaaagggtgaattcactctctttgtttgagctgggacattcatattctcttgcccttggagattggagctcctggttctcaggcctttgaactccaggacttacaccatttgrgctcatggttctcaggcctttggacttggactgaattaaactgctggctttcctggtgttccagcttgcggacagcagattgtgagatttctcagcctctgtaattatgtgagccaattcctataataaatctcctgttataaacctcgctatattccattggttctgttttactggagaattctgaccatacactttatttctctacagaggaatttattattttgtagctagaaacaaagatttgccgttcatgtaggttttctgtgcgtttttcttgggacatggttgtgcttctta

SEQ ID NO: 145195 - DNA, 601 bp, Human
caatggtgcagactgagtgcccagcacagaacagccaatcccatttataggagtcaaggccttctctccttcattctttcatcctttaatcttttcatgtggaaagggtggggactaacaaaagatctgcagttccctttaagagtacttttagaggcttcctaacacatggtctatcctgagagagacagagaaagcagacaggtaataaacacctgtcaccttccatatgccaaatttttgaggctttggtgtcctatttttctctctaagaaaagactataaatgaaagttgctgtcwgtgcttatttcttaagatattttattctttaaaataaaatgggaaatgctaactggagatgagatgataatgaacgtgaagtggccaaaagaaagggggtctggaacttgacgggccttccttaaatggtataaacattgaagaagacgatggtaatttctttttcctttttttttggagacagagtcttgctctgtcgcccaggctagctcttggctcactgcaacctccgcctcctaggttcaagcgattctactgcctcagcctcccgagtagctgggattacaggcacacaccact

SEQ ID NO: 145196 - DNA, 601 bp, Human
aagttggggactgtgtcttttttattcattgctatattcccagactctataatggtttctggtacacaggagtgtcttaataaatattcattgaatggtagatgaatggatggataagtgaatggatgatagagagatgaatggatggataaataaatggatgatagatgaatggatggatgaagatgggtgcatggatgatagatggatggataatggatatatggatgacggatgaatggaagcagtgtgactagagtcaaaaaagagagatttcgaagaaagggttaatctgtcttgygccattttgatatgagtgctcagtacaatggtgcagactgagtgcccagcacagaacagccaatcccatttataggagtcaaggccttctctccttcattctttcatcctttaatcttttcatgtggaaagggtggggactaacaaaagatctgcagttccctttaagagtacttttagaggcttcctaacacatggtctatcctgagagagacagagaaagcagacaggtaataaacacctgtcaccttccatatgccaaatttttgaggctttggtgtcctatttttctctctaagaa

SEQ ID NO: 145197 - DNA, 601 bp, Human
cacaatgggctttttggtggagaagggatccatgggaagcaaaaacaacagagagagactgaaaaggaagccactgaagatatccaggcaaaagatgctactgctgtggagtagggtgattgattgcagtgggtggagtaagaagactagaactttgacatcaattttcaactagtacaccaatattccctgacgggttctagatgggctgtgaggaaaaagattgataaataaccacccctggtttctcgttgcacagataagttgtgcaatcacataggtacccgtattataaccatcttaagctattttttttggagttgggcaagacttcgaacaagcaagtgtggagaaaaaatcaaaagtggagtttgggacatgttacttttaggaagactgagaggcatcgtgtcaagtaagaagttggggactgtgtcttttttattcattgctatattcccagactctataatggtttctggtacacaggagtgtcttaataaatattcattgaatggtagatgaatggatggataagtgaatggatgatagagagatgaatggatggataaataaatggatgatagatgaatggatggat

SEQ ID NO: 145198 - DNA, 601 bp, Human
cgtgagctgttgcccctggccgagatctgtactcttaaaaatggttaagatagcaacattttatgttatgtgtatctgactacaattttaaaaaaatttaaaaagaacacaatgggctttttggtggagaagggatccatgggaagcaaaaacaacagagagagactgaaaaggaagccactgaagatatccaggcaaaagatgctactgctgtggagtagggtgattgattgcagtgggtggagtaagaagactagaactttgacatcaattttcaactagtacaccaatattccctgaygggttctagatgggctgtgaggaaaaagattgataaataaccacccctggtttctcgttgcacagataagttgtgcaatcacataggtacccgtattataaccatcataagctattttttttggagttgggcaagacttcgaacaagcaagtgtggagaaaaaatcaaaagtggagtttgggacatgttacttttaggaagactgagaggcatcgtgtcaagtaagaagttggggactgtgtcttttttattcattgctatattcccagactctataatggtttctggtacacaggagtg

SEQ ID NO: 145199 - DNA, 601 bp, Human
aaactcttgagctcaggtgatacgcccgcctcggcctcccaaagtgctgggattagaggcgtgagctgttgcccctggccgagatctgtactcttaaaaatggttaagatagcaacattttatgttatgtgtatctgactacaattttaaaaaaatttaaaaagaacacaatgggctttttggtggagaagggatccatgggaagcaaaaacaacagagagagactgaaaaggaagccactgaagatatccaggcaaaagatgctactgctgtggagtagggtgattgattgcagtgggtrgagtaagaagactagaactttgacatcaattttcaactagtacaccaatattccctgacgggttctagatgggctgtgaggaaaaagattgataaataaccacccctggtttctcgttgcacagataagttgtgcaatcacataggtacccgtattataaccatcataagctattttttttggagttgggcaagacttcgaacaagcaagtgtggagaaaaaatcaaaagtggagtttgggacatgttacttttaggaagactgagaggcatcgtgtcaagtaagaagttggggactgtg

SEQ ID NO: 145200 - DNA, 601 bp, Human
ggccagattagtttcaaacaagcctggctaatttttgtatttttagtagaaacagggttttgccatgttggccagattagtttcaaactcttgagctcaggtgatacgcccgcctcggcctcccaaagtgctgggattagaggcgtgagctgttgcccctggccgagatctgtactcttaaaaatggttaagatagcaacattttatgttatgtgtatctgactacaattttaaaaaaatttaaaaagaacacaatgggctttttggtggagaagggatccatgggaagcaaaaacaacaragagagactgaaaaggaagccactgaagatatccaggcaaaagatgctactgctgtggagtagggtgattgattgcagtgggtggagtaagaagactagaactttgacatcaattttcaactagtacaccaatattccctgacgggttctagatgggctgtgaggaaaaagattgataaataaccacccctggtttctcgttgcacagataagttgtgcaatcacataggtacccgtattataaccatcataagctattttttttggagttgggcaagacttcgaacaagcaagtgtgga

SEQ ID NO: 145201 - DNA, 601 bp, Human
aaatctgacaaggagaccaagagaatgcagtaatgaagaatgggaggttgacaggtagggtggctcaggaaggcatcttgagtagatgggaagatgaattaggaaaccagtttcagtaatcaaggattaagatgatggtggtccggagacagaagctgagatctgaaaggcaagaagctggatttcaaagaaaggaggcaagagctctccaggcggaagcactgcatgtgggtgcgaggggcatgaggactggactgtggcaccaaagggagggcatgtggccaaaacattctaagtgagrggcagagtggcaccagatgagatcagagtccagataagtcagagactttagaaatgaaatactatttaaacagaaatagaaaataggagtttcaattgtattctaagtgtacgtggggcccacaaagatttttgaggagaaagtatttgaagtttgcattttaaaaaacacatacctgttcattgcagcattattcacaacagccaaaaggtggaagcaacccaaatgttgtccatcagtggataagtagattaaaaaatgaatggacatacaacgggataccatttggtattaaaatgg

SEQ ID NO: 145202 - DNA, 601 bp, Human
gctagaaatctgacaaggagaccaagagaatgcagtaatgaagaatgggaggttgacaggtagggtggctcaggaaggcatcttgagtagatgggaagatgaattaggaaaccagtttcagtaatcaaggattaagatgatggtggtccggagacagaagctgagatctgaaaggcaagaagctggatttcaaagaaaggaggcaagagctctccaggcggaagcactgcatgtgggtgcgaggggcatgaggactggactgtggcaccaaagggagggcatgtggccaaaacattctaaktgagaggcagagtggcaccagatgagatcagagtccagataagtcagagactttagaaatgaaatactatttaaacagaaatagaaaataggagtttcaattgtattctaagtgtacgtggggcccacaaagatttttgaggagaaagtatttgaagtttgcattttaaaaaacacatacctgttcattgcagcattattcacaacagccaaaaggtggaagcaacccaaatgttgtccatcagtggataagtagattaaaaaatgaatggacatacaacgggataccatttggtattaa

SEQ ID NO: 145203 - DNA, 601 bp, Human
agtggttctcaactaggggtgattttgaacccccagccagggcacatttggccatgcctggagacacttggtcgtcacaactactgctgatataataatggggagcactattgccatctagtggggagaagccagggatgctgttaaacatcctgcaatgcacaggaaattcccaacaaagaattatctgtcacaaatatcaatagtgctgaggttgaaaaactgaatggtaagcttttgggcctgaaactaccatgttcaacttgtatatacaggatctagcacagtatctggaatgtcrcaagcactaaaagtattattacaatgttgaaagaaggaaggaagtaataaaacattcaatcttctgattaacaaaatgtgtctaacctcagctgagaaagggactgctgtatagtggaaagagtgtggactttgaagtaagagaactgagttccaatctctgctctgtagtttatatttcacttaggaaagccattaactcagattcaatttcatctgtaaaatgaagctaatatttattcattcaacaaaaatgtgttccacacctagtaaatcccaggctcaaggtaacttgttaaca

SEQ ID NO: 145204 - DNA, 601 bp, Human
attctactccacttccgtatgagataagtatatgaggagcttaattccagataaactaagcaagacaaaattaatagcagccactttttcctgaattgaagtttcagtataattgttgaatataaggaagataatgagaggactctcttggttctatctgtgctgggatttaggatttgcttgttagatatttaaatgcttcactgccaacctcaaacggtctggattgttttggccacgttcacttaaaacgccattggtcacagatggcggtttagatggtgttaggaatccagatgcrtggaacaaagtcagaagtctcggctcagaattgctcacagccattgcacctaagaggcttatggaattcttcctccagcaaagtggatgatcagcttacttcttaattgtgttgcctgaaatccaagaccccaaaggataatcaaatgcaaggcaaagttcactgctgaaactcaaaacccaactctgttctacgctgtatggatttccagtgcataattaaggtgttgttctaggagggcactgcagatcttgcaagaaaagccttccccagagatgacatcagattttcttcgaaagc

SEQ ID NO: 145205 - DNA, 601 bp, Human
acagcacatttccctgctcagaacatctgaatgttcagtacggcaactaagatcatgggcaaaaccagcctggtggaagcatcctgacaaaccatgtgacctaggacacatcatttgtgctttctggtctccagtttcctcatgggcagaatgatgaccataagcccatgcttttcatagatgtttaagggttaaatgaggtaatgcatgtcgagtgctcagccaactgagattcaggaagcgctcaatagatgctggctgtcattattaactgagtaagtaatccttttcccacagaagyagtagaaggctgacgatgtgtgtgaaaaggatggatacaattccctgggccacaaataaaggtttttttggttgttgttgttgtttaaatgaactgaaatgagtttgagagattcatatattattttacaatacttcttaatgctagtttaaaaagttcaacattgtcattctactccacttccgtatgagataagtatatgaggagcttaattccagataaactaagcaagacaaaattaatagcagccactttttcctgaattgaagtttcagtataattgttgaatataaggaagat

SEQ ID NO: 145206 - DNA, 601 bp, Human
atcagctctgcatgggtttgcgataattttgtgttttctgaagagcatgtctggttaggctagtcatgtgcccctgccagaagctgctgctacctttgaagctgggtgcagtgtggaggtcatggtgttgtggctgctggaaggggagtgaacactccttctgccacacagtcaccctgtgctttctgaacaccaggtcctcgtctgtcatggcggcctaacaacatctgcttcatagagggttagggagtgttacatgtgataatttctgtaacatttcttgcctacagtccagcatacrgaaggcattaagaaacctttgaaaaacaaacgagtgaatgaatgaatgagtatatgaatgagcagtgagcagttgttattcctgacttcctctggatctgttctctctcacccagcactgttccagcagtttgattgaggaactccattaataaccagcccaggataaatttagaaaaacgccaatgctcagccagctccatcttccttgaactgaagtcaacatttttggaattgctttcctggctgctactagataaatgactaataggacagagcccatgggctaaaaatagtgaat

SEQ ID NO: 145207 - DNA, 601 bp, Human
cagttgcaccttgacttaagcccaagtccacccttcccatctggctgaccttcggcaaatctgtgacctttttgagcctcagttaccttgtctgtaaagtagggataagcattccctgctttatctggttgctatgagatgatgtttatccaggattcggcatagagtgtgacacagagcaggtgctctgtacatgttaatttcttccatttctcagcttttgcccccttaccctagtgagcacgaaggataaagtccttttttgtggtactttccagagagtgccacattgcgtgttttygcccagtggtatactcaatgcagcagcttctgctcccttaccccacacagagcttggcacacaggaggcattccctcatgtacttgtgaaataaatgagagagtgaatgaatatgggtgatcaaatcagctctgcatgggtttgcgataattttgtgttttctgaagagcatgtctggttaggctagtcatgtgcccctgccagaagctgctgctacctttgaagctgggtgcagtgtggaggtcatggtgttgtggctgctggaaggggagtgaacactccttctgccacacagtcacc

SEQ ID NO: 145208 - DNA, 601 bp, Human
tggagaagtcactttctgagccgcacacatcagaggccttggagagaactgaatgatacaatgaggattgagggcctgggtgggctcagacactgaggaaacaggcttttctgcatgtcctccctttgcataagtaaaagaggcacatgaggccatggctcctacagcctccagagggcgcttttctgccactcttcccgtgccctggtctctaaattgctttgcacctggcaccgccccatccttcaagttgacctccataacaatccaatcatggggcggggggtcggggcggaccctyagaaaccaaggtgacaggtttccaggctcctaacttgggagcctgcagccctagactcctgggaatacatcacaatgcctcagcccaagggacaggaggagttagggaagcaagaagttggcttgtcgagggaagggagagagttaccttgtggagtcaaaggttcttaagtgggcaaagggagaggtgaggaaggaagtggacttgggggaggaagaagtggaagagacagggagggagataaaaaggcattaccttcagaactctgccagaaagcgtaggctttcatgcggaaggccg

SEQ ID NO: 145209 - DNA, 601 bp, Human
aaaagaagagaagaagacggcagagactagactatgcagtgtcccagcagagatcaccctccaggtcaacacaggtttattaactggttttctctgaataaaggctttcagccagtgaggaatccagatagctgtgttttcatacaaccacatttctgtcatatcctacataaaggtgtcaggaaaatccacgtccaaggctttgctgaggtctacacactgtaacactactgtgcttccctatctattggactgggaatcttgcggaaaataccatgatcagttggagaattcaccttastttctagaattcactgctacctttatgaagtgcttacatgctgataaagtttaggtaatagcatactttttttcattttcttgcagaattctaaagcaaaacagaaataggtagaatggattatggtctctgctgatacagacaaaaaaatactataatttattatcttgttaaaaatgcgaactaattaaaacaaactatatggatgaagttaggcagaagaaaaaccattttgagcaagaagcctctacaggaagaaaaccctccactctgacaccctttaaaatacatggtagttac

SEQ ID NO: 145210 - DNA, 601 bp, Human
aggcgtaagccaccatgcccggcctcttgattcttttataagtggaaggttcataatatttcttaagcctaactccctcactcattgtgttacctgccttgaagacatttgggaataaagagatgtaaatttaggcagtggactttctaaagaacatcttattcaaaattttgaagctttggaaggagaagagctgctctgttaagggacaaagctctctgtgttacaatgttgtcagggggctgatatctgagtgtcttctctggctttgtcctgggaggggtatcaatcaactcaaagrtaattatgcaggatggagaatgctctgggttctgctgatatgaagttttcttcctgtttcaataaagctcataagtctcctcttgttttgtaacagtgtgaaacaggtggggctattatcactttcaaaagttacaggaagaaatgtcatccacatggtctgggaagaggagtgagaacatttttgtacagaaacctttcaaatggccaccaactgaaacaagcttcaaactctttcttcattttacttaggagagtgacaacttcacccacataaaggaccccagcagaggtttggggg

SEQ ID NO: 145211 - DNA, 601 bp, Human
ctgggattacaggcgtaagccaccatgcccggcctcttgattcttttataagtggaaggttcataatatttcttaagcctaactccctcactcattgtgttacctgccttgaagacatttgggaataaagagatgtaaatttaggcagtggactttctaaagaacatcttattcaaaattttgaagctttggaaggagaagagctgctctgttaagggacaaagctctctgtgttacaatgttgtcagggggctgatatctgagtgtcttctctggctttgtcctgggaggggtatcaatyaactcaaaggtaattatgcaggatggagaatgctctgggttctgctgatatgaagttttcttcctgtttcaataaagctcataagtctcctcttgttttgtaacagtgtgaaacaggtggggctattatcactttcaaaagttacaggaagaaatgtcatccacatggtctgggaagaggagtgagaacatttttgtacagaaacctttcaaatggccaccaactgaaacaagcttcaaactctttcttcattttacttaggagagtgacaacttcacccacataaaggaccccagcaga

SEQ ID NO: 145212 - DNA, 601 bp, Human
gcacgcattctccaggtgcccacggtcccatcactccctattctatccccaggactgaggttaaatattaaaatattaagttgctttctatcatcacgttaatgctctcgattctttttttttttttttttttttgagatggagtctcactcttttgccaggctggaatgcagtggcatgatctcggctcactgcaacctctgactccctggttcaagcgattctcctgcctcagcctcccaagtagctgggactacaggcaggcgccaccacgcccagctaatttttgtatttttagtaragatggggtttcactatgttggccaggctggtctcgagctcctgacctcatgatccacccgcctcagcctcctgaagggctgggattacaggcgtaagccaccatgcccggcctcttgattcttttataagtggaaggttcataatatttcttaagcctaactccctcactcattgtgttacctgccttgaagacatttgggaataaagagatgtaaatttaggcagtggactttctaaagaacatcttattcaaaattttgaagctttggaaggagaagagctgctctgttaagggaca

SEQ ID NO: 145213 - DNA, 601 bp, Human
tccagctggctagtgttttctttggcctgcacggggttttaaaacatgtaagccatctcaaaaattgagaatttcatgtaaaagctggatattctgttttctggaaacagaggatctgcatccctaaaagaaggtagggcgctcatttctaaaagaaggtagagacttcattcctacctcttttagatggggcacgcattctccaggtgcccacggtcccatcactccctattctatccccaggactgaggttaaatattaaaatattaagttgctttctatcatcacgttaatgctctcrattctttttttttttttttttttttgagatggagtctcactcttttgccaggctggaatgcagtggcatgatctcggctcactgcaacctctgactccctggttcaagcgattctcctgcctcagcctcccaagtagctgggactacaggcaggcgccaccacgcccagctaatttttgtatttttagtagagatggggtttcactatgttggccaggctggtctcgagctcctgacctcatgatccacccgcctcagcctcctgaagggctgggattacaggcgtaagccaccatgccc

SEQ ID NO: 145214 - DNA, 601 bp, Human
tccatgtgctaaatccagctggctagtgttttctttggcctgcacggggttttaaaacatgtaagccatctcaaaaattgagaatttcatgtaaaagctggatattctgttttctggaaacagaggatctgcatccctaaaagaaggtagggcgctcatttctaaaagaaggtagagacttcattcctacctcttttagatggggcacgcattctccaggtgcccacggtcccatcactccctattctatccccaggactgaggttaaatattaaaatattaagttgctttctatcatcaygttaatgctctcgattctttttttttttttttttttttgagatggagtctcactcttttgccaggctggaatgcagtggcatgatctcggctcactgcaacctctgactccctggttcaagcgattctcctgcctcagcctcccaagtagctgggactacaggcaggcgccaccacgcccagctaatttttgtatttttagtagagatggggtttcactatgttggccaggctggtctcgagctcctgacctcatgatccacccgcctcagcctcctgaagggctgggattacaggcgta

SEQ ID NO: 145215 - DNA, 601 bp, Human
cctccttccggcctcttcacgcaggcaacccactgcctggacattgagaaaaggaggacacacaacatgcagtggcaggtcactagcatttcctaaggggtcaccatgaaatgcttgataattgtagctattatcaagtgtccactgtgcccgctaatattatgtatcaactcagtcctcacagcaacctaatagggtattataatccccatactacagatgaggaaaactgaggctcagaacaattaattaacttgcacgtgatcactcagtaaatgctgaatcagtgatttgatttccrtatcttttttgaatggtaggtagtagtactcaagtatcttatctccctttgaaaaacaatggtggggactgggcgcagtggctcatgtctgtaatcccagcactttggtaggccgagttgggcagatcacctgaggtcaggagttcgagaccagcctggccaacatggtgaaaccccatctctactaaaaatacaaaaattagctgggcatgatggcaggcgcctgtaatctcagctcctcaggaggctgaggcaggagaatcacttgaacctgggaggcagaggttgcagtgagtcaag

SEQ ID NO: 145216 - DNA, 601 bp, Human
gatacaacaaaaaggaataattcagatttgcttctacctctcctgcacgggtcccatttagggttttgaataaaacaaaaggattactatgatccttgaaaaactggcagtaccatttatctaatgtagagttaggcagatgatgctagattatgagctgtttgctgtgaaagcaagagtgagctgcatggtgctgtgagtgagcgggtttctctttccaccttgaatggatctcacctgtgcctgccctccttccggcctcttcacgcaggcaacccactgcctggacattgagaaaagkaggacacacaacatgcagtggcaggtcactagcatttcctaaggggtcaccatgaaatgcttgataattgtagctattatcaagtgtccactgtgcccgctaatattatgtatcaactcagtcctcacagcaacctaatagggtattataatccccatactacagatgaggaaaactgaggctcagaacaattaattaacttgcacgtgatcactcagtaaatgctgaatcagtgatttgatttccatatcttttttgaatggtaggtagtagtactcaagtatcttatctccctttgaa

SEQ ID NO: 145217 - DNA, 601 bp, Human
cctagaggaggaagtggccttgctaatgttgcccgggtcaaggagcaagagttctcaatttaggaacatttccttagacagaagcatgtggactgttagtctatgtttcttctacatggtgatttaagccctaaaaatacaagggcagtggttagcaagaactgagcttctcagaactgaagaccctacctagcagcttgctcttgcctgcctaaattggcaccttacttgaacttttgtgaatgaatatacatgagtgtatgtgcacacgtgtgtgatgttcttgctttgacaattcacractcaccaggaaacactgtcgtcaggtgtatcaccctattttacaggtgaggatatgagcaccatgatcagcagatgccaggatagcatctgagcctcaataataactgacaagggtcagttagaaaagttacaatctgactctgtcttatgcactttattgacttttgtgaattttatgacaatcccccaagatggatactattattatctctatttcacaggcaagagaacagacactgagaaatagagtggaaattataaattaaaatttaaaatgaaaacaaaattcttgatacaa

SEQ ID NO: 145218 - DNA, 601 bp, Human
gcagagagatgctttgaagtgttacaggcctgctgtgtcccctagaggaggaagtggccttgctaatgttgcccgggtcaaggagcaagagttctcaatttaggaacatttccttagacagaagcatgtggactgttagtctatgtttcttctacatggtgatttaagccctaaaaatacaagggcagtggttagcaagaactgagcttctcagaactgaagaccctacctagcagcttgctcttgcctgcctaaattggcaccttacttgaacttttgtgaatgaatatacatgagtgtrtgtgcacacgtgtgtgatgttcttgctttgacaattcacaactcaccaggaaacactgtcgtcaggtgtatcaccctattttacaggtgaggatatgagcaccatgatcagcagatgccaggatagcatctgagcctcaataataactgacaagggtcagttagaaaagttacaatctgactctgtcttatgcactttattgacttttgtgaattttatgacaatcccccaagatggatactattattatctctatttcacaggcaagagaacagacactgagaaatagagtggaaatta

SEQ ID NO: 145219 - DNA, 601 bp, Human
tcttgcaactcttaataatagaaacagctaataatttattttgtgcctcctacttgcaagccttgcacaccaggtattaatgttaatctagagaaaacctaggcaaggtcttctaggaagcaaaggcggaaagcagagagatgctttgaagtgttacaggcctgctgtgtcccctagaggaggaagtggccttgctaatgttgcccgggtcaaggagcaagagttctcaatttaggaacatttccttagacagaagcatgtggactgttagtctatgtttcttctacatggtgatttaagycctaaaaatacaagggcagtggttagcaagaactgagcttctcagaactgaagaccctacctagcagcttgctcttgcctgcctaaattggcaccttacttgaacttttgtgaatgaatatacatgagtgtatgtgcacacgtgtgtgatgttcttgctttgacaattcacaactcaccaggaaacactgtcgtcaggtgtatcaccctattttacaggtgaggatatgagcaccatgatcagcagatgccaggatagcatctgagcctcaataataactgacaagggtcagttagaaaa

SEQ ID NO: 145220 - DNA, 601 bp, Human
aagctgtagggtggttccggggggcctgtctcagaatagttgcagatgatggttttcaaatcggaatacctgttgtcctccttcttctctgcttcagctggcgaggaggtgcccttggttgggtaatactccgtgacctgcacctgcaaccgttccatgtgttgcatgtgcatatccacgaggaagtccagcttcttccccatgtcctgaacctggaaaatcaaaggagctgtgaattaccactttctctgagggtggggatcgttgctattggttgggaggaaatattctttttttttgyttttttttttttttttgagacgaagtctcagtctgtcacccaggctggagtgcagtggcgcgatctgggctcattgcaacttccgcctcccgggttcaagcagttctatgcctcagcctcccaagtagctgggattacaggcacccgccaccatgccaggctaatgtttgtattattagtagagacggggtttcacaatcttggccaggctggtcttgaactgacctcgtgatccacctgccttggcctcccaaaatgctgggattacaggcatgaaccaccgcgcctgaccggaaggaa

SEQ ID NO: 145221 - DNA, 601 bp, Human
tggaagagtacactgggaccgaccctttgtatgtcggcaaggtaagaaatgccaagtagaaatgacccgggtagtggatattgaaattgaatatgaattgagtatcaaagttgacctagcctttatctgagacctgagaaaaactagaacaagtggtacgttacttgacacctagctaaaatgtaacttctgctttgtcagagaccagtctgaaaggaaagatttatttccttgtccatgtctctggtatgaatgggaaaaagtgggaattgggatttggaggaaaaggctcagaccctgmaagagctattcaagtcctaaaagaggcagcagcagctgtctgggaatgacagaatgggggagagggaaacttggaaatacaagaagagtacagagttttttgctttgtgtttttgtggggtttttttcagagcatttccagaggtattgcctgaggtgcaaatttaatgaaaaaaataaaaataaaacatttttcatttcagaagatcttagcatgtgctttaggatagttggagacaataaatatatttataaatgttatatttgaattctcttgatttaatctatcattatttcatct

SEQ ID NO: 145222 - DNA, 601 bp, Human
gtttactttattggggtgttaattacagaccattttgtgaaagcaaccaagtgagagagaatgggagacaagaaactaattagaaaataactaattcattcaaatggtaacttaaacgcttgtttagcacagaggctgggagcatgggtttcagattcaaacacaggtgggttcaaagcccagccctgccaattatttctagaggaactttggacaggtcaccaagccctgctcatctcggcttcctcaaattcgaatgagattgagagaactgctccttctcaagtgttgtctacccaakttctttccccagtgtccactcacttcttaacccaggtatctggctttggtccctacctctgacccaaagctgtgttttcattgcttctcaagacctctctactgcccaatcacacctcccagtcacaaactcagacactgctgacctgtctctccttgactcattgtcctatctgtgccatgaccttcacaatcccgtttttccttcttttttctcagccgcgtttgtgggtcctctccttccacctgaccccatttgttggtgggcttgtcagctttgccctagcctcttctccacaca

SEQ ID NO: 145223 - DNA, 601 bp, Human
cctgccaattatttctagaggaactttggacaggtcaccaagccctgctcatctcggcttcctcaaattcgaatgagattgagagaactgctccttctcaagtgttgtctacccaagttctttccccagtgtccactcacttcttaacccaggtatctggctttggtccctacctctgacccaaagctgtgttttcattgcttctcaagacctctctactgcccaatcacacctcccagtcacaaactcagacactgctgacctgtctctccttgactcattgtcctatctgtgccatgaycttcacaatcccgtttttccttcttttttctcagccgcgtttgtgggtcctctccttccacctgaccccatttgttggtgggcttgtcagctttgccctagcctcttctccacacactcattccctgggtggactcgccacctctgcagttttgaatgccatgtctatgccaatgaatgcaaaacctctatctctggcttagaccactttgggttataaattctactgcatatgtgacatctccacatctactcataggcctttccaatgtagtgtgtccagtaagaaactcttgttttt

SEQ ID NO: 145224 - DNA, 601 bp, Human
tttgggttataaattctactgcatatgtgacatctccacatctactcataggcctttccaatgtagtgtgtccagtaagaaactcttgttttttttctcctaaacgtagtctgccccaacacccacccatcatttcctaaaaccagagaactggggatcattcctccctttcccctgcccacacattctctccctctgcaaattctgctagtcctatgccagaatcaaccccaaatcctgcatttctcttatccctgcttccaccatcatctgtcacctgggcaagtacctagcctcccamccagtctcctcatgtccacctgcacctccctcccatctgttctccaccatggtctttttaaaatttaagtcacatcatgtcactcctctacttacgtctcttcaatgttttcccactgtgcattgaatcctccagacacctccccacagctaacaagaccatccctttctggatcagcctgcctcctggcatccacccatggcccatgctactctctccctcattctcgcgttgcagcggtatgacctttgacagttcctacaacctgtcaagcactgcctttactgctcccccataatg

SEQ ID NO: 145225 - DNA, 601 bp, Human
ggacaaggcagtgtcaagttaaagctagattatattgacatatgcaaagagagggatgctgagagcttgtgcacgaatctgtgggtccaaatcatgccgaggttaacaactacatggaagctgcctaaccacaaactgtaagcactcactgcatactcgaaattactcaaggtactctgaaagatgacaaaaggagtgaacatcattcttgtttttgaaatcctcaatcagctaagattcttcaggacctgcttgtacttcccatcactcactactcccttggctgaagatcttaaaaacyaaagaatgattaggataagtgagacattcacttgtcttattctgcctaaaatatttttttaggaaggaaaaaaaacattttcccaagatgtacgtaactgtgctgctgactctgctcggaagcttcttaccttcctccaaatagctggtgcgcagtcagtgttagttgaattaaatatgggcaaatataaaacacatttttattacaccgccaatttgctgagtgacttggagaaaagctgttaatgtctgttctttgccatttttgaaaccaaatgtgtattctacggctggtaaagcg

SEQ ID NO: 145226 - DNA, 601 bp, Human
ctgttaatgtctgttctttgccatttttgaaaccaaatgtgtattctacggctggtaaagcggaatattaaatgtgcattgctgcacgggttattaagctggtgtctctcagccccatgctcacctttccatactctgctttgggtgctggggctgaaactctccaagccgtaatttctcctcttccaaccatctcctctcccaggtaggttctgcctgccggtagaaggtactagagggagcccaggaggcaggaggagggaggagtgacttgctcctcatcacacctacttctaagagktctgagtcccagggaacaggggcacctcctcgaagctcctgcggccccagcccaaggagcagcactgcttcctcaggggtctcaggcccagcctcaaggggctcccctccaaacctgcagatgccagaatccccacctccctcctgtgttgccccagccagaggggcactggctgtttttcctggagctgcgctctctctctgatgcctcggggcttccttctggcctttcagccctccactccaaattctccctgctgaaaccaggtgtgagttttgttccctgactacacctagaact

SEQ ID NO: 145227 - DNA, 601 bp, Human
attctacggctggtaaagcggaatattaaatgtgcattgctgcacgggttattaagctggtgtctctcagccccatgctcacctttccatactctgctttgggtgctggggctgaaactctccaagccgtaatttctcctcttccaaccatctcctctcccaggtaggttctgcctgccggtagaaggtactagagggagcccaggaggcaggaggagggaggagtgacttgctcctcatcacacctacttctaagaggtctgagtcccagggaacaggggcacctcctcgaagctcctgyggccccagcccaaggagcagcactgcttcctcaggggtctcaggcccagcctcaaggggctcccctccaaacctgcagatgccagaatccccacctccctcctgtgttgccccagccagaggggcactggctgtttttcctggagctgcgctctctctctgatgcctcggggcttccttctggcctttcagccctccactccaaattctccctgctgaaaccaggtgtgagttttgttccctgactacacctagaactgataggcttatgggcctcagaaaccacctctgtgtaagtaga

SEQ ID NO: 145228 - DNA, 601 bp, Human
ccccacacttctgttcctctgcctgagaacacaggtccaaatggaatagattttcatttgtttgtgcccaggtccaaatgaaatgcctttctattctacacaacaagagatgggcacctctacttttttaactgcataaatagaagatttggattgtaaaaaaaaaaaaaaaagaaagaaagaaagaaaaaagaaaatactgtatacgaaatgaggaaatgtgagaacttcacattctaaataaaataagtagaaaaaagcccacaactattttttcggtcaattttattcccttatttcyctttctagataagacgcagctgagttcccctaggcagcaaaaccattgcctgcatgatttggccttgagtcaatctgagatcagctcaaagccagccacaacctccaaacccatccctgtcggaggctgttgtggatgcatttgcaggtgttttattggtgttcatgctgtttaatcctcagagtaacactgtctcagccatgcttcaggcggccttctgcagcttttaccatgagactgtgcataacaaaaaagccaacaggttgtttttgcctctctgccaccctcctggaggtctgt

SEQ ID NO: 145229 - DNA, 601 bp, Human
acgtgtatcatggttggccccatttatggccttcctataatgggaaaagcactgtgctgggtgcctcacgtgcattaatctctaatgatcccagtgaaccttcagaataagtattagtgctgtcctcacacttataaggaaattaatggttataaacataaaataactcatcaagggccctgaatttatagctggcctagacagtgttcaggccagatatattggcctccctgccccaagcctaatcctggctgttttatcaaataatctcatgaacttcaccctggactatgcaaagtgytaacaacccaggcaacaatggagtggctgactaaatttaactaactgttttgttaccacctttagaaagagaccattacctatagggttgctcaaaattacagggttcttgccacccatacatactatctgcaattaattagatattacagatgcagaaatatgtttataggcctgagattttaaaaatatagtactcctggactccttttgagagttattaaaagtattctggctgggcgtggtgactcacacctataatcccagcactttgggaggccgaggcaggtagatcacctga

SEQ ID NO: 145230 - DNA, 601 bp, Human
ctggactatgcaaagtgctaacaacccaggcaacaatggagtggctgactaaatttaactaactgttttgttaccacctttagaaagagaccattacctatagggttgctcaaaattacagggttcttgccacccatacatactatctgcaattaattagatattacagatgcagaaatatgtttataggcctgagattttaaaaatatagtactcctggactccttttgagagttattaaaagtattctggctgggcgtggtgactcacacctataatcccagcactttgggaggccgasgcaggtagatcacctgaggtcaggagttcaagaccagcctgaccaatgtggccaaacccccactctactaaaaatataaaaactagacaggcatggtggtgcatgcctgtagtcccagctacttgggagcctgaggcaggagaatcgcttcaacctgggaggtggaggttgcagtgagctaaaatcatgccactgcactccagcctgggtgacagggcgaaactctgtctcaaaaaaaaaaaaggattctgagagcaaatatagctgcatggtcagataaaagcatgtccctaactcaac

SEQ ID NO: 145231 - DNA, 601 bp, Human
ctaaatttaactaactgttttgttaccacctttagaaagagaccattacctatagggttgctcaaaattacagggttcttgccacccatacatactatctgcaattaattagatattacagatgcagaaatatgtttataggcctgagattttaaaaatatagtactcctggactccttttgagagttattaaaagtattctggctgggcgtggtgactcacacctataatcccagcactttgggaggccgaggcaggtagatcacctgaggtcaggagttcaagaccagcctgaccaatrtggccaaacccccactctactaaaaatataaaaactagacaggcatggtggtgcatgcctgtagtcccagctacttgggagcctgaggcaggagaatcgcttcaacctgggaggtggaggttgcagtgagctaaaatcatgccactgcactccagcctgggtgacagggcgaaactctgtctcaaaaaaaaaaaaggattctgagagcaaatatagctgcatggtcagataaaagcatgtccctaactcaaccatccacatatagatttaagtgactcagttatgaacccaagaaccagt

SEQ ID NO: 145232 - DNA, 601 bp, Human
ccactccttgatacaatcgtgtccaatgcatactagttctttgtcgacaaacttattaaacatttgaaaaatctccttatgtaaagggaggttataagtttgtaacaaactgaaaatcaatgtgttttctgacacctgttgacattcatgatgagaattaggtgctttcctctcccagcttcattcagatatggacaggggagacggatccatcaaatacatcctctcgggagaaggtgctggcatcgtgtttaccatcgacgacaccactggagacatccacgccattcagaggctcgaycgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtaaggtggtgactcgctgattttcacaaatagcacctcctatatatatacacacacacacacatatgcacatgcacacacacatgtagatacacatatattcagaacaggagagcatgagaggagaa

SEQ ID NO: 145233 - DNA, 601 bp, Human
cctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtaaggtggtgactcgctgattttcacaaatagcacctcctatatatatacacacacacacacatatgcacatgcacacacacatgtagatacacatatattcagaacaggagagcatgagaggagaagctcaccaattataaagcaaccaaaaatgacgaccaagccctttggctggcaggaagctatatagacattggaatcaaccagagcaagtaataataataagcctattaatgttttttagttctgattctttaaaaacaaaatattagctagacagatttgtttcataagggagaaatattttgttattatcaaaagagcaatagggttaggcgcggtggctc

SEQ ID NO: 145234 - DNA, 601 bp, Human
gtggtgactcgctgattttcacaaatagcacctcctatatatatacacacacacacacatatgcacatgcacacacacatgtagatacacatatattcagaacaggagagcatgagaggagaagctcaccaattataaagcaaccaaaaatgacgaccaagccctttggctggcaggaagctatatagacattggaatcaaccagagcaagtaataataataagcctattaatgttttttagttctgattctttaaaaacaaaatattagctagacagatttgtttcataagggagaaatrttttgttattatcaaaagagcaatagggttaggcgcggtggctcacgcctgtaatcctagaactttgggaggctgaggcaggtggatcacaaggtcaggagatcctggccaacatggtgaaaccccgtctctactaaataccctgtctctactaaaacaccaaaaaaattagcctggtgtggtggtgcgcacctatagtcccagctactcaggaggctgaggcaggggaatcacttgaacccgggaggtggagatttcagtgagctgagatcacgccactgcactccagcctggcgacag

SEQ ID NO: 145235 - DNA, 601 bp, Human
gactcgctgattttcacaaatagcacctcctatatatatacacacacacacacatatgcacatgcacacacacatgtagatacacatatattcagaacaggagagcatgagaggagaagctcaccaattataaagcaaccaaaaatgacgaccaagccctttggctggcaggaagctatatagacattggaatcaaccagagcaagtaataataataagcctattaatgttttttagttctgattctttaaaaacaaaatattagctagacagatttgtttcataagggagaaatattttsttattatcaaaagagcaatagggttaggcgcggtggctcacgcctgtaatcctagaactttgggaggctgaggcaggtggatcacaaggtcaggagatcctggccaacatggtgaaaccccgtctctactaaataccctgtctctactaaaacaccaaaaaaattagcctggtgtggtggtgcgcacctatagtcccagctactcaggaggctgaggcaggggaatcacttgaacccgggaggtggagatttcagtgagctgagatcacgccactgcactccagcctggcgacagagtga

SEQ ID NO: 145236 - DNA, 601 bp, Human
ctggcaggaagctatatagacattggaatcaaccagagcaagtaataataataagcctattaatgttttttagttctgattctttaaaaacaaaatattagctagacagatttgtttcataagggagaaatattttgttattatcaaaagagcaatagggttaggcgcggtggctcacgcctgtaatcctagaactttgggaggctgaggcaggtggatcacaaggtcaggagatcctggccaacatggtgaaaccccgtctctactaaataccctgtctctactaaaacaccaaaaaaawtagcctggtgtggtggtgcgcacctatagtcccagctactcaggaggctgaggcaggggaatcacttgaacccgggaggtggagatttcagtgagctgagatcacgccactgcactccagcctggcgacagagtgagactccatcttaaaaaaaaaaaaaaaaaaaaaaaaaaaaagcaatgaagagcccaaaggctgtgtccttatcagtcattcagaatttaaagcacaaataactcttatccctactaaacaggtacaagataagagttatggaagcttgacctagaaaggggactc

SEQ ID NO: 145237 - DNA, 601 bp, Human
aaatgcagggaggaagagggtaatgtgtcctttatatcctaagaagagtcttagattattttgacagctcccggggggcatctgtagtgttaaggtcaaaaatacatgaacagagagttatagctgtgcccatggggggccttttaaaaaagaaaatgctgcatatatcactggagaatgttatactacaatgcaatatatacattataggggtaaactggggacggattattgttcccagtcccttccattttcatgcaaaaggtctatctagccaagagtcatgttgtaaagctgtagwaagtaagcctttaatctttgcctacagtgtagagaagtcaacttttttaagttgcagggttaaaagggagacaaaacattactgtacaggcttggcaggatcacaacacatttcaacggatttggtgtaggcctctcttcttaaatgaaaccgtatctgctgcttgctctctggggaaattcatatcttatgcatggtaaaaataaacagctcacagagcatctttcatgtcctagctcacaaaattaaaagcacagaggtaaacagaagaatgtcacaaaacagaatgaatatgtaaca

SEQ ID NO: 145238 - DNA, 601 bp, Human
ggggggcatctgtagtgttaaggtcaaaaatacatgaacagagagttatagctgtgcccatggggggccttttaaaaaagaaaatgctgcatatatcactggagaatgttatactacaatgcaatatatacattataggggtaaactggggacggattattgttcccagtcccttccattttcatgcaaaaggtctatctagccaagagtcatgttgtaaagctgtagtaagtaagcctttaatctttgcctacagtgtagagaagtcaacttttttaagttgcagggttaaaagggagayaaaacattactgtacaggcttggcaggatcacaacacatttcaacggatttggtgtaggcctctcttcttaaatgaaaccgtatctgctgcttgctctctggggaaattcatatcttatgcatggtaaaaataaacagctcacagagcatctttcatgtcctagctcacaaaattaaaagcacagaggtaaacagaagaatgtcacaaaacagaatgaatatgtaacaacaggaaaatccaattagaattccaaccctgcttacaggtagtagggaagcaagaaaaagcaggaatgagtt

SEQ ID NO: 145239 - DNA, 601 bp, Human
tgggttccatcttcattacttcatgaagggctcatattactcacactatagactataaattcttgaacacccttgaactacttggctttttacatttgacactagacaggtgtctctgatggaggcagaagggacagtagaaccagctaattacatagctcaggttattacatagctcaaaggtagatggattcggacatattgccgggagtcatgttaccccaaacatggcagcttcacaatagcagaacactatacaaggattactggggttttagtcttgcctccgaaaccaatatctttttttttttttttttttgagacagggtcttgctctgtcacccaggctggactgcagtggtgcaatcacagctcactgtagcctcaacccccaggctcaagcaatcctcccacctcagctcctgaatagccagaactacaggtgcacaccaccatgcccagctaatttttatattttttatagagatgggattttgtcatgttgcccaggctggtcttgaactcctgggctcaaatcatctgccttcctcaggctcccaaggtgctgatattacaggcatgagccaccacacccagcctc

SEQ ID NO: 145240 - DNA, 601 bp, Human
gcatcatttcttctcctgcgcaaggcagggtgctgtgagctggctgggtgctgtcaacctccctgattctttgtgaaacttgagccctcacacctgaggctatagcttacaaagcatattagaataaaagggaacacgtacatattgaaaatgtgattgtgtgatttttctttgttatttagtcagtcacattatgattgacaaaataacaaaaaacgtcaaaaagttgagccccagaaaaagtaagttggtaaaaatacgaattcatggagatgaaagtgaactaaatttaattgtgagytcaggatatcatgtccaaaaggagatgaccaactctgagcttcttacatatgtgagaacctttttagtattttattctggaataagaaaacaagaagcatgaagggtctgtccatggagaggcaggctggggcagtctggggtgtaaggacacactgaggggcagcacatggagctgatggagcttgctctccacggctgccccccctttatagatcactgatctccatgacctctgatcaggtgttgctagagacaggcactcagcacacaggccaggccatgaaaaaaaagatggaca

SEQ ID NO: 145241 - DNA, 601 bp, Human
gatgaaattggaaatcatcattctcagtaaactatcgcaagaacaaaaaaccaaacaccgcatattctcactcataggtagaattgaacaatgagatcacatggacacaggaaggggaatatcacactctggggactgttgtggggtcgggggaggggggagggatagcattgggagatatacctaatgctagatgatgagttagtgggtgcagcgcaccagcatggcacatgtatacatatgtaactaacctgcacaatgtgcacatgtaccctaaaacttaaagtataataataatttwaaaaaaaaagacatttgagaaggcaataaagctcaacatgtgcagtaccaacaatgtgtagaactcccctaaagtacaacatggacagctttgactaggtctggcttgcatgggcagtaacaactactgcttagaaagatccctttgcctccctttgacactagggcacttataaggtgttatcaattggagaagcaacgctatttctaaaatatcaaaatatgaaaaactgtgcatcttacattactgaaatacattaataaaatctgcatatactatcactcaaccagtaaatgttaa

SEQ ID NO: 145242 - DNA, 601 bp, Human
atgccttatacaaacattaactcaagatggattaaaaacttaaacataagacctaaaaccataaaaaccctagaagaaaacttaggcaataccattcaggacataggcatgggcaaaggctttgactaaaacaccaaaagcaatggcaacaaaagccaaaatcgacaaatgggattgaattaaactaaagagcttctgcacagcaaaagaaactatcatcaaattcaacaggcaacctacataatgggagaaaatttttgcaatctatccatctgacaaaggtctaatatccagaatctamaaggaacttaaacaaatttacaagaaaaaaaaaaaacaaacaaccacatcaaaaagcgggcaaaggatatgaacagacacttctcaaaagaagacatttatgcagccaacaaacatgaaaaatagctcatcatcactggtcattagagaaatgcaaatcagaactatattaagataccatcttatgccagttagaatggtgatcattaaaaaagtcaggaaacaacagatgcaggagaggatgtggagaaataggaatgcttttttacactgttggtgggagtgtaaattagttcaacca

SEQ ID NO: 145243 - DNA, 601 bp, Human
aaaaaaactcctcattcatgcaacatggatgaatctcaaatgcatcatgctaagtgaaagaaccctaactcaaaagattacatactgaatgtagtttatctgacattatatgacattcttgcaatagagacagaacatacatgaatcagtgtttgccaggggctgggtgggaggggagaggttgactacaaaggggcacagagagggtcacgggggttttgaaacagctctatagcttgattatcacggtagacacatgactgaatacactagtcaaaacctgccaactttatactaaaaragaaattttaatgtatgtaaatatataaatgtatgtaaatatcttattttttaaaacatacaaatttcacacaaaattagaaaaacaatttaaaattaaagggaaaacaagttttgcctagctcaaacctaacacaaacaacggtgtccacaactgtgttacaaatacataaagaattttaagagcgtataaatgtaatttaccaggaaagaaaaatgtttcgatttagggagcaagcattaaatgaattggtaaaatagtccttcaaatatatcattaatctgactggcagatttccct

SEQ ID NO: 145244 - DNA, 601 bp, Human
ggcgattggaacaaccatacagatcatttctgccaaggacccagatgtgaccaacaactcaatcaggtttttccacagatttcaccttttccttatatgctggaatcttcccttcccttgtatgtaattttctagcacttttccctttgtttctttcttctctatcccatttctggagactctcctctttgagttttttgtgttgtttttttttttttcccttaaataacatggccttgccaggttgtttagaagtgtcattatatttataactcactttcaattggttgagacacacatacacacacacacacacacacacacacacacacaccccttagttctcaatcatggtcctgttgacatttgggggtggataattctgtgttgttgtggaggggttctcctgtgcactgaaccatgtttagcagcatctctggcctttacgcacgaaatgcagtagcactctctgagttgtaaccacctaaaatgtccccagatattgccaaatgtccagggaagtggtgtaaaatcaccccaggttgagagctactgattcagataaagtataatcagacacacagatgtcaaaatgttaaaa

SEQ ID NO: 145245 - DNA, 601 bp, Human
gcaccagctactgctggctctgggcagctttgtacctgcatgatgccgattctgctcataggaggttagaatgtaatggttaagaaaagaaaaccacctacataattcacgagtgtgtcccaatttcctcgttttccatctgtatctacacctttaatttttctcctgcctcctgaaaattaacccagcatcctattcagggaaacaaaggctattattccctcaattctggccccattggggaaatcagagagggattcccctcgatgagggaggcttctctgaggaaggctcctggtgygtcagcccggcaatgctgtcaggggtcctgtgggttagttatttctatcactccctctcccatgcgacattcactatattgccgtaggtctgagtatagaaagctgctttctcataggctgcctctccccttggcatcatgcctgcagcctggagagctgccatcagggacatggctccgtggaccacatggctggctctctgcatgtgtcaggagctgaaagagaagactgtcatgagccaatcggtgtttttttattttatattagagaaaattcaattctgaaaatagtaaacttta

SEQ ID NO: 145246 - DNA, 601 bp, Human
gcatgtgtcaggagctgaaagagaagactgtcatgagccaatcggtgtttttttattttatattagagaaaattcaattctgaaaatagtaaactttaaaagtaaataacaatttatgcttaaaaagtaataatctagtccattttaaatgaactctgaagcatgtgtttttctttattaaaaaggcaactattcgctgtcactctgatgtgatctggctctgtgtccccacccaaatctcaccttgaattgtaataatctccatgtgtcaagggcgggaccaggtagagataactgaatsatgggggtggtttcccccatgctgttctcatgatagtgagtgagttctcacgagatctgatggttttaaaaggggcttcccccttcccttggcactcattctctctcctaccaccatgtgaaggacatgtttgcgtccctttccactacgattgtaagtgtgctgaggccttcccagccatgctgaactgtgagtcaaacaaacctctttccctataaataccctgtcttgggtatgtctttattagcagtgtgagaacggactaatactcgtatctttaaaagataaagtcttgtttcc

SEQ ID NO: 145247 - DNA, 601 bp, Human
gggcgggaccaggtagagataactgaatcatgggggtggtttcccccatgctgttctcatgatagtgagtgagttctcacgagatctgatggttttaaaaggggcttcccccttcccttggcactcattctctctcctaccaccatgtgaaggacatgtttgcgtccctttccactacgattgtaagtgtgctgaggccttcccagccatgctgaactgtgagtcaaacaaacctctttccctataaataccctgtcttgggtatgtctttattagcagtgtgagaacggactaatactcrtatctttaaaagataaagtcttgtttccttagacaatctcttatagactatgtgtcaataaggcagcatggcctggtggctgggagcagaacctgcagccagactgcctgggcttgattcccagcaatgtgaccttgggcaagggacctaacctgtctactcctcagacttcttacctgtaaaataaggatcataattgtgcctacctcatggtgttattgtaaagattaaatgagtccatataggtgatgtgtgctgagcagtgcctggcttacagtgaatgttcattaaatagggtca

SEQ ID NO: 145248 - DNA, 601 bp, Human
gaaagtcaaactcatagaagtagagagtacaatagtgattgccagaggctggtgggtaaaaaggaaaaagaatcaaaaagttcaaagcttcagtaaggggtagtaagttcctgtgatctattgcacagcatggtaactgtagttcataataatgtattgtatatttcaaaatagctaaaagaatagattttaaatggtatcattgcaaaaaacaaatacatatgtgaggtaatagacatgttaattagcctgatttgatcattctatgatgtatacatatatctaaataccacattgtacrccataaatatatataattattacttgtcaattaaaaaaataaaaatggctggacacggtggctcacacctgtaatcccggcactttgggaggctgaggcaggtggatcacttgaggtcaggagtttgagacccgactggccaacgtggcaaaaccttgtctctactaaaaatataaaaattagccagggatggtggcaggcacctgtaatcccagttacttgggaggctgcggcaggagaatcacttgaacccaggaggcagaggctacagtgagctgacatcatgccactgcactccag

SEQ ID NO: 145249 - DNA, 601 bp, Human
aagtcaaactcatagaagtagagagtacaatagtgattgccagaggctggtgggtaaaaaggaaaaagaatcaaaaagttcaaagcttcagtaaggggtagtaagttcctgtgatctattgcacagcatggtaactgtagttcataataatgtattgtatatttcaaaatagctaaaagaatagattttaaatggtatcattgcaaaaaacaaatacatatgtgaggtaatagacatgttaattagcctgatttgatcattctatgatgtatacatatatctaaataccacattgtacgcyataaatatatataattattacttgtcaattaaaaaaataaaaatggctggacacggtggctcacacctgtaatcccggcactttgggaggctgaggcaggtggatcacttgaggtcaggagtttgagacccgactggccaacgtggcaaaaccttgtctctactaaaaatataaaaattagccagggatggtggcaggcacctgtaatcccagttacttgggaggctgcggcaggagaatcacttgaacccaggaggcagaggctacagtgagctgacatcatgccactgcactccagcc

SEQ ID NO: 145250 - DNA, 601 bp, Human
cagtgaataactcgaaacctttgcaaatgtaattcaaagaactgatgattccacaggaagaaagccaagcagtgccacacagtatgcatccgattggcaatgggctcttttaaagcccagaatacagaactgacctgcctttaattccaagacttgaagtctgagccaaatgggagactgaaaacctctttttaagattcgttttttgacacttgctccctttgtctcacccttcccttcatactgctgatagcaaaggttcaccaacacacaccttattctgtccaaacttctcatgtcyggccacactcttagtaggcaacacatggatcctatgctcttgctaccatctccatgtacttcatcctctcctttcaaatccagactcaccaagtaaataactactttgttttttttttgtttgtttttttttttgtttttttttttgtttttttttttttttttgagacggagtcttactcttttgcccaggccggactgcagtggtgctatctctgctcactgcaagctccacctcccgggttcacgccattctcctgcctcagtctcccaagtagctgggactacaggcgcccgccac

SEQ ID NO: 145251 - DNA, 601 bp, Human
caagacttgaagtctgagccaaatgggagactgaaaacctctttttaagattcgttttttgacacttgctccctttgtctcacccttcccttcatactgctgatagcaaaggttcaccaacacacaccttattctgtccaaacttctcatgtccggccacactcttagtaggcaacacatggatcctatgctcttgctaccatctccatgtacttcatcctctcctttcaaatccagactcaccaagtaaataactactttgttttttttttgtttgtttttttttttgtttttttttttktttttttttttttttttgagacggagtcttactcttttgcccaggccggactgcagtggtgctatctctgctcactgcaagctccacctcccgggttcacgccattctcctgcctcagtctcccaagtagctgggactacaggcgcccgccaccacgcctggctaattttttgtatttttagcagagatggagtttcactccgtgttatccaggatgttatccaggatggtctcgatctcctgacatcgtgatcctcccgcctcggcctcccaaagtgctgggattacaggcgtgagcca

SEQ ID NO: 145252 - DNA, 601 bp, Human
aaacctctttttaagattcgttttttgacacttgctccctttgtctcacccttcccttcatactgctgatagcaaaggttcaccaacacacaccttattctgtccaaacttctcatgtccggccacactcttagtaggcaacacatggatcctatgctcttgctaccatctccatgtacttcatcctctcctttcaaatccagactcaccaagtaaataactactttgttttttttttgtttgtttttttttttgtttttttttttgtttttttttttttttttgagacggagtcttactyttttgcccaggccggactgcagtggtgctatctctgctcactgcaagctccacctcccgggttcacgccattctcctgcctcagtctcccaagtagctgggactacaggcgcccgccaccacgcctggctaattttttgtatttttagcagagatggagtttcactccgtgttatccaggatgttatccaggatggtctcgatctcctgacatcgtgatcctcccgcctcggcctcccaaagtgctgggattacaggcgtgagccactgcgcccagtcgtaaataccgacttctagcaaa

SEQ ID NO: 145253 - DNA, 601 bp, Human
agcaaaaaccattactctttttttttcttttggcattactaaactctcagatttggttttccttgtgttccctttagacaatccctcccaggttggaagtgttcctgtcacaatcaaagtcttagatgtgaatgacaatgctccagagttccccagattctatgaagcttttgtctgtgagaacgccaaggcaggacaggtaaggtggcctgtgggtggtgcactctgcttaacccctaacttctggaaacaattgttagataaccaaattcaccatcaaagccattttgactccagaaaygaacagttcacaaaacagagtccctaattcccgtatatcaggtttcaaccatttatttgttaagacaactatttgaggctaggtgtggtggctcatgcctgtaatcctagcatttttggaggctgaggcaggaagatagtttgagcccaggagtttgagaccagcctgggcaacatcgtgagacccaatctctaaaaaagtgaaaaaacaaaaaactatttggaacctacattaccttttatggcctaaacagcactttgagggtggccagatgcacacaatggccgtataaggtatgtg

SEQ ID NO: 145254 - DNA, 601 bp, Human
gtgcccatgtagcaatgcatgtcaggctgttgcctgccctataatctgtccatctcctccattctgctcctgcttttgtaagatgctttcctcccctgtgtatgacccagcaaccctacagatcccctaatagtcctcatctactgcccttccccaccctagtatatcctgtggtcctgtggatgctggtgctggatcaatgggctggaatggttttaacatgaaagctggggaagcgcatattgataaggcagggactcatgcattggtaattctggcccctgactgtaatctaactttkccttcatgtattagtccattttcatgctgctgataaagacatacccaagactgagtaatttataaagaaaaagaaggttaatggactcacagttccacgtggctggggaggcctcacaatcacggtggaaggcgaaaggcacatcttacatggcagcaggcaagacagactaagagccaagtgaaaagggaaaccccttataaaactatcagatcttgtgagacttattcactaccatgaaaacagtatgggggaaactgcccccgcaattcaattatctcccattaggtccctcccaca

SEQ ID NO: 145255 - DNA, 601 bp, Human
atggtctatagccctcctaaaagattcttttcaacaagtctaggataattctctttccacatctagtgaatttctagtctactaagacctgaaatgttatgcagccaataaaagttataatgcagaatttacagcccaagaaacgatccatgttattataagtaaagaagggaggtataaaaactacacctacatgcttgcagtcatgtaaaattatgactgcaagtgaacaatgatcgagagggaagatgcaaaaatagtataattactgtgctaaggtagttgagtttaagtgaggagktttgggtctttattttaataatttttgttttatattataaaatttatatatatgtaatataaacttgttataaaattatatgaatattttgttatgataaaataagctaattttaatctataatacaaagagggtgataagtagcagagtaaattaaacctccttccccccaaaataaagggcttcagagtaggagaggttgcattctaacaagtgaagaacatttcaactatctctcctgtttttgtaatcaaacaaacatagtccccatttctaaatgcatcttttaatagtttgtta

SEQ ID NO: 145256 - DNA, 601 bp, Human
gaagggaggtataaaaactacacctacatgcttgcagtcatgtaaaattatgactgcaagtgaacaatgatcgagagggaagatgcaaaaatagtataattactgtgctaaggtagttgagtttaagtgaggagttttgggtctttattttaataatttttgttttatattataaaatttatatatatgtaatataaacttgttataaaattatatgaatattttgttatgataaaataagctaattttaatctataatacaaagagggtgataagtagcagagtaaattaaacctccttccccccaaaataaagggcttcagagtaggagaggttgcattctaacaagtgaagaacatttcaactatctctcctgtttttgtaatcaaacaaacatagtccccatttctaaatgcatcttttaatagtttgttatacagtgatctgaagtacagatctttcacttcaagttcagtctgtcccatttgtcacctttaggccaagatactgaaaatattaacctttgatttgggctctgggaaatgttttgaagatttttcaaaagcatacagctcagagatacatctggtttataaagtat

SEQ ID NO: 145257 - DNA, 601 bp, Human
attctaacaagtgaagaacatttcaactatctctcctgtttttgtaatcaaacaaacatagtccccatttctaaatgcatcttttaatagtttgttatacagtgatctgaagtacagatctttcacttcaagttcagtctgtcccatttgtcacctttaggccaagatactgaaaatattaacctttgatttgggctctgggaaatgttttgaagatttttcaaaagcatacagctcagagatacatctggtttataaagtatcgggcctccttgtgtttacttgttggatactgtcctcmgcttcacatctgacaagtccagacacatgcttccctcttagtaagcagccttgaaggaagcccataaagaaatcagataacatacttggtgatggacaagggcggaatgaaaccagctgagcagaatattgcacgacaagtggggctgaggaagaaatctgacctgctgggagaacagagagcaggagagcgggccatgcgctcccaacccagacttagcgatttgtatcttcactcactcatgctttaaagccctgtaagcaaccagctctgtgcctcaggccccagtctcaccaatat

SEQ ID NO: 145258 - DNA, 601 bp, Human
cattaattagtcactggatgtcgccctggaaggatgtggtgaccatgggtgtctcagtcggtttgtattgctataaaggattacctgaggctgggtaatttataaagaaaagaggttcatttggctcatggttctacaggctgtacaagaagcatggtgccagcatctgcatctagggagggcctcaagctgcttccatgcatggaggaagggggaaggaagccgacatgtgcagatcacatggtgagaggaagcaaggcaggaggggaaggtgccaggctctttttaacaatcagctatyacaggaacaaagagagtaagaactcaactcatcaccaggacgactgcaccaaaacattcatgagggatccacctggatgaccccaacacctcccaccaggccccacctccaacaatggggatcagatttcaacatgagatttggtggggtcaaatatgcaaaccataggagtgggtaggtggctctctgcaattggcaatccctaaagggactggtaggtgacggggaaaaatccttcattgaagggggatctgagcaacacagtgtccaaaaggccccgatgggagctccccctaccac

SEQ ID NO: 145259 - DNA, 601 bp, Human
tgggtaatttataaagaaaagaggttcatttggctcatggttctacaggctgtacaagaagcatggtgccagcatctgcatctagggagggcctcaagctgcttccatgcatggaggaagggggaaggaagccgacatgtgcagatcacatggtgagaggaagcaaggcaggaggggaaggtgccaggctctttttaacaatcagctattacaggaacaaagagagtaagaactcaactcatcaccaggacgactgcaccaaaacattcatgagggatccacctggatgaccccaacaccycccaccaggccccacctccaacaatggggatcagatttcaacatgagatttggtggggtcaaatatgcaaaccataggagtgggtaggtggctctctgcaattggcaatccctaaagggactggtaggtgacggggaaaaatccttcattgaagggggatctgagcaacacagtgtccaaaaggccccgatgggagctccccctaccaccacccccagttatttaatcttcagcatattgtgagagttagctttagctcccctaatttacagatgaagaaatacaaactaagcaagccca

SEQ ID NO: 145260 - DNA, 601 bp, Human
atctagggagggcctcaagctgcttccatgcatggaggaagggggaaggaagccgacatgtgcagatcacatggtgagaggaagcaaggcaggaggggaaggtgccaggctctttttaacaatcagctattacaggaacaaagagagtaagaactcaactcatcaccaggacgactgcaccaaaacattcatgagggatccacctggatgaccccaacacctcccaccaggccccacctccaacaatggggatcagatttcaacatgagatttggtggggtcaaatatgcaaaccataggrgtgggtaggtggctctctgcaattggcaatccctaaagggactggtaggtgacggggaaaaatccttcattgaagggggatctgagcaacacagtgtccaaaaggccccgatgggagctccccctaccaccacccccagttatttaatcttcagcatattgtgagagttagctttagctcccctaatttacagatgaagaaatacaaactaagcaagcccagctgggacctcaaactgacctttgatgtcctggttcctatggtggtagaagcacagctggcttttaaacagcaggattg

SEQ ID NO: 145261 - DNA, 601 bp, Human
acatcatggtctcccagacttcatgcaacttactcctttgaaaaacattatggaaaaggcaaaacgtggccagtgagtccaagaggaagccacctgacctcctgctctccccactccagagttctgcttctgactcttgtctgttctgcatttctactctggggatcctgtgctatctttgctagctctccctcctgccaacaaaatgtgactctctgtgacccattccctcatgtctgttttctgttaacctgacatggccaatgccaatgggtcactcacttctcttcaggtcatggtyattcttaaataggggcttcttaaagacagcaatttagccctgaaatattgggccagtgatgaggttaagtagatgaggtgagaagaaaatatggggtcaagcaggactttgtggcacccgagccctttaactcaaagtctcttattttttagactgcctagaaacggctggccgtggtggaagaatatatgttattttgatgtctaacatctgaagtatttaggtaacatttatcctatgcctactaacatactcaagcccaaccctaaagcaaaattaaatcccaaggtgtgtgatggc

SEQ ID NO: 145262 - DNA, 601 bp, Human
attcagtcagtaagtcggcagatgtttactgagtgcctgtcccgtgccagaaacactgcaaagcacagaggcaaaatccttcattcccactggtagcagccctgttcatatgttctgtaacaacgggaaaaatctgagaaagatagaaagtgatctaggataaaaaataaaataaaataaaataaaaaacccctgggggcacatttctaggcagagatcaaagcaggaaacagtaaaaagctctccaaacaataaggagacaaaggataatagagataacaaagggcaaatacaggaccayaaacacagttttggcactgaaacagctttattactttagaatgatttagagaaatactttcaggtagggttccctatccataaactgctccccgctatagctttgatggaacagaattctaggcccctcttttccaacaagcattcagaccagctaaggggctcatagacccagcacactcttctttgggcacagatgggaaaaggaaggacttttgttctgtagccagatgatttgcttcaaaagaaaaaaaaaggtcagggcaatggaaaaaataagttaaactgtcaaatgaacctc

SEQ ID NO: 145263 - DNA, 601 bp, Human
tactccaacactttgggaggctgaggcaggagaactgcttgataccaagagttcaagaccagcctggacaacacagcaagaccctatctctgaaaaacatattttaaaaattagccaggcatggtggcacacacctgtagtcacagctagttgggagcctgggacaggagggtcacctgaggccaggagtttgagatcagcctgagcaacacaccaagaccccatccctaacaattttttttaagtagccagacatggtggcatgcacctgtagtcccagctacttgggaggctaaggtgrgaggatcatttgagcccaggagttcaaggctgcagtgagctatgatcagaccactgtactccagactgggtgacagagtaagatcctgtctctaaaaaaagccaccacaacaaaaactgactaatatagggcagatctactgtcaactacctctgttcctgtgcctgaaacatgatgtccttttatgaacacaacagggcactatctccagtaaagcctttttttacttttcagccccaaaacattatgaaaagaattatgtgtatatagtactttacagtttcaaagtattttcccata

SEQ ID NO: 145264 - DNA, 601 bp, Human
aagatcctgtctctaaaaaaagccaccacaacaaaaactgactaatatagggcagatctactgtcaactacctctgttcctgtgcctgaaacatgatgtccttttatgaacacaacagggcactatctccagtaaagcctttttttacttttcagccccaaaacattatgaaaagaattatgtgtatatagtactttacagtttcaaagtattttcccataccttatttgatatttacaataattctgtgaggctttaaggaagttattaatccctctgattcttattgtcccatctgatwgatgaggaaagtaagcaaatggcccaagaccagagtcaataagctgaataagcattaaaactgggattagaaattgagtcctgttttaccatgcccccccactacacccccgccccacacacacagtgttctgtgtcacctcagaaaaaaatgctgtttccaaataagttactaaagtcctcattatcacattcaacaaaaattttccaagtggctactatatgccaggccccttccagcactggactcagcaatgtgatgctctgatatttttctttaatcttaaataattcttagatc

SEQ ID NO: 145265 - DNA, 601 bp, Human
atctccagtaaagcctttttttacttttcagccccaaaacattatgaaaagaattatgtgtatatagtactttacagtttcaaagtattttcccataccttatttgatatttacaataattctgtgaggctttaaggaagttattaatccctctgattcttattgtcccatctgatagatgaggaaagtaagcaaatggcccaagaccagagtcaataagctgaataagcattaaaactgggattagaaattgagtcctgttttaccatgcccccccactacacccccgccccacacacacagtgttctgtgtcacctcagaaaaaaatgctgtttccaaataagttactaaagtcctcattatcacattcaacaaaaattttccaagtggctactatatgccaggccccttccagcactggactcagcaatgtgatgctctgatatttttctttaatcttaaataattcttagatcaagaaacatatatatcgtaggtataatacttttatgaatttcggctctagtcagactttctaaaagtctcatgacctcacctggattaaaccaaaaaaattaaaaaaaagttctgattagagaa

SEQ ID NO: 145266 - DNA, 601 bp, Human
aataagcattaaaactgggattagaaattgagtcctgttttaccatgcccccccactacacccccgccccacacacacagtgttctgtgtcacctcagaaaaaaatgctgtttccaaataagttactaaagtcctcattatcacattcaacaaaaattttccaagtggctactatatgccaggccccttccagcactggactcagcaatgtgatgctctgatatttttctttaatcttaaataattcttagatcaagaaacatatatatcgtaggtataatacttttatgaatttcggctytagtcagactttctaaaagtctcatgacctcacctggattaaaccaaaaaaattaaaaaaaagttctgattagagaaaaacctgctttctgaaaaaacaagcaattaaaactacaaagtggaattgatagtatttagctattaagtctggaacacagaaaggtgcacgggttgtttggtaggtggaaatatgaatataatcctcaggttggcatcctttctccattgggaagaaaataagaagtagcctgtatcaaagcaggaagaggttatgcttatctgaattttttttgacagttaa

SEQ ID NO: 145267 - DNA, 601 bp, Human
actacacccccgccccacacacacagtgttctgtgtcacctcagaaaaaaatgctgtttccaaataagttactaaagtcctcattatcacattcaacaaaaattttccaagtggctactatatgccaggccccttccagcactggactcagcaatgtgatgctctgatatttttctttaatcttaaataattcttagatcaagaaacatatatatcgtaggtataatacttttatgaatttcggctctagtcagactttctaaaagtctcatgacctcacctggattaaaccaaaaaaatwaaaaaaaagttctgattagagaaaaacctgctttctgaaaaaacaagcaattaaaactacaaagtggaattgatagtatttagctattaagtctggaacacagaaaggtgcacgggttgtttggtaggtggaaatatgaatataatcctcaggttggcatcctttctccattgggaagaaaataagaagtagcctgtatcaaagcaggaagaggttatgcttatctgaattttttttgacagttaatattactaaactaaataagcagttatgtagcacaatggaacatgtacatgtttt

SEQ ID NO: 145268 - DNA, 601 bp, Human
taggtccgtgcaatgtgcttctcaaaatacatttaaaaatacaacatgtggtttaattttgttgttttagttcagtcctacgtaaagagaggaagagtataaataagtaacctttctaagttcttggatccctgtgtcaagagaaaattgttacggtttctggtccctgactgcattgacaagtaaaacctccctgcaattccttgagtttccataaggtggcattgggagtcctttagcacagaagtggacgacctgtaagaggcctttgaagaaacttgttcctgggaggaatttccaractggctgtccttacttctatctttggaaaatgtcgaagttaaaagttcaccctggcccacaaaaagccatcattacagaaatactgatttaaagagactggcttggagaggctctcaagttaaaaatggtgtgcaagggacaatttatcttatcccttcccacccacgatgatgtcttgtcttttaaaccgtacagaaaaagtaaacagttttcaggagctaaattgagcagagctgtcataaaatcctcacagttttaagtacccttacttctaagagtacacatcccacattaaaaa

SEQ ID NO: 145269 - DNA, 601 bp, Human
accacttcaaggtcacctctgtgaagccctacccagtctcccaggtaaaattcactggccctgcctctgtactctcccagtgacacttgtggctctaacagcccttatcactgtctgacttgcattaattatcagcatccataatctccttagattacaagctcacaagagcagaatccatgtcacactcaatattgtttccccattgcttagcatagaggattaaaaatacttgggtttaataactttactgaatcctgcaaacacagcatgctcacttcgaatctcacgtctccaaccygcatcaatccaaatcacactccaacctttcaggctcgattcaagcccacgcttccttagagtcctattagtctctttttctctaggaatcccaccctcctttcagtccacgcctcgtatttttgcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatctttt

SEQ ID NO: 145270 - DNA, 601 bp, Human
ttaattatcagcatccataatctccttagattacaagctcacaagagcagaatccatgtcacactcaatattgtttccccattgcttagcatagaggattaaaaatacttgggtttaataactttactgaatcctgcaaacacagcatgctcacttcgaatctcacgtctccaacctgcatcaatccaaatcacactccaacctttcaggctcgattcaagcccacgcttccttagagtcctattagtctctttttctctaggaatcccaccctcctttcagtccacgcctcgtatttttrcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgcatgtatgaatgtactccactttctccccttggataaactggggtcttattttgcagtgctgtcaaactgtcactgttcaccagctataacaaagcacaccagaaaaaaaaaaaatcaat

SEQ ID NO: 145271 - DNA, 601 bp, Human
gctcacaagagcagaatccatgtcacactcaatattgtttccccattgcttagcatagaggattaaaaatacttgggtttaataactttactgaatcctgcaaacacagcatgctcacttcgaatctcacgtctccaacctgcatcaatccaaatcacactccaacctttcaggctcgattcaagcccacgcttccttagagtcctattagtctctttttctctaggaatcccaccctcctttcagtccacgcctcgtatttttgcacacagggaaaatacacatgagcgtatcatcgttycctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgcatgtatgaatgtactccactttctccccttggataaactggggtcttattttgcagtgctgtcaaactgtcactgttcaccagctataacaaagcacaccagaaaaaaaaaaaatcaatagcagttctacagctaaaacctcaacactcttcctg

SEQ ID NO: 145272 - DNA, 601 bp, Human
caatccaaatcacactccaacctttcaggctcgattcaagcccacgcttccttagagtcctattagtctctttttctctaggaatcccaccctcctttcagtccacgcctcgtatttttgcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgyatgtatgaatgtactccactttctccccttggataaactggggtcttattttgcagtgctgtcaaactgtcactgttcaccagctataacaaagcacaccagaaaaaaaaaaaatcaatagcagttctacagctaaaacctcaacactcttcctggaaaacgttttcagagagataaatagctcaatgggattatctctatctctcctttaaaccccagcgaacacattctaggggggaaaaatgcatttgttgggataaaattttatccaaacctgcaagggcacatctaacagtgtgg

SEQ ID NO: 145273 - DNA, 601 bp, Human
cacgcctcgtatttttgcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgcatgtatgaatgtactccactttctccccttggataaactggggtcttattttgcagtgctgtcaaactgtcactgttcaccagctataacaaagcacaccagaaaaaaaaaaaatcaatagcagttctacagctaaaacctcaacactcttcctggaaaacgttttcagagagataaatagctcaatgggattatctctatctctcctttaaaccccagcgaacacattctaggggggaaaaatgcatttgttgggataaaattttatccaaacctgcaagggcacatctaacagtgtggtgtttctttgataacatgatgaattatataaaaggccactgctcattctctgccttccataaatacccttgggtccagaaagccacaaccacctctttaatga

SEQ ID NO: 145274 - DNA, 601 bp, Human
gaggccccaggtgagtgtgtctgcctgcgcggggctggggaggcgccgctgggcagatgtgcgcccttgctgtgcgcctttggaagcaggactaatcagtgagcggagagcgggcggggatgtccgtgtggagtttcccttggcgtccccaagttactgcgtgttgcagtgagatgtggctctgcaaggcaggacaggcttgtggacggaggcgggggcgtttggcccggaaagccggtgttgacagacaccaggtgcgacacgaggagtagtagttgagggtaagagcaaatcccggcamtctccaggtgcagcggcaaacatgggcaggctggagcactctcctcaaagaggaccacaagcaggctcctccctcaacctcggactgatgggggcacaactccgcgccggctgtgccgccgggttctgcagaggtctgaggctggaagggggtatgcgccgctttgggcaggagtcctttgaaccattcgctctggacaccttttacctttcgtgaaggtggagctcacttcagggtgctttgcttttttcccctgtaattagtattctgctgatctggttcatctgcatcctgcgtccc

SEQ ID NO: 145275 - DNA, 601 bp, Human
ttctgctattttgcaaagtgtttattgaaacctgctgacttttattgaagtcacataaatcacacgtggcccaaggtaaatacaagggcaaattaaaaattatagttgatacagctaagatttcttgtaagaataaattataaaaaactctctgaatataattttaccattttattacataaataactcagaaagattgtgccttgttactttgtttactttttaatttacgaatgtttcttctagttaattataaactcttgtttccccttttaaaaaattcatttcacccatggcagargttgtgcttagttgaaattgagtctgtaatccactttgagaagttttctttctgtgtttgataaccagatgcacactacaggctgtgtgattcatttccagggcccctgcctgcatatttaggccagttaacagtaggaggttgtggtctgtggttgtaatgttatctggcccagggagctaatggatttgatcgcagtttctttacgtgagaagtcacatatcacagagagtccctagcctcactaattaaaatgtaaaaaattataccttttaagtacaaaagagagagctctttcat

SEQ ID NO: 145276 - DNA, 601 bp, Human
ttttattgaagtcacataaatcacacgtggcccaaggtaaatacaagggcaaattaaaaattatagttgatacagctaagatttcttgtaagaataaattataaaaaactctctgaatataattttaccattttattacataaataactcagaaagattgtgccttgttactttgtttactttttaatttacgaatgtttcttctagttaattataaactcttgtttccccttttaaaaaattcatttcacccatggcagaagttgtgcttagttgaaattgagtctgtaatccactttgwgaagttttctttctgtgtttgataaccagatgcacactacaggctgtgtgattcatttccagggcccctgcctgcatatttaggccagttaacagtaggaggttgtggtctgtggttgtaatgttatctggcccagggagctaatggatttgatcgcagtttctttacgtgagaagtcacatatcacagagagtccctagcctcactaattaaaatgtaaaaaattataccttttaagtacaaaagagagagctctttcatcagaattaaaattatcgaatgtgatgttaaactttaaat

SEQ ID NO: 145277 - DNA, 601 bp, Human
ctgttgtttaaatttcagtggaaatagttagctaccttgtgtcatagtgtagtaggaaattatttttggattccagagttgtttagaagggaaaaagcaattttaaatttggatagagctcactcttcatttttttgtaagatagaaacatacaaccctagacaataggttccttcaccctttcttcttagtctgcattttctgcccttctgaatgataatgatggttaccattacctacttagaaaattaaaacttatggtcgtataaaaatttaagtacagccaaatctactttgtttsacttttaggaaagatgataagttccaaagatcacacattgcaaaagcacttattaccagaatgagcaatttttaacaaatactttaaaatactcattacatacagttatgcaatggatattggatcagtacctagctgtgtgaccttgggcatttcactgggaatctgtagatttccattttgttcaaagtaaagcaagggctaccttggtttttctaacatctattgcagctcaaacatgtcatcaatctgtggttccaccactttgggaatcttcaaacttaaggagcagcagaattt

SEQ ID NO: 145278 - DNA, 601 bp, Human
aataagctgtgtgttagtgtgttatatattaagtctatttcaaaacagtttcagaagacctgcatctgaggcagactccagacagcagagagcatgagcagctgctccttgcctagaatttagagaaagtttggtggaatgtggtctttaattgtgataagccattgcttatttatattggactgcaacaaacacattccagttcaacattaagtgccacaaaaccaaaaatagtcctatatttccttttagtatagctgatagttatatatcatagcacatattatttctagaaagcatrcagcactgtgtactttttaaaaaagcagtctagaacatatgaattaattggcagttagccatgttttaaaaactactcttgtggtgatatgttagtgtgcagtggctgaatatgatgtatacttgttatgtttttagcatgttgactttgaatggaacaggttttggaagactcgcaattttgctgattagtaattgatatgctaatgcataacagttttttttttttttgcatgaaaggacctttagtcattgtttgtaagtttgaaaacaccatttgattaagagcacgatagtcact

SEQ ID NO: 145279 - DNA, 601 bp, Human
cacaaaaccaaaaatagtcctatatttccttttagtatagctgatagttatatatcatagcacatattatttctagaaagcatacagcactgtgtactttttaaaaaagcagtctagaacatatgaattaattggcagttagccatgttttaaaaactactcttgtggtgatatgttagtgtgcagtggctgaatatgatgtatacttgttatgtttttagcatgttgactttgaatggaacaggttttggaagactcgcaattttgctgattagtaattgatatgctaatgcataacagttttttttttttttgcatgaaaggacctttagtcattgtttgtaagtttgaaaacaccatttgattaagagcacgatagtcacttgatctgttaaaagtggtttcctagagatgtcaagtggaggagaaattccaagaaaacgttatagtaatgaatttgttttggtaaaataacattagctgttaaagttaagtggataataaacagtctacttgaaactaatacactgccacttagtttaacaaaaataattggaacaaaatggtagcatgatcaagtgatttcatatcaaatgacgtt

SEQ ID NO: 145280 - DNA, 601 bp, Human
tgattaagatctgttatgcttatcacagtactacttgtgattttcatgtatttcagtttgtaaaacatggaaaaatattataaattgtttttcaaaatacaagttttagccttaaaatatcaaacaaaaacattttaaatcttcctcaattttttttccgtttcagattaatcatttatccagtaaccatcactactactccctgagacatctgtgatttacctctgtgcccttctctcctcagatataacctgttcttgtttttctcttcagaaatgttccagtgtccaaaagtttgtamagatctgtagacattccttcaactgtatatccatatatatatatattttttttttctgcactttttaaagaactagtaatagtgaagaggtcagctctccaaaccacatgcatggatgcagagtactcatttttttctgacatgaatcttgtttttaactcctgtatatgaaactcagataggaaaggaggtggaagatagaagataaacaacatagacttctaaagagggatgcagtgtttttgctttaggcacagatttgtgaggcaatatttaatccattgtgaaaagtcaacaatt

SEQ ID NO: 145281 - DNA, 601 bp, Human
cttgtgattttcatgtatttcagtttgtaaaacatggaaaaatattataaattgtttttcaaaatacaagttttagccttaaaatatcaaacaaaaacattttaaatcttcctcaattttttttccgtttcagattaatcatttatccagtaaccatcactactactccctgagacatctgtgatttacctctgtgcccttctctcctcagatataacctgttcttgtttttctcttcagaaatgttccagtgtccaaaagtttgtaaagatctgtagacattccttcaactgtatatccttatatatatatattttttttttctgcactttttaaagaactagtaatagtgaagaggtcagctctccaaaccacatgcatggatgcagagtactcatttttttctgacatgaatcttgtttttaactcctgtatatgaaactcagataggaaaggaggtggaagatagaagataaacaacatagacttctaaagagggatgcagtgtttttgctttaggcacagatttgtgaggcaatatttaatccattgtgaaaagtcaacaatttgttactgactctgtactcaagttcatttaaat

SEQ ID NO: 145282 - DNA, 601 bp, Human
gcaaatacttcaaatactgcagagaaatataatggaattttcttgaaagtgattgtgacttataaacatggttgacttaccaaggaatttgtatcttgacttgttatacggttaacttttcatatcaaaaaatgaggttgatcataatgaaaatgagcattatgtaaatggtttccgaatgtcaattatgtgcctacttcagtcgtagatactacagatacgatagggtagatctccttcttcatcaaggtttatgtttatactagctgcttttaaaaacccttgattaaaatgagttgcwcaattatcaagtatcttcccttcacagacattatttcaatgactttaatgtaacccatgccatgttctgtaactcccttctttgatatgttctagctaatttgataaatctccagtcttgttgaatggaagagaaataatcttcaagagcaagaagagtacattaaacagctcttcttaaagtgaatgttgcattttataagcaagtcaaatgtttattttacattcctataacttccttaaatttctctgcccattatcttttttttttttttcttttttcttttggagacagaatctc

SEQ ID NO: 145283 - DNA, 601 bp, Human
agggtttcaccatgttagccaggatggtctcgatctcctgaccttgtgattttcctgacttggcctcccgaagtgctgggattacaggcatgagccaccacacccggcccccattatcttttattattaacaatgtgtattttatcacagctttaaaagagctaacaaaatcaattttatataattgtcaaaaagtagaaaagtaagacctgaaaaaagaaatagactttataagataattgagttcagctccttcattttgcaactgtggaaaataaaatcccggagcaatccaaggtcrtacaaagtggtggagcttgtaggacaatgagtcctgtgctcttatccctagtccagactgtgtgcttcgttcctcatcagtaaacacctagtgaactaaaataaatttctccagctctgatatttgtgtttgatttctaaaaaattacagaaggcatgcctttaagaaataaagaattatacatatatatatagtactttggcgcctttgtattcatcttgattttttgatttatgaccatatggttctctggaaccaactacaactatcaaaatgctttcacttggtgtaagagttgtc

SEQ ID NO: 145284 - DNA, 601 bp, Human
ctctgaaacaatgttaccacatcccctcaatccataaagtagcctaaatggtataattttgctctattgcatctaaaaactatattatcaggagccaaagtgtttatgtcattgtctttaagagagaattcattctcttgagaagggagagtggtgaaactggaactgttctatggccacagacctcacatgcttgtctcagccacctgaccagatctctaaaccatccctccccatccccaggagactggtttaccactatatgaaggaagaagctacatgactttgccccttcccataytgtcagccattcctactgaagaccactcttcacgattctcatctcatcactggactaatccctacactagtgcaccatgtccagatcaagtttaagcacgtccctgcctttttaaactgtaggaagcacgcctttcaggtgggttagtcagacctacctacaataaacttccaacttaattaaggggcctacattggaacatcaaggcatgatcccaagttacttgttctttataagtcaaaagctagaacaactggccctctagggtggtttctaaatggaataaatttatttttgatc

SEQ ID NO: 145285 - DNA, 601 bp, Human
tgaaactggaactgttctatggccacagacctcacatgcttgtctcagccacctgaccagatctctaaaccatccctccccatccccaggagactggtttaccactatatgaaggaagaagctacatgactttgccccttcccatactgtcagccattcctactgaagaccactcttcacgattctcatctcatcactggactaatccctacactagtgcaccatgtccagatcaagtttaagcacgtccctgcctttttaaactgtaggaagcacgcctttcaggtgggttagtcagacstacctacaataaacttccaacttaattaaggggcctacattggaacatcaaggcatgatcccaagttacttgttctttataagtcaaaagctagaacaactggccctctagggtggtttctaaatggaataaatttatttttgatccttggatagggtatctggatttgggtagattgtgttctctgcacagggtgcagttaagagttaccattctggtggctctcaggtacagtaattagatgaacattggcttttccttaaatgccctctggaatatcaaaactttatagatatatat

SEQ ID NO: 145286 - DNA, 601 bp, Human
gctacatgactttgccccttcccatactgtcagccattcctactgaagaccactcttcacgattctcatctcatcactggactaatccctacactagtgcaccatgtccagatcaagtttaagcacgtccctgcctttttaaactgtaggaagcacgcctttcaggtgggttagtcagacctacctacaataaacttccaacttaattaaggggcctacattggaacatcaaggcatgatcccaagttacttgttctttataagtcaaaagctagaacaactggccctctagggtggtttmtaaatggaataaatttatttttgatccttggatagggtatctggatttgggtagattgtgttctctgcacagggtgcagttaagagttaccattctggtggctctcaggtacagtaattagatgaacattggcttttccttaaatgccctctggaatatcaaaactttatagatatatatttttaaatgtatgcattcattttaacagttcattgcccaaagtcattggaacctgttttttctagtcatgtgaacgatttaaaaatttgataaatttgtatgtatgtatatatttgtttc

SEQ ID NO: 145287 - DNA, 601 bp, Human
gtcagacctacctacaataaacttccaacttaattaaggggcctacattggaacatcaaggcatgatcccaagttacttgttctttataagtcaaaagctagaacaactggccctctagggtggtttctaaatggaataaatttatttttgatccttggatagggtatctggatttgggtagattgtgttctctgcacagggtgcagttaagagttaccattctggtggctctcaggtacagtaattagatgaacattggcttttccttaaatgccctctggaatatcaaaactttatagrtatatatttttaaatgtatgcattcattttaacagttcattgcccaaagtcattggaacctgttttttctagtcatgtgaacgatttaaaaatttgataaatttgtatgtatgtatatatttgtttcacatttcttttactacataatagtattttcttaagaaatttgactatcaaaaatatttttttattgtataacagacactcttcttacagaagggacaggtagaaagactgaaaagcttatgaggatagtgcattttctgccttaataggagacatcttttggctttatgttct

SEQ ID NO: 145288 - DNA, 601 bp, Human
ctatatttttctcctcttcctcaaaaaaaaaaaaaaaaacagaaataggcaaatgatacttctttgccttaattgttctattgttgatttatttataggaagtaaaatgaattcataaaccaaagtgcaacatggtgatttaagtgaggactttgtcataaattctcatttctttgtgttttaggggtatgttcgaaagtttgttttgtaactgattttatatctcttgcataatcagaattctgtaactgaaataaatagacattagaataaaagggcttttccatgcttctgctaaagmacctcctggatgcatgccagcaatgaatgggcctcacaaatacagctgttttctcactcttctgttgatcaacataattcaattctataaatgtttatgtagggaggccctactatgcacaactcatgctgcaagatgctcaataaataattgtaaaatagcaaataaccgcaatgcaatagcataacctaacatgctacacagcatacatgacaataagttcaaagagtggaaaatggaaactactgagcttttcagctgaccacaatcaaatcagaacacatcaaaacagctggtgtt

SEQ ID NO: 145289 - DNA, 601 bp, Human
catttattgggtgaccaagtgttagctggatggacattttgtttttcacagtttcttctgtcttaatatttgagaaggagattttcactggagagcttcctgaaccaaaaggtgcttctagaaagcatagccttctctctgccatttggcatatcatgttctcggttcctagtctacttccggttcaatttttttaatatttgtaaaggcctactgaatttctcaatttggtactgagtcctggtgaaggttttctaaatagggtatattagcacaaaatctgtgcctctgtatttttacrcttcactctgtcagttttatatttgtcttcctggtaaaatgaagcatagctacctactgaatttatctataaatcagtttttcaactttaaaagatagaggaataatcctggtgatttactgcatgggtcgttttttcgtttgatcacaccttaagtaagggccaaaattatgtttattgatgagcatctacatcaatcaaggtaatttgtattatatttattattttatttatgtctctatattttataaatactgacttttactaccttgtaaacaaaaggacattaataagttaaag

SEQ ID NO: 145290 - DNA, 601 bp, Human
gatttaattttttaaaaaattgactaaaatacagaaaaagggctgtaacataatttgagatggaaggagaatttgtacacaagagagacaaatgcaaggccttacaggaacaattttcatatatccttggaaaaaaatggcagagaacttgattactatagattttatatttgagatgatgaaatgattctttttattaataatttggtggtctgaataagcagagatataacaataactttgacttaagtacgttttttattacttgggtaaatagacacattttcctttccttttttcttttttttttttagttttgggaggtgatgtctgtgcccagaaatgtttgtaggacagaaagaaataaaaattatagaagaagatgtgaagaaatggctgggcagataatcatagaaagaaaaaaagaacctaattaatcagtgcttttcacagatgtgtattcaacctaggccacttagatggtcacattcttagtcatcctaacacaatctagctatttgggtaatttggaaaatataagtgatgactttgatacattttgtaccttaacttgatcacataatggataactaccgtatgt

SEQ ID NO: 145291 - DNA, 601 bp, Human
tttcacagatgtgtattcaacctaggccacttagatggtcacattcttagtcatcctaacacaatctagctatttgggtaatttggaaaatataagtgatgactttgatacattttgtaccttaacttgatcacataatggataactaccgtatgtgtcaaattgacatcatttttattttcttgctctaccactttctactagttgtataacttgggggcaaattgcctaatatcattaagttttagttttctaatctataaaatagaaaaatggtatctacaattcaattctgttactsaataaatccgattagtctttatgacctacattcaattactctggacattattatattttatatttcattacatattaattataaattaacttagttatggatcatctattttgttacatgtgaaatgttatctgtgtgattcctcagatgaaagccggtattattttatgttctaatagtgtttatatttattccagttaattataggaatgtctattttgggggagcttaataatgcagcttttagaaattatttatatacaattaaactatggcagagatataattagtgggtaaaaa

SEQ ID NO: 145292 - DNA, 601 bp, Human
tgtgtattcaacctaggccacttagatggtcacattcttagtcatcctaacacaatctagctatttgggtaatttggaaaatataagtgatgactttgatacattttgtaccttaacttgatcacataatggataactaccgtatgtgtcaaattgacatcatttttattttcttgctctaccactttctactagttgtataacttgggggcaaattgcctaatatcattaagttttagttttctaatctataaaatagaaaaatggtatctacaattcaattctgttactcaataaatcygattagtctttatgacctacattcaattactctggacattattatattttatatttcattacatattaattataaattaacttagttatggatcatctattttgttacatgtgaaatgttatctgtgtgattcctcagatgaaagccggtattattttatgttctaatagtgtttatatttattccagttaattataggaatgtctattttgggggagcttaataatgcagcttttagaaattatttatatacaattaaactatggcagagatataattagtgggtaaaaaattcacaga

SEQ ID NO: 145293 - DNA, 601 bp, Human
taacttgatcacataatggataactaccgtatgtgtcaaattgacatcatttttattttcttgctctaccactttctactagttgtataacttgggggcaaattgcctaatatcattaagttttagttttctaatctataaaatagaaaaatggtatctacaattcaattctgttactcaataaatccgattagtctttatgacctacattcaattactctggacattattatattttatatttcattacatattaattataaattaacttagttatggatcatctattttgttacatgtsaaatgttatctgtgtgattcctcagatgaaagccggtattattttatgttctaatagtgtttatatttattccagttaattataggaatgtctattttgggggagcttaataatgcagcttttagaaattatttatatacaattaaactatggcagagatataattagtgggtaaaaaattcacagaaattatatctgtgagtcttttaagactttcaaatttcgagtccatgttaatggcaggtgaccagcaagatcaattaaatgactcttcagtcaataaaatttgatcattaagac

SEQ ID NO: 145294 - DNA, 601 bp, Human
tcttttctccttttcactttatatcacccctcccgtggctattcacagtacataggaggtcccagtttccacccatttcattggatcgcactgcatttcttcagcccagtctgttaatcaccttggcattactcacttaacgtcctgtaactgtctgacgtaaaaaaaaaaaaaaaattgtctacaaaaccactcagcctctgttccaggtattaagtatttttcatctttcctaaccgtaatgggatgccagccgatcgctgtgccccaggccattactttcactgaaatgtgtgcttcstgcctcttccacagttgcttccctagctgttaacatcactctttcttttttttttttttttttggctactcctctttcttccttactcattcagggaaagtttatacctattaccccagtagaaatcaaatacacagaaatgcagtttgcaggattggctttgctttaaatttaagcttacttggaagcattggtgagcattttcaatgcatttaattatacctcagcagtatctctcaccaagaaattatctacctcctgatatctaaagatacattcagtgttccaaaaaaggaagtt

SEQ ID NO: 145295 - DNA, 601 bp, Human
acataggaggtcccagtttccacccatttcattggatcgcactgcatttcttcagcccagtctgttaatcaccttggcattactcacttaacgtcctgtaactgtctgacgtaaaaaaaaaaaaaaaattgtctacaaaaccactcagcctctgttccaggtattaagtatttttcatctttcctaaccgtaatgggatgccagccgatcgctgtgccccaggccattactttcactgaaatgtgtgcttcgtgcctcttccacagttgcttccctagctgttaacatcactctttctttyttttttttttttttggctactcctctttcttccttactcattcagggaaagtttatacctattaccccagtagaaatcaaatacacagaaatgcagtttgcaggattggctttgctttaaatttaagcttacttggaagcattggtgagcattttcaatgcatttaattatacctcagcagtatctctcaccaagaaattatctacctcctgatatctaaagatacattcagtgttccaaaaaaggaagtttcatattgaaaataggttgtgtttatttttaaaaacttgagttacaaat

SEQ ID NO: 145296 - DNA, 601 bp, Human
ttatagattttattgagaaaagacaaacaggaaaagtgtcctctgaaaatgtagattgcctaatgccaggtcaactcttagaagaaaacaaagacagtttattttttctaggaatgagtagaaaccccattttcataataactttacaactagagtcaatttgtaaaggcatttgttctctgtcagtttgctgatagatgtgtggaattcctggtgatttcaaaaggaatttggacacggatcagctctatcagatgcaaataagttcagatttttagaaatacttcttggcagttatatkcagctcttataatactgcaataagcaaatacattgttattttgtttttttcttaccattttgtaaataacatgttagattgtgccactaaaatgcagaaacccaccatttattcggcttaatatggctaattaacttaaaaagtcacctcagttcagaaatgaaggttataattaccaaaggctttagctatacagctaaaagttggacagagtggaagactctcagttatatgcctgattatagccaaactaggtactctagattgggctccacatttcctgattgtctgtgtatgttg

SEQ ID NO: 145297 - DNA, 601 bp, Human
aaaagacaaacaggaaaagtgtcctctgaaaatgtagattgcctaatgccaggtcaactcttagaagaaaacaaagacagtttattttttctaggaatgagtagaaaccccattttcataataactttacaactagagtcaatttgtaaaggcatttgttctctgtcagtttgctgatagatgtgtggaattcctggtgatttcaaaaggaatttggacacggatcagctctatcagatgcaaataagttcagatttttagaaatacttcttggcagttatattcagctcttataatactscaataagcaaatacattgttattttgtttttttcttaccattttgtaaataacatgttagattgtgccactaaaatgcagaaacccaccatttattcggcttaatatggctaattaacttaaaaagtcacctcagttcagaaatgaaggttataattaccaaaggctttagctatacagctaaaagttggacagagtggaagactctcagttatatgcctgattatagccaaactaggtactctagattgggctccacatttcctgattgtctgtgtatgttgatcaaaatcatttaaaa

SEQ ID NO: 145298 - DNA, 601 bp, Human
gatcatctcttgaggaaaacaatctaagaaaaaataggatttgagactcaatatatatgattagaaataactagtgaataccttgaaggaagctataataaaattaaacatttttatgccaaaatgtctctcttcaaaaattatttttcttaaaaaatgttaaatgagaaacccaatatctcttctttcatagcaaattccattatttgcttttgcttacccttcccttcagatcttccacattcttatttggttttacaaattaaaacgacctttttcaaatgctctctcctccaagcasaatgatagcctattgcagtggtaatacattgcacagctgtgggggcctgacacttcattttccatatggtactgaatctgttgtacctgagtcagcacgatttcctcggggccgtcattgggagtgtctacagctactctcatatctcagataatgttgagagccctgggttccaggatagtctagtccagtggaaagatgtggggcctgggagaaagagaggtctggatttgaatgatggttatacccccctgatgatgcaggatcatgaatatcaccatctctctaattcccttgatg

SEQ ID NO: 145299 - DNA, 601 bp, Human
tatgccaaaatgtctctcttcaaaaattatttttcttaaaaaatgttaaatgagaaacccaatatctcttctttcatagcaaattccattatttgcttttgcttacccttcccttcagatcttccacattcttatttggttttacaaattaaaacgacctttttcaaatgctctctcctccaagcacaatgatagcctattgcagtggtaatacattgcacagctgtgggggcctgacacttcattttccatatggtactgaatctgttgtacctgagtcagcacgatttcctcggggccrtcattgggagtgtctacagctactctcatatctcagataatgttgagagccctgggttccaggatagtctagtccagtggaaagatgtggggcctgggagaaagagaggtctggatttgaatgatggttatacccccctgatgatgcaggatcatgaatatcaccatctctctaattcccttgatggtcctggctttattttaaaatcttccataaagcaagctgaaggaaataaataatagcaaaagaggcggggaagggagaaaagagctaggttgtttgtgggtatctggaatgttc

SEQ ID NO: 145300 - DNA, 601 bp, Human
gtctcatgtaatacaattgttatcaagactaaataagttaatatatgtaaagaacttcttgttttatatacagcaaacattcattaagtattagttgttaataatagtggtacatatttttattttgcattcaattgctactttctataactggcctaattcaggtgttttattttcaagcatatttttaaaacaacctaaaggataaggcagggatgtccaatcttttgtcttccttggaccacgttgaaagaagaagaattgtcttggaccaaacataaaatacagtaacactaatgayagctgatgaactaaagaaaaaaaatacacagtgttttaagaaagtttattcatttgtgctgggctgcattcagagccatcctgggctgcatgtagcctgtgggccttgagttggacaagtatggtctaaggaaaaaacaaggaagaactcaagcaagagttatcacattggccacttggtgacaacagccaagtcctttaaattacctttccttgttctctcgtctatcaaaaagggactgttatgccaggtatccctcctcctcaaagttggagtcagctttgaatcagataactcctg

SEQ ID NO: 145301 - DNA, 601 bp, Human
ctataactggcctaattcaggtgttttattttcaagcatatttttaaaacaacctaaaggataaggcagggatgtccaatcttttgtcttccttggaccacgttgaaagaagaagaattgtcttggaccaaacataaaatacagtaacactaatgacagctgatgaactaaagaaaaaaaatacacagtgttttaagaaagtttattcatttgtgctgggctgcattcagagccatcctgggctgcatgtagcctgtgggccttgagttggacaagtatggtctaaggaaaaaacaaggawgaactcaagcaagagttatcacattggccacttggtgacaacagccaagtcctttaaattacctttccttgttctctcgtctatcaaaaagggactgttatgccaggtatccctcctcctcaaagttggagtcagctttgaatcagataactcctgctaaaatgctttgaaatatagaaagtattaaatgttaaataagagttatttctgatggaaagagcagatgttagttatatttataaattattagagtaagaacagaactggcaacacatacatcccttttggtaactgtttttg

SEQ ID NO: 145302 - DNA, 601 bp, Human
aaatcacacatttgaagaaagtacagaacacacacacacacacacacacacacacacacacacacacagagagagagagagggaagagagagaaagagagagggagagaggattgttctattctcaaatacttttcaaatcctgaaagctaatgaaatccttgagagtttcccaggaggcaagagattctagtgtcattaggattctactgaagaaaagtgatgcttaatggaactagataaatgagattgcttgttaatctctcagttaattttctctcactctctctccttctttctckctctttttcttgaccatgccttaggtcagaacttcattgaatcatcgaattcattgaagtttggctccaacctatcatatcgccgaggtttaccaatcctatacttcataaagttctaaattcagaatgtgaggttgacaaattcatttcagttccacaagtggtagcatttaaatatcagcagcttaagtattcaaaattaatagattgcatttttagaatggtgaaattctgacagtttgcagggaaaaggtgctgaatatcttgatataatttacatacttctataaacaggcattt

SEQ ID NO: 145303 - DNA, 601 bp, Human
agagagggaagagagagaaagagagagggagagaggattgttctattctcaaatacttttcaaatcctgaaagctaatgaaatccttgagagtttcccaggaggcaagagattctagtgtcattaggattctactgaagaaaagtgatgcttaatggaactagataaatgagattgcttgttaatctctcagttaattttctctcactctctctccttctttctctctctttttcttgaccatgccttaggtcagaacttcattgaatcatcgaattcattgaagtttggctccaacctawcatatcgccgaggtttaccaatcctatacttcataaagttctaaattcagaatgtgaggttgacaaattcatttcagttccacaagtggtagcatttaaatatcagcagcttaagtattcaaaattaatagattgcatttttagaatggtgaaattctgacagtttgcagggaaaaggtgctgaatatcttgatataatttacatacttctataaacaggcatttttatacctttggaaagataaatgagtagaaaccaagtattttacaattctaatagttttactgacatgtagaggg

SEQ ID NO: 145304 - DNA, 601 bp, Human
acttttcaaatcctgaaagctaatgaaatccttgagagtttcccaggaggcaagagattctagtgtcattaggattctactgaagaaaagtgatgcttaatggaactagataaatgagattgcttgttaatctctcagttaattttctctcactctctctccttctttctctctctttttcttgaccatgccttaggtcagaacttcattgaatcatcgaattcattgaagtttggctccaacctatcatatcgccgaggtttaccaatcctatacttcataaagttctaaattcagaatstgaggttgacaaattcatttcagttccacaagtggtagcatttaaatatcagcagcttaagtattcaaaattaatagattgcatttttagaatggtgaaattctgacagtttgcagggaaaaggtgctgaatatcttgatataatttacatacttctataaacaggcatttttatacctttggaaagataaatgagtagaaaccaagtattttacaattctaatagttttactgacatgtagagggaggggcatagactgtccaaaaggggaactattgccaggcttttaggagctgccg

SEQ ID NO: 145305 - DNA, 601 bp, Human
tctactgaagaaaagtgatgcttaatggaactagataaatgagattgcttgttaatctctcagttaattttctctcactctctctccttctttctctctctttttcttgaccatgccttaggtcagaacttcattgaatcatcgaattcattgaagtttggctccaacctatcatatcgccgaggtttaccaatcctatacttcataaagttctaaattcagaatgtgaggttgacaaattcatttcagttccacaagtggtagcatttaaatatcagcagcttaagtattcaaaattaayagattgcatttttagaatggtgaaattctgacagtttgcagggaaaaggtgctgaatatcttgatataatttacatacttctataaacaggcatttttatacctttggaaagataaatgagtagaaaccaagtattttacaattctaatagttttactgacatgtagagggaggggcatagactgtccaaaaggggaactattgccaggcttttaggagctgccgttgctaacaaatcagtttgggtaggcaggtgttctagaaaaaccagaagaaaaatgaagatcagagatgattttt

SEQ ID NO: 145306 - DNA, 601 bp, Human
gtgaggttgacaaattcatttcagttccacaagtggtagcatttaaatatcagcagcttaagtattcaaaattaatagattgcatttttagaatggtgaaattctgacagtttgcagggaaaaggtgctgaatatcttgatataatttacatacttctataaacaggcatttttatacctttggaaagataaatgagtagaaaccaagtattttacaattctaatagttttactgacatgtagagggaggggcatagactgtccaaaaggggaactattgccaggcttttaggagctgccrttgctaacaaatcagtttgggtaggcaggtgttctagaaaaaccagaagaaaaatgaagatcagagatgatttttctcttcttttcacaaattaaataaaatgaaagacctgatgctgaaagtaattatccacaggggcttcctgcagtgtaattctgcaatataaagctgaaggaaatgtgaagacgagtatttcttcataaacaaaaataattatgttggttgactatatccagatgaaaagtacatgagttttagggcaaactctctacatttgagtatgcaaatactcaaagtttc

SEQ ID NO: 145307 - DNA, 601 bp, Human
aggcaggtgttctagaaaaaccagaagaaaaatgaagatcagagatgatttttctcttcttttcacaaattaaataaaatgaaagacctgatgctgaaagtaattatccacaggggcttcctgcagtgtaattctgcaatataaagctgaaggaaatgtgaagacgagtatttcttcataaacaaaaataattatgttggttgactatatccagatgaaaagtacatgagttttagggcaaactctctacatttgagtatgcaaatactcaaagtttcttgataaaatgcatgttaaacgyaccaaaagctccagagtctccaaaaggagatttattatatgatctccgcagtgggactagcctacaggtgaaaagtaaaactctccaaacgcgaagcaaatttatccactcaaatggatatatttatgttttatccatccaagcagaagcatctggttaagtggaaagcatacttgtatttgcatgacaaattcatcactgcatagggtaacatgcttcctccttactccctgccatttatgaaatgaaaagtctagtaggaatgcatgctctcctcccacccaccaccagagtataatt

SEQ ID NO: 145308 - DNA, 601 bp, Human
ctgaaagtaattatccacaggggcttcctgcagtgtaattctgcaatataaagctgaaggaaatgtgaagacgagtatttcttcataaacaaaaataattatgttggttgactatatccagatgaaaagtacatgagttttagggcaaactctctacatttgagtatgcaaatactcaaagtttcttgataaaatgcatgttaaacgtaccaaaagctccagagtctccaaaaggagatttattatatgatctccgcagtgggactagcctacaggtgaaaagtaaaactctccaaacgcraagcaaatttatccactcaaatggatatatttatgttttatccatccaagcagaagcatctggttaagtggaaagcatacttgtatttgcatgacaaattcatcactgcatagggtaacatgcttcctccttactccctgccatttatgaaatgaaaagtctagtaggaatgcatgctctcctcccacccaccaccagagtataattactactcaccaaattataactattatgtaatttttaaattttaaagagtatataagaatatggccattacaagtgccacctttgttggtttgt

SEQ ID NO: 145309 - DNA, 601 bp, Human
gttttctgaaattttacagtaatgttcatagcagcacgtccccacaaaacacactcatttaatgtttctggttcaactaatggtttttatttcacatttggcatctttttcttctacaaactaatagattctccagaaactattcacctgagatttctttttctaccatgcctgtcctttgcaggattgtttgaattttcaagagaatttgaaacacttagtctctagacagtttctttcaatgtagccctttgctcttcagacatatgtgacaggagtcaaatcactgtttgtttgtttgttttttttaatggaaaaaatgagtttattttttagtaaattttgtagatgcaaaggacatatctggtggcaactggaatcacagaatgagcattcagaagccacaacagaaaatgtagatttagaaatctttcatacagaattggaagctggagccataagaatagaaaacattctttttttttttttttttttcagtcattatttgtacagctgtgtgaatttttttttttttattatactctaagttttagggtacatgtgcacattgtgcaggttagttacatatgtatacatgtgc

SEQ ID NO: 145310 - DNA, 601 bp, Human
ctttgcaggattgtttgaattttcaagagaatttgaaacacttagtctctagacagtttctttcaatgtagccctttgctcttcagacatatgtgacaggagtcaaatcactgtttgtttgtttgttttttttaatggaaaaaatgagtttattttttagtaaattttgtagatgcaaaggacatatctggtggcaactggaatcacagaatgagcattcagaagccacaacagaaaatgtagatttagaaatctttcatacagaattggaagctggagccataagaatagaaaacattctttttttttttttttttttcagtcattatttgtacagctgtgtgaatttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttg

SEQ ID NO: 145311 - DNA, 601 bp, Human
ctctagacagtttctttcaatgtagccctttgctcttcagacatatgtgacaggagtcaaatcactgtttgtttgtttgttttttttaatggaaaaaatgagtttattttttagtaaattttgtagatgcaaaggacatatctggtggcaactggaatcacagaatgagcattcagaagccacaacagaaaatgtagatttagaaatctttcatacagaattggaagctggagccataagaatagaaaacattctttttttttttttttttttcagtcattatttgtacagctgtgtgaatttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatt

SEQ ID NO: 145312 - DNA, 601 bp, Human
gtttgaagtcaggtagtgtgatgcctccagctttgttcttttggcttaggattgacttggcaatgcgggctcttttttggttccatatgacactctcagggaaaaacaagggtagggttggcagttgcccactgcagagatagaattcctccttcagttttgcacccttaactgccttgtttgcctctctctattcctgtttttttttttttttttttcggagaaaataggaggatttttctgtccaaatctctgatgctcatttatttgcactagctatggtcccatcttcacttgagtygcatatgttcttcatcaatactcttcggaagtcaatgcagctataaaacacaaataagaatcttcccaagatggtgttggaataggaagaattgcatctctttcagtgttttaggagaaacatctggcagaacttaaattcgattctgtctcatagctacatcattgccagtttatcagagaactgacactgaatcctcagattcgagagtggtgcttactgcccttttacatagattagcctcattttacttttctttgtatatatttcaaatatatttaattttatgtcaaccacatt

SEQ ID NO: 145313 - DNA, 601 bp, Human
catgattgggaaaagcagcattaatttaaataaggaatcaggttaacattcaaattttatgttttaaatagcatgaaataatctgaccatacatataaattacatacaaatatatgcaagcatacataacctaactatttttacacagaatattttgtatacttgaatgtggcttttttggtacaagtttggaattatttcacattttagacattttaaaaggctacattgttggagagaaggaaatacaaaacataatacatgtaattcaaatcctttttcttaccttttccactttttkcattctattccttttttaaaatcattctgtcacatcttaatagctgtctgactgatacttaagaggagaactacaaatagagcaaacaacctttctagctaccctattggttgatttctttctttctttctttccttccttccttccttccttccttccttccttccttccttccttccttccttctttctttctttctttctttctttctttctttctttctttctttctctctctctctctgtctctctctctctttctctctatctttctctctttctctctttctctctctctctc

SEQ ID NO: 145314 - DNA, 601 bp, Human
atagagaaagacaccaagaatatgacacagtttacattctagtgagggacacaacaaaatcaaatttaaaaaagagtgtaatagatgctgataaatactgtagataaagcacataagaaaatagaaataaaggctgtcaatggagaagtcatgatttttattttatttatttatttatttatttgagacagagtcaggctctgtgcaggctggagtgcaatggtgtgatctcggctcacaacaacttccaccttcctggctctagggatgctccctcctcagctgcttgagtagctgggamcacaggcattaccacccacagctatttttttttttttttttttgtagagattgggttttgccaagttgcccagtttgctctcaaatctctaggctcaatcacccatctcagcttcccaaagtgctgagattacaggcatgagccactgtgcttagctgaaaagttgtaatttttaaaagggtggtcagcttcacctgaagtgatatttttacaaagcccagagagaaatgcaggaatgaacaaagtggacacctggggaaagtgaatttcaggcattggaaacagcaagagcacagactc

SEQ ID NO: 145315 - DNA, 601 bp, Human
cacagtttacattctagtgagggacacaacaaaatcaaatttaaaaaagagtgtaatagatgctgataaatactgtagataaagcacataagaaaatagaaataaaggctgtcaatggagaagtcatgatttttattttatttatttatttatttatttgagacagagtcaggctctgtgcaggctggagtgcaatggtgtgatctcggctcacaacaacttccaccttcctggctctagggatgctccctcctcagctgcttgagtagctgggaacacaggcattaccacccacagctatttttttttttttttttttgtagagattgggttttgccaagttgcccagtttgctctcaaatctctaggctcaatcacccatctcagcttcccaaagtgctgagattacaggcatgagccactgtgcttagctgaaaagttgtaatttttaaaagggtggtcagcttcacctgaagtgatatttttacaaagcccagagagaaatgcaggaatgaacaaagtggacacctggggaaagtgaatttcaggcattggaaacagcaagagcacagactctgaagcaggagtggcctactatgct

SEQ ID NO: 145316 - DNA, 601 bp, Human
cataagaaaatagaaataaaggctgtcaatggagaagtcatgatttttattttatttatttatttatttatttgagacagagtcaggctctgtgcaggctggagtgcaatggtgtgatctcggctcacaacaacttccaccttcctggctctagggatgctccctcctcagctgcttgagtagctgggaacacaggcattaccacccacagctatttttttttttttttttttgtagagattgggttttgccaagttgcccagtttgctctcaaatctctaggctcaatcacccatctcarcttcccaaagtgctgagattacaggcatgagccactgtgcttagctgaaaagttgtaatttttaaaagggtggtcagcttcacctgaagtgatatttttacaaagcccagagagaaatgcaggaatgaacaaagtggacacctggggaaagtgaatttcaggcattggaaacagcaagagcacagactctgaagcaggagtggcctactatgcttgaggaagtagaaaaggccagcgtggctagtttggagtaagtagcgtataagaaaggagaatcagcttctcacaaagttggtgaat

SEQ ID NO: 145317 - DNA, 601 bp, Human
taatgacttttggattgatttttagttaactagaagtttggttaacttattgcgacaatccacttgcaaagccgtacatttaaattacaatttggctgaatccagtatgttgtatctgacaagttttatgaaactgattattagagaaccatgacttgtctaaaacaagcatatttgtcatataatatatgtcatatatatatatattattaggcgattctcaaataatgggaacaaatatgacatatagtgttctgtagagatagcatgaaaatggtatcattttattagaatatgatgccagtgttgtagataaggttatgtacaacattaaatacaatttagtaaaaatatgtctggttaaagttgtagcatggaattaattgagtcatttttgaggcaaatactggtcatttaagaatcacattctttagcgtagagcttttattagtagaaggtacattaacaataaattcttagcctgcattctaagacagctctgcccaatgcagtagatattacttatataggagaaaacctctaaaatctttgaaaaaaaagaaaaaaaaactaagtgacaaaacaatgaaaaaatatctaa

SEQ ID NO: 145318 - DNA, 601 bp, Human
acattaaatacaatttagtaaaaatatgtctggttaaagttgtagcatggaattaattgagtcatttttgaggcaaatactggtcatttaagaatcacattctttagcgtagagcttttattagtagaaggtacattaacaataaattcttagcctgcattctaagacagctctgcccaatgcagtagatattacttatataggagaaaacctctaaaatctttgaaaaaaaagaaaaaaaaactaagtgacaaaacaatgaaaaaatatctaatggagtttagggaaacttaatatatawtattttcctaatgacattagttttgagttcattgtatacattatggagggagtattaattttattctgattttgatattgccaaataaaaagcatgaaaattatgattgcaaaattctttcctttagaagagttcctttctccttaagaaagtaacacaaaaattaaaacaaaattaaacttttcaacataagaaatataatttgtaaaagtacatatagcagtagaatatgttaaccagcatattatactaggatactggatattcagtttaaaacacattataaatacatgtggtgtt

SEQ ID NO: 145319 - DNA, 601 bp, Human
taaattcttagcctgcattctaagacagctctgcccaatgcagtagatattacttatataggagaaaacctctaaaatctttgaaaaaaaagaaaaaaaaactaagtgacaaaacaatgaaaaaatatctaatggagtttagggaaacttaatatataatattttcctaatgacattagttttgagttcattgtatacattatggagggagtattaattttattctgattttgatattgccaaataaaaagcatgaaaattatgattgcaaaattctttcctttagaagagttcctttctmcttaagaaagtaacacaaaaattaaaacaaaattaaacttttcaacataagaaatataatttgtaaaagtacatatagcagtagaatatgttaaccagcatattatactaggatactggatattcagtttaaaacacattataaatacatgtggtgttgattgcacctgcgtgtttcccgtacattagcatgcagcttttggttccctaggccccaagatattacccggaataaataaatggtagtgattgatctgagctagagctgcccattaatatggttgtaacatgaatggataac

SEQ ID NO: 145320 - DNA, 601 bp, Human
ataggagaaaacctctaaaatctttgaaaaaaaagaaaaaaaaactaagtgacaaaacaatgaaaaaatatctaatggagtttagggaaacttaatatataatattttcctaatgacattagttttgagttcattgtatacattatggagggagtattaattttattctgattttgatattgccaaataaaaagcatgaaaattatgattgcaaaattctttcctttagaagagttcctttctccttaagaaagtaacacaaaaattaaaacaaaattaaacttttcaacataagaaatawaatttgtaaaagtacatatagcagtagaatatgttaaccagcatattatactaggatactggatattcagtttaaaacacattataaatacatgtggtgttgattgcacctgcgtgtttcccgtacattagcatgcagcttttggttccctaggccccaagatattacccggaataaataaatggtagtgattgatctgagctagagctgcccattaatatggttgtaacatgaatggataacaatgaaatttttaccgtattatttaacatattttcaagcttctgtctgtagactgaa

SEQ ID NO: 145321 - DNA, 601 bp, Human
aaatatctaatggagtttagggaaacttaatatataatattttcctaatgacattagttttgagttcattgtatacattatggagggagtattaattttattctgattttgatattgccaaataaaaagcatgaaaattatgattgcaaaattctttcctttagaagagttcctttctccttaagaaagtaacacaaaaattaaaacaaaattaaacttttcaacataagaaatataatttgtaaaagtacatatagcagtagaatatgttaaccagcatattatactaggatactggatrttcagtttaaaacacattataaatacatgtggtgttgattgcacctgcgtgtttcccgtacattagcatgcagcttttggttccctaggccccaagatattacccggaataaataaatggtagtgattgatctgagctagagctgcccattaatatggttgtaacatgaatggataacaatgaaatttttaccgtattatttaacatattttcaagcttctgtctgtagactgaatgtacctgattatatcagggagatcaatgagaaagtactttttttttcaagctaagtttgatttc

SEQ ID NO: 145322 - DNA, 601 bp, Human
tttagaagagttcctttctccttaagaaagtaacacaaaaattaaaacaaaattaaacttttcaacataagaaatataatttgtaaaagtacatatagcagtagaatatgttaaccagcatattatactaggatactggatattcagtttaaaacacattataaatacatgtggtgttgattgcacctgcgtgtttcccgtacattagcatgcagcttttggttccctaggccccaagatattacccggaataaataaatggtagtgattgatctgagctagagctgcccattaatatggttgtaacatgaatggataacaatgaaatttttaccgtattatttaacatattttcaagcttctgtctgtagactgaatgtacctgattatatcagggagatcaatgagaaagtactttttttttcaagctaagtttgatttcattgacaaatgacattagaagcatacctaacatttaaagtaataaccaagggtagatatgagttttgtggggtctcaggctgacataaaatatatggattttaaagcttcaaataacataaaaatttattttggacattttacaaaattatcattacat

SEQ ID NO: 145323 - DNA, 601 bp, Human
agctaagtttgatttcattgacaaatgacattagaagcatacctaacatttaaagtaataaccaagggtagatatgagttttgtggggtctcaggctgacataaaatatatggattttaaagcttcaaataacataaaaatttattttggacattttacaaaattatcattacattcctaagcccacaaccgcccccccagttcttggactttagaatgacctatgcaagtgtgaggctctaaatcttagcctgcattagcttcagagtaaatctacctctgcatagcaaaccataaatcwgtactgataatgtttaattgaatatattaatataatgtctgtgatgggattcagcccttgtttaaaatgatgttgtaaaaggatagctttaagaggtatgataacgctgataactctctgagtcagagataatttccttggctgcttctttttctctctctctctttctctttttttctttgagataagatcttgctttgttgcccaggccggagtgcagtggtgcagtcatagctcactgaagccccaaattcctggtctcaaacaatcatcccacctcagcctcttgagtagctgaga

SEQ ID NO: 145324 - DNA, 601 bp, Human
tatatggattttaaagcttcaaataacataaaaatttattttggacattttacaaaattatcattacattcctaagcccacaaccgcccccccagttcttggactttagaatgacctatgcaagtgtgaggctctaaatcttagcctgcattagcttcagagtaaatctacctctgcatagcaaaccataaatcagtactgataatgtttaattgaatatattaatataatgtctgtgatgggattcagcccttgtttaaaatgatgttgtaaaaggatagctttaagaggtatgataackctgataactctctgagtcagagataatttccttggctgcttctttttctctctctctctttctctttttttctttgagataagatcttgctttgttgcccaggccggagtgcagtggtgcagtcatagctcactgaagccccaaattcctggtctcaaacaatcatcccacctcagcctcttgagtagctgagactacaggtgtatgtcactatgcacagctaattaatcaaaatttatgtttttagagacagagtcttggtatgttgcccaggctggtctcgaactcctggcatcaaat

SEQ ID NO: 145325 - DNA, 601 bp, Human
ttcatgcccatcaatgaaaacttttttttttccctgacacaagactgtcacatatttatatgttttcaccaaaacagattcaagatcattatcattagcagcatttgttgacacatgcagccaaaaagtcaggcatgaaacagaaagtttttatggaaaattatttattttaacatttcaatagatttcatatatatgtagaaagagcttttctgacaaaacatttcatcgttttaaatgtatcaaattatgcaacatacattccttctacatataagaaggattattagaacttgattgrggggtggttatacactgttccaaattattgcttctgttgctgccatagttggtgctgctcctgctagtggaaatgattttgacatcagttcaatttaatttaacaaggatttattgagcgtttgccacttattctacaagattcaacaggcgtttacctactagcaggaggatggagagtagttaccaaatacaagtaacatattttaaggaattcttcatctaaatttcaggacatttggtctaagtaatgagggtccagacagaaaaaggacaaatttagagctgctttgattttaaa

SEQ ID NO: 145326 - DNA, 601 bp, Human
ttttccccactatttttactgaattccacccttcatttgaacacacattgaaaataagcttgtataatcaggaattgattcaagtttatcaggtgaacaacttattaaactgttcagctctggacacaggactggttgcttgcaaagcatgggctaaaatgaatatcctgactggatgtaccaaggacacaccactaaaattcatagcaaattttacattactgtctaaaatcatcaattaagtttacagacagaagtcttgcacacagggaaaaatatgtggtcatcatcactgaaatarttggcttctgagtgctttaatctactcatcctaagtaacatataaaaaatatgaaattctaaaagaaagaaagagagagggaatgagagagaaagaaaaagaaagaccctacatatcacatggtgtgtaaagttcatgttggtagctgcaagtcatgctgtgtagcgcgagcaggtatgtttatagataatcacttcagatgcagagatcacaggggccatctgccggcttgctcaactaatgcatttgcttgagcctctagccacctgcagccttctgaaaacaccacctcgtggacca

SEQ ID NO: 145327 - DNA, 601 bp, Human
agcctgggacatcaggcaggtctttaaagaggaggtaatatttcagctgagccttgaaggatgagaaagtgactcctaaataaatgggactagagaaaaagatagtgttgttcaaaagaagcagcttatgcaaaggcgtggagacttgagaaaatacaatctgtttaggcgtctgtaattgattcacatggccaaagtataggacaaataaaaaccaagacaaccagcaacagccagccacatcatgaaagtttaatacatgtgctatttttttgtttgtttttttttgtttgttttttgrtaagtttgaggatggttctgagccaatttgcattttagaaacatcaattctgttacagtcaaagtctgtaacatttgggatggtgggtaagacaggagacagaaaaccaagtcggtgagagtttattccaggcaggatatggtgaggactgaaaaatggtcatggatgaatttaaaaggatcagataaataacaattatttggaaagtagaatagttgtgagatgtttaacagttaagtatggagttgaggatcttaggaggcatctaggcagagggaaaggaggtggggaggtgtctta

SEQ ID NO: 145328 - DNA, 601 bp, Human
agggaggctgggcgcggtggctcacacctgtaatcccagcactttgggaggccaaggcagacggatcacgaggtcagaagatcgagaacatcctggctaacatggtaaaaccctgcctctactaaaaatacaaaaaaattagccgggcatggtagtgggcgcctgtagtcccaggtgctgaggcaggagaatggcgtgaacccaggaggcagagtttgcagtgagccaagatcgcgccactgcactccagcctgggtgacagagtaagactctctctcaaaaaaaaaaaaaaaaaaaaaargaagttgcctgagggatatctatgtggaggtgtgcatgcatgaaatagtcaaattcctaagtatagaggtatatgggaaaaataattgaacctagttgatggtgaagcatgcattatttaatgtctctcgataaagaagagtagactgtaagcttgattgttaacagggccccttgagagtgaagtgtaagaataagtactctacaatacactgatttttatattctctttctcctcctcattctctttttctgttcacccaagtagtcaggaatactattttaaaaaatgctacattaa

SEQ ID NO: 145329 - DNA, 601 bp, Human
tgtaatcccagcagctcaggaggctgaggcaagagaatcacctgaaccacggaagcagaggttgcagtaagccgagattgcatcactgcactccagcttaggcaacagagtgaaactctgtctcaaaacaaaacaaaataaaacaaacaaacaaaaggtaattgattagtttaaaatggacccactaaagtatgaaattcctatgaacagttgctgtgtttgtaagggtacattatttagacaccttgaacagaaaaacaatctcgttacttacaaaaagggctttcaaaaatgtaaaaaktgtttaacttaaagatttcgtgaatatttttacttatgaggcaactttcctttacatttataaaatatttgaagaatgatttaatctgaatattagaaatgacacctttgtcttttagtctttggttagcatcttcatttgaaacatgaaacatcagagagtacatgtatgtgtgtttacatatgtgtgcatgtttgtgtatgttacaatgttacacatttaatcggtcagctctttgtgtatatttttacatacaaattagtagcacagtttgatctgaaaccctgttctttctatgtg

SEQ ID NO: 145330 - DNA, 601 bp, Human
ccactaaagtatgaaattcctatgaacagttgctgtgtttgtaagggtacattatttagacaccttgaacagaaaaacaatctcgttacttacaaaaagggctttcaaaaatgtaaaaagtgtttaacttaaagatttcgtgaatatttttacttatgaggcaactttcctttacatttataaaatatttgaagaatgatttaatctgaatattagaaatgacacctttgtcttttagtctttggttagcatcttcatttgaaacatgaaacatcagagagtacatgtatgtgtgtttacrtatgtgtgcatgtttgtgtatgttacaatgttacacatttaatcggtcagctctttgtgtatatttttacatacaaattagtagcacagtttgatctgaaaccctgttctttctatgtgatgttcttaatccagtagcgctaacataattccctttatttaatattatgtggtttgtaagctatattgttttacattatttcactggagtcttaaaaaaatgaggtagaggaagcatcgttatcactagttcatttgtacatatgggaaagttaagccgagagaaagtttaataagcagt

SEQ ID NO: 145331 - DNA, 601 bp, Human
tcagtgtgattgcaaaggagacttgattttgtaaagaaaataagagtaagataatcttagaagctgtgaagaaaacacatgcagtagcagtaataaacaaaatgctggcattgactgaagctgttgtcatcatgtttctttgaacaacacataatattcatgacttcatgtgctcgtaaggagcacatgaaaagtgtaagactttgatttggcttttcttgatttttattttagatgagtgcagaatatgaataattttgctatagaatttgatgcatttgattgtaggaaagctgtgggygttatattgttgctttgcaaagcctggtgcattcccagggcagaagggggaatatagaagaatagagaattagaagtaggaagtaggagacaagaatcagaaatagcacatactatcaattataagatgcatctttttccacattttaccttgcaaaatcaggatacttgttatgataaataacatgttaaagtgataatacacagtttttttttcttttgtggtagtatataagattatggtgtacattacagtcaatgagaccataccattgaacatattgaatactaaactgatctt

SEQ ID NO: 145332 - DNA, 601 bp, Human
tttggcttttcttgatttttattttagatgagtgcagaatatgaataattttgctatagaatttgatgcatttgattgtaggaaagctgtgggtgttatattgttgctttgcaaagcctggtgcattcccagggcagaagggggaatatagaagaatagagaattagaagtaggaagtaggagacaagaatcagaaatagcacatactatcaattataagatgcatctttttccacattttaccttgcaaaatcaggatacttgttatgataaataacatgttaaagtgataatacacagtttttttttcttttgtggtagtatataagattatggtgtacattacagtcaatgagaccataccattgaacatattgaatactaaactgatctttaatgtggaaagttgtagggaactatcgatgattttgttccagagaagaatagcgatgtgttttaataagattcacatgacaatgatgtaatactatggattagagatgttgagtaggtgaccttttaaacatctataagtcttttctactatacaaagtataaattgctgtgctgttaatctatgtgagaaataaaaccatcctta

SEQ ID NO: 145333 - DNA, 601 bp, Human
tttctactatacaaagtataaattgctgtgctgttaatctatgtgagaaataaaaccatccttattcagagcagtaatgggtggagtggagacaaagagaaaggaggtcattgagctgtggagatggaacattgtgaattgacaaccagttgggggtcgggagcaagggacaaggaggggttagaaaaaaaaaaaaacctgaaaatttagttgttttaagttcacgtttttgccttaataatggttggatttttcgtgtggggaaatgaaagaatccaagctcttctaagtcatctcttcygagaggagatgggtgggagtggaaatgggcacactcagggcggtgtggggggtgagaatacaggcttcgttgttggggagacctgcagtcaagtctgtgaaattattgtgtaaacttgggcaaaagcctgaatcctcttaatcatagttttctcatgtataaaattaggacggtaatgcctaccacaaaactttgtcagaagaattaaaggtccctttaccacagtgtctgacacgtaattatgctcaataaatattagctgttaattatttgaataaaagagctatacaacaatttgtg

SEQ ID NO: 145334 - DNA, 601 bp, Human
taaattgctgtgctgttaatctatgtgagaaataaaaccatccttattcagagcagtaatgggtggagtggagacaaagagaaaggaggtcattgagctgtggagatggaacattgtgaattgacaaccagttgggggtcgggagcaagggacaaggaggggttagaaaaaaaaaaaaacctgaaaatttagttgttttaagttcacgtttttgccttaataatggttggatttttcgtgtggggaaatgaaagaatccaagctcttctaagtcatctcttccgagaggagatgggtgggrgtggaaatgggcacactcagggcggtgtggggggtgagaatacaggcttcgttgttggggagacctgcagtcaagtctgtgaaattattgtgtaaacttgggcaaaagcctgaatcctcttaatcatagttttctcatgtataaaattaggacggtaatgcctaccacaaaactttgtcagaagaattaaaggtccctttaccacagtgtctgacacgtaattatgctcaataaatattagctgttaattatttgaataaaagagctatacaacaatttgtgaagtggagtgaataaaat

SEQ ID NO: 145335 - DNA, 601 bp, Human
aaataatattttgcttagagaagaaaacctctcttaggcgtccttaggtcacctggggcagagtatagtcttattattctttatatctgctctattttagaagagacaattacatatcccatggagggtcttgttatgtgaaccaggtttgtttttcatttagaagcattagtgttctgaaattgaaattatgccagagactttttgaggtaagcttttaaaaatttgtaacttctcagcaaattatttcaaacgttctgcagacatgcttattttccctcttttatagctagttaataamcctatttctcctctgtctttcaaaatgatagtacaatggaagaacatttacctcaaacttcctctgtatttctctcttctttttaggccagtggctcttaccttgggtatgtagtagtttgacccaggaagattttacaaataaaatagcctgggagtatggatggatattctgactgaattattcagtagtgtagtctgaacatcacagcacttgagcgaacataagatactcaacccttggcatagagaactaaggaggagggcatgcaaactgggtcgctggcttccctgagctaag

SEQ ID NO: 145336 - DNA, 601 bp, Human
caatggaagaacatttacctcaaacttcctctgtatttctctcttctttttaggccagtggctcttaccttgggtatgtagtagtttgacccaggaagattttacaaataaaatagcctgggagtatggatggatattctgactgaattattcagtagtgtagtctgaacatcacagcacttgagcgaacataagatactcaacccttggcatagagaactaaggaggagggcatgcaaactgggtcgctggcttccctgagctaaggcaattttgcttctttctcttctcaaataaagawcaccagaatgaattcttcatgctcttgggattggtccattcacagtgtgaagtttccataaatcaaagcatttgagagcatggaaaaataagagtatgtcagatatctactgaaagaaacgagtgacacactgcctggggctacaacttttatgaattttgccatttgacagcctttgcttcagtggcttcttcttctgatcagcaagtacacatctctcaacaaatgacataaatgttcccctctgtcacctgtgcctctgaaggagagagcatggtatgcatgagtaccaaggagcca

SEQ ID NO: 145337 - DNA, 601 bp, Human
cactgcctggggctacaacttttatgaattttgccatttgacagcctttgcttcagtggcttcttcttctgatcagcaagtacacatctctcaacaaatgacataaatgttcccctctgtcacctgtgcctctgaaggagagagcatggtatgcatgagtaccaaggagccaagctctgtgattcattagttactgagttggaaatgtgtgtgcatgctgcaggtcaggttgcataagaaacagacctggaccagggatttacccatagggaatttattggtgtgcattcttggaataaayacttgtgagggagaaaagaaggaagtaggattgggcagtaaaagttgttgagcaaagcagcctaggacttggctgaccttgtggggaggtcaggagtagggaagggtcttcatagttgtcttgagctaaagggaaaaggaggagctttaaaggctcacagcagccaatcactggatgtggcctgttcttaagaaagatgtgttatctttggtcaaggtggctctcttcaactgaggatgatttttggaaaggccttagctgagatgtgttggccaccagcacacgaatgtttcatttggt

SEQ ID NO: 145338 - DNA, 601 bp, Human
cacaaaataataaagtgattagcaaaatagtaggagaagatgaataaactattctatactctttaaaattttttaaattatttaaatagatgtttatagaatataggttataatatatttatgtgataagacctctttttatagatctcatgccaaaattaattattctgtattataccttggtggattctgtgtgttactcagtcagagtatccctagaaaggaattgatttcatcttttagtcaagtctattcctggaaatcaagttcctccccttcattgtgaaactaactcttaggwgcatcctttttgtcccaacttaaatatcatttctttaaaaagcacttccctgaaccccgggctcagcttggttttcctgccatatgatttcttggtgttcttgcttttgtgtggtcaccaaaattacaattatttgttcaactttctacactgatagcataccccactgtaagctcatgaaggcgggggttacttgattcaagactttaggctccctcttgttaccccttctggttttcatccacaagtcccaataagccagacatatagtagatagtccatagttatttttaataggtg

SEQ ID NO: 145339 - DNA, 601 bp, Human
ttgagtttttacattcatattaaccaaagtgcagaatgatggcagttatagggggtgaaagattgttgaaatgacggattgagtagcgcgtttgtcaggttatgaagttcagggaaatgtgtaattacgtgtgagtttcctgaggttcctctgttcaacattatgttctgacatacagcagggacagttccagatgtgaaatgcaaatcgggaggtgctgccctgctgctgatgctgtgcttgatcatgcaaatctaatgcagttctgggtatttcaacaaagcttttagttgaagtcccrtgcatgtattgatttaaaattcctacttgagagagcagtgtcatttttttcagctccaatttttaaaatacggaacaggacttggagacagatttagagactggacatccagccacactcgttaatcacagagtgtgagtggggacagggcagggaggagggagagaagggcacccttaaataatatgggggtttctaagcatattaaatggtatattggaaccagatttacaaatgttctatagaaagtttctttgcttagaatagatcaaatcaacccattatacatgtttactgaat

SEQ ID NO: 145340 - DNA, 601 bp, Human
aatgtgtgccatggtggtttgctgcatagattatcccatcacctaagtattaagcccagcatcactaagctactcttcctgatgctcttcctcctacccccaaccctccaacaggccccagtgtgtgttgttccctgacatgtgtccatgccaccgctaattttaaaaaatttctccaaaaacttaaatgcatggaaatttgtagtgaatttatagcaacggtaaggagatacccatttggagatatatatttaaaacatgaaggcttttttattcaaggccttttgtcatcgcgccattrctagaaagatacccagtaaagcatttctagtgtttatatcgaataatcaaaattctcttttaaatttcatttattcaagtacttttggaatagtttacagcaagtatgtaatttaagcataggaaatcttataaaaaatacaaagttattagactggatgagagatgggttgattattatatatttatttcctgctgtttttaatattgagagtttatttaaaataataatggaacttgtattttaacacatgggtattttaacccatgtgatttattaaaaaaaaaaaaaggtcatttc

SEQ ID NO: 145341 - DNA, 601 bp, Human
aaagataatcctctttattcagtattgagaaaaccacgttaataatgttttctctgttttgtaacattgtgtaaaactatcatatttctttggtctttaatacacagtaaaattatttaaagtaaacaaaacaacaaaaggcaacaactcaagagggacttactacttgtatcagtattctttgttagtataaatgcagtgattcatgatgagttttactgggatttgaaattttacaggagtcatcaagactgcccttccaaacatggatagagaggctaaagaccagtatttgcttgtyattcaggcaaaggatatggttggtcaaaatggaggactgtcaggaactacatcagtcactgtgaccctaactgatgtcaacgataatccacctcgctttcctcgaagtaagttgttttcttaagtgacacaagtgcaataactttccctgaaagtctataaaatacatctttaaaatgactttttttcaaatacttctaaagcaaataattgtcttacttcattctctcaaatttgcattttattagagacataattttgattcaggaatatggattataagggtattgagaagaaatag

SEQ ID NO: 145342 - DNA, 601 bp, Human
aagtgacacaagtgcaataactttccctgaaagtctataaaatacatctttaaaatgactttttttcaaatacttctaaagcaaataattgtcttacttcattctctcaaatttgcattttattagagacataattttgattcaggaatatggattataagggtattgagaagaaatagaagccatcatatatttgcattacttctatcttaaatatagtaagatttttctttcattcacattttgaatactagacaattattaattgtgtttatgtattagtcttttttctaagaattattttttatattttgtaaattataaagttgttgccaattaataatattcaaatacattttattcattctatgcactaaaatattgatttatttttgaaaattaaaaaagagtaataaatgttttcattttatcatttcacactttttaaagccagtttatacacactgaacattcctttagcagttcccccacgtctttcttgtgcaaacattcagtgttttaaaaaccaatctaaagaactagaaaaccaaatgccctcagttccacttatttgaccaaaggggcttttaacttaaccaag

SEQ ID NO: 145343 - DNA, 601 bp, Human
tggagtgcagtggtgtcatctgggctcactgcaagctccgcctcccgggttcacgccattctcctgcctcatcctcctgagcagctgggaccacaggcgcccgccactactcctggctaatttttgtatttttagtagagacggggtttcaccgtgttagccaggatggtctcgatctcctgaacttgtgatccgcccgcctggtctgtaaaatttttatgatcattaactcatcaggataggatacatgtgtattaagatgagatatctgaaacgttgctgtttgaaataggtaaaattaaaaaaaaaaaaaaaaacttgtggtgcttcagactcatatttgccagatatgtatttcactgttcctcagtttcactcaacaatctagagcagtcactaaactacttgtaattcctggagagcaacgtaaagttttttccagttcttcaaacctccccctgcctgttgactcccctgcactctgctttcgtgcccccttaccatactcatcttttgagtctaaaaaatccctcctatttttcctttaaacaataaacagaagaagcacagcgcctgtaccagcaagatgcattttttttca

SEQ ID NO: 145344 - DNA, 601 bp, Human
gccctggggaagaagttgaatagtggattcataacaatgtttttctcaggtagacaagagaaagtggcacagaggtaatcacctgtgcagagacttcacttatgagataacctgctaaatacagaaagaaccggggcaatttctttggaggataatgaggaagggaatgtgggcaacagatgaggtaatgtaaatgagagggctcttaatgctccttcacaaaactgctgttggtaaataggaatatatatgtacagtgctttgcaaatagagtggattacacataatacatattgtaagrcattttaagtgcagctcaataaaatatgagtagaaaattaaaatatttgcttatttctcttgaacacttattcatggaagtgcctgtgataactttaattcatttcaagtctttcacttcttttcaaaggactgtattacaatgaatatcaatatttattcaaattgttattactttcctggttataaatacatttccttcctcccttccttcctttcttcctcccttccttccttctttccttcctctctctctcccttccttccctctctccttcccttccccccttccctttccttc

SEQ ID NO: 145345 - DNA, 601 bp, Human
gaagaagttgaatagtggattcataacaatgtttttctcaggtagacaagagaaagtggcacagaggtaatcacctgtgcagagacttcacttatgagataacctgctaaatacagaaagaaccggggcaatttctttggaggataatgaggaagggaatgtgggcaacagatgaggtaatgtaaatgagagggctcttaatgctccttcacaaaactgctgttggtaaataggaatatatatgtacagtgctttgcaaatagagtggattacacataatacatattgtaagacattttargtgcagctcaataaaatatgagtagaaaattaaaatatttgcttatttctcttgaacacttattcatggaagtgcctgtgataactttaattcatttcaagtctttcacttcttttcaaaggactgtattacaatgaatatcaatatttattcaaattgttattactttcctggttataaatacatttccttcctcccttccttcctttcttcctcccttccttccttctttccttcctctctctctcccttccttccctctctccttcccttccccccttccctttccttcccttccct

SEQ ID NO: 145346 - DNA, 601 bp, Human
tttggcctccttttattaccccagagtatttttaaaattataccgagataaacaatggaatgctatggacagtccaccaaaacgaacagttttttggttggtctcccagtcccttctccgcataagaaaacatttacaaccagacattgctcagatgttgacaagatttttgttaaagtcataaatgtatttgttctggtggttctgaatgtctacatattacttcacatttggacaataaagctttaatgtccatctggatagagtcatttctattgtaattagattattttctacctgyggactgtgcttgataatcatctgaatttattttctctctatactataataaaactttggtccatatccttttcataaataatgtactattatatgtataataagatgtattccagtttgtgaaaattatcattgtattttgctacatttgaatgtattatacttggcatagaattcttttagaatcaggaagagaaaagcagaaaaaaatcctttttaaaatatatatttgaaaaaagaataaatagagaaaatgaaaaaatgctgttggttattctattactgttccaatatcttatac

SEQ ID NO: 145347 - DNA, 601 bp, Human
aaaatgaaaaaatgctgttggttattctattactgttccaatatcttatacagaaaatgtttattaatatgacaaaatatgcagaatccacaaggctaaagattgctgtaaataatggcatagagtttttatgatttaatcactcttatactttaagaataaacctgattatatagtttaaatataaaaatgatgatgaaattttcatcttaaacagttaaagcaatgcaaatgctattccttgaccatttatgaatgtttctatgataacctttataaccagttaaataggatttcaaamtttacaaagagtaaacataaagattatcacatttgagtgaatatagtttttgtttcacctagaattctttctttttacatttgctatcataacttaaaattaggtactttagtcttttttaatttttttctttaatatatggaagtctttcctctaatgtacctcagttttcaatataagtcttcagttgtgattaaatatggaatttttttctataaaatgcattactatggagttactatagagtaaaaaaaatgagcattttcaaaattaattccctatgaaagataactatgcatc

SEQ ID NO: 145348 - DNA, 601 bp, Human
atattgaggtctaatttctacaatcaaatatgtatttcatttagtatttcataaatgttgctgatatgtggtgagagagaatcaaaccaaggttaatgccaatttatttttcttcctctcattaatttttttctttcaaacattttattcaattaatcctgctgctcaggatgcatatttcttaaaattgagcaatgacattgctctcatttgactgtgaaaaggcataaattttggattattttagttttaagggccgagataatttggtgagcttctgaacttcagattatattttccrcttaattcaatcattgttactatgtatataagtatatactagcatactttaatcattatgtgtatgtgtttgtgtatataggcttattatctgcttattaaggtataaatttacctgtgcttgagtagtcaagagtagagatgaacatagagttttataaaaagataagaaattaacattctttgaagaaaatgatactaatttacatgtcgacatgtttgacctgatcaaaaggcactgactttgttcacttaggattatttcagcttttgttgattttgttcacttaagagtatttca

SEQ ID NO: 145349 - DNA, 601 bp, Human
atgtgtttgtgtatataggcttattatctgcttattaaggtataaatttacctgtgcttgagtagtcaagagtagagatgaacatagagttttataaaaagataagaaattaacattctttgaagaaaatgatactaatttacatgtcgacatgtttgacctgatcaaaaggcactgactttgttcacttaggattatttcagcttttgttgattttgttcacttaagagtatttcagcttctgtttgattttttaaaattttgatagtgattatagcagtattctcagaatatgtgtatrtcaaagatgttttccagtgagtccattatggaatttattttgctgagtacaagtcacagatcatgtaaaattgtccttcctttcccccctgccctcccatggcgtgttgattcctaggtcaatttcggtgggtaggattccaagaaagagatatttaagaaatagataggagagaatttaataattgtataaggaaggttaaaaggagaatttaaagacatagccagtatttctagtttgtgtaactagctgaatacttgcattgttctttgagaatggaatggagatgtgtaggatggc

SEQ ID NO: 145350 - DNA, 601 bp, Human
ccgctttggcctcccaaagtgctggaattacaggcataagccaccatgcccgacctaacataaaattattgtaagggaaaagttataaatgagggttattttcccataggtatggtctcactcaagcccatttacttaggaaaaaagatttacatttatttgttcaagaagtagggaaaagctacagatattgaaagctacaaaatatactttcatttgaaaaacagctagaatctccagagaaagaaatactcttaatgaagacagtcatagaacttttgaacaaaatcaaaattaaacrtaagacattaagtatatagacatgcacatatacacatacactatccagccctgatagtgtcatgctaccattaaagagaacagaatggagaaatttagaagaatttaacttggatcaattcctgaaacattaacaacattgttggctaaaggtgcgagatatataaggaggtcattgaacttaacgagtatgtatttggctataaaccagaagcaaagctatattaatgaagaaaaatgaagtgcaatgattttattaaatgaattcagtaattaacttgttttaatattgaaaaggcta

SEQ ID NO: 145351 - DNA, 601 bp, Human
caagtctagtagtcactaatatttatacttcacaaaaatgtttgcagacccttgccttacacagaattctttttatttaatcctaatttaattatccttgatgacaataaatttaaagactatttttgtactttggaaactaatacaccaaaaaagctgcttctctcttttagtgtctctaacacagatgtcacttgatgtatgaaaaagtatctgctagtctgtatgtcccctatttgattccagacttgaagtggtgaagccacagagtcattctgggaaccctagagatgctaaaagrgaagcagcgctttttttttttaaccctggttaaatttccaattatgtaagtatgcacttatatgtatgatatgtttggctgtgtccccacccaaatctcatcttgaattgtagctcccatgatttccatgtgttgtgggaaggaaccagtgggagataattgaatcatggaggtggttcccccccatactgctcttgtggtagtgaatatgtctcatgagatctgatggttttataagggggagtttcactgcacaagctcttctcttgtctgccaccacgtgagatgtgcctttcacct

SEQ ID NO: 145352 - DNA, 601 bp, Human
ctctggtgggttctcattctcacctttttttgaccaccgttggacaagaccgactcttagataataaacaaacaaaaaatgttagcctcataaaaatattactgagtttgttaatacaatgttgtcatggcagtattttctatgtgtcccaacatttttatgtaaaacctgagataaaaattaaaacttttttgttctgcagcaattctagaaagtgtttctgtgctcaagaaaaacaatatacttgactgttatttcttcccttatctctcattttaaccagcaggattctttgggtcakatgtatagttcaattttcagcctcttgtacactgaatatctgtgttctaatttttttgttgttgtgttgattcaagaaaaggaggctcaagaatttattgagactcccctatgtataaaaagcattttaggtactgggaataatagtgatgaacaaaatgatcagggcttcaaatctagtggctaagagagatattaaataagcattttagtaagtcctgtctggtctagatattgtaagcctattttgtatattgatttatatatatatatgtgtatattttccttttgcttactcgga

SEQ ID NO: 145353 - DNA, 601 bp, Human
cattttaaccagcaggattctttgggtcagatgtatagttcaattttcagcctcttgtacactgaatatctgtgttctaatttttttgttgttgtgttgattcaagaaaaggaggctcaagaatttattgagactcccctatgtataaaaagcattttaggtactgggaataatagtgatgaacaaaatgatcagggcttcaaatctagtggctaagagagatattaaataagcattttagtaagtcctgtctggtctagatattgtaagcctattttgtatattgatttatatatatatrtgtgtatattttccttttgcttactcggagataagctgtgggatctctttaatatttgtgtgcaaacatatatatacacatatgtaatgtgtatacatatatttatatatataatgtgtatatgtgtgtatatatgtgttatattttatgtagcaaagtgaatatgcactgtacacagtatgggatatattatatacagtatagtatgtgtatatacatcctattgtatacttatataactattgttttatttattttggttattacctcctttgtgggataagtcggaataaatgcgtg

SEQ ID NO: 145354 - DNA, 601 bp, Human
tcttcctctatccatttatataatatcccttaagaggccagtctccttattttataatttgttgcatatgcattactctcacgcattctctggaagactggttcccttcccagcactgctgtttgtggaatggcctcggagatgtcaccttgtcttctgtgtttttgtattagccagcaaaaaggaaaagtagctgatgctttatcccaagcttttctgatgattgaataagagcgagaaagtaaatgaagcttttaaactgtgaatcatgacttgaatattaccatgtattatcattatrtattgctattattataggttattgtgtttccatgccattttaattctgagattaatgaagtcagtaaaagagacatagcattttatatgcaaccatattgacaatctatattgcaggttgtcttgtactcatactcacgcgtattccaatagatataacatattgtatggctttttgatgaatataagcatgtatttgcattaggcactccagtaactatcaaaatgtaaatcctgtctcatatgtttaacataataaaacatatgttaatggatgaataaatagcagtcttctgaggta

SEQ ID NO: 145355 - DNA, 601 bp, Human
aacttcacttctgtgtttctcatccaagatggtaaaagatgtaagaacagcctagagtctagaggatttgactcatttctcatgtcagcattggcagactgatcaatgactgaacaggcattcattaaaaacctgtgttatgcaagcactggggaaaatgctaatgagaaaacaaagataaataaaacatttcctctgacctcaaggaacttacaatctggatgaagtaataagagctcataaaagttaaacaatatggggaaaaatatgccagcactgtaatatggcaaattgtaagatraataatcagcactccaagttcactggctgtgagatttcatttgaaggagtggtagtgtaagtagggcttcaagagatggcaagatttgggcaagccaagaaaacatcatgcaaagtacatttatgttttatttggttatatcctaaaagcctagtactaaattatgaaatcagcaagttcatttctgtaggcatcacagcaagcccaaagttcctatactaaaaatggccaatgaaatagaacatgatattattacaaataagatcagatatgaagacaggaaaacaaaaagtaatacgc

SEQ ID NO: 145356 - DNA, 601 bp, Human
ggggaaaatgctaatgagaaaacaaagataaataaaacatttcctctgacctcaaggaacttacaatctggatgaagtaataagagctcataaaagttaaacaatatggggaaaaatatgccagcactgtaatatggcaaattgtaagataaataatcagcactccaagttcactggctgtgagatttcatttgaaggagtggtagtgtaagtagggcttcaagagatggcaagatttgggcaagccaagaaaacatcatgcaaagtacatttatgttttatttggttatatcctaaaagsctagtactaaattatgaaatcagcaagttcatttctgtaggcatcacagcaagcccaaagttcctatactaaaaatggccaatgaaatagaacatgatattattacaaataagatcagatatgaagacaggaaaacaaaaagtaatacgcatcattttaagcatttctaataatctaaatatagaaatatgtttatatttatgttaaaggatacttggataatatttacccgtgggctttttcagcattcctagtattgtatatcctcacataaaaagtgataatattatgttggaaatt

SEQ ID NO: 145357 - DNA, 601 bp, Human
atgaagtaataagagctcataaaagttaaacaatatggggaaaaatatgccagcactgtaatatggcaaattgtaagataaataatcagcactccaagttcactggctgtgagatttcatttgaaggagtggtagtgtaagtagggcttcaagagatggcaagatttgggcaagccaagaaaacatcatgcaaagtacatttatgttttatttggttatatcctaaaagcctagtactaaattatgaaatcagcaagttcatttctgtaggcatcacagcaagcccaaagttcctatactaaaaatggccaatgaaatagaacatgatattattacaaataagatcagatatgaagacaggaaaacaaaaagtaatacgcatcattttaagcatttctaataatctaaatatagaaatatgtttatatttatgttaaaggatacttggataatatttacccgtgggctttttcagcattcctagtattgtatatcctcacataaaaagtgataatattatgttggaaattactttatgtgatggattagtgtgaacatatttggggtgtttgaaaaattcagtgtgtattttttaagtagc

SEQ ID NO: 145358 - DNA, 601 bp, Human
gaacactgaagacacacagatgtatgagatatggtcttttgcagaaaccctcttgttatgtagctgtagaagagatcttacatgaaaactcattttaaaaaattcagtgttagatctgaaaatgagaattcatcttgtaaaactttctcattgaacaaatgaagaaacagaaaagcacagatgaaaagccccaattagaacagtaggttagtgacagggtaatggccagaaatactgtcctttaatcctcagtctatggtccctggtggtgtagcacaaggagcatttggtaagatccacrgatcacacaccatgcaggttttcttaaaaaagcatgacttctgatgtaattggaaaggcatgctgctttaatgctgctagtttgtcttcaaggaatagcaggactaaaataattggaaaggaggaaaaacaggaatacagaatgaccaacatgagaaaaggcacagaattggagatgtgtgtggtatatttgttcaccacttaatacatcagtttgactggttatgagtttagataggaaagcagaggggtgaaaaaaaacaaatagaagctgaattatagagatgtaggtggctgaaac

SEQ ID NO: 145359 - DNA, 601 bp, Human
tatgaaacctggatagagtggagccatcaggcctctaaaaagtaaatattagcaggtagtttagtgaagatgagtatacagagtatctccaaacctgtgatgagtttaccattattttctctctactgtcccctgtcctggagtaataattagaaaaacattagtagaataaatccaaagcaaggtgaagaaataaaacaataaagataagaacataaatcaatgcatttcaaaacaaattttacagaaatcaatagaattaaaagcttgtttttttgaacagacctaaatattgataaaygtctaccaacactgacaaaggaaaaaaaaaaagcagaaaaaatgataaatattaagaacaaaagaggagatgttacacaccccgcaaacataaaaagcagaataagaaaacactataaacaaatctactgacataagttttataatttcaatgaaattaggcaatttagaataaacggatcaatttttcaaaaagtgtaactctcaaaactcactcaatatgaaatagataacctaaataatcccataactattaaattataattttagttaaaaactttctgaaaatggaaatatccaa

SEQ ID NO: 145360 - DNA, 601 bp, Human
gccatcaggcctctaaaaagtaaatattagcaggtagtttagtgaagatgagtatacagagtatctccaaacctgtgatgagtttaccattattttctctctactgtcccctgtcctggagtaataattagaaaaacattagtagaataaatccaaagcaaggtgaagaaataaaacaataaagataagaacataaatcaatgcatttcaaaacaaattttacagaaatcaatagaattaaaagcttgtttttttgaacagacctaaatattgataaacgtctaccaacactgacaaaggaaaaaaaaaaagcagaaaaaatgataaatattaagaacaaaagaggagatgttacacaccccgcaaacataaaaagcagaataagaaaacactataaacaaatctactgacataagttttataatttcaatgaaattaggcaatttagaataaacggatcaatttttcaaaaagtgtaactctcaaaactcactcaatatgaaatagataacctaaataatcccataactattaaattataattttagttaaaaactttctgaaaatggaaatatccaagcacagatagcttcactgacaa

SEQ ID NO: 145361 - DNA, 601 bp, Human
ggcctaaagccaaataggagggaaagttagatttttctcattcttttcttataagcactcgttttcttatttgtataccaagttcattatccaaataatctagtaagttgatggtcaactaaataccctaataagtactatgctcatagatgcaacttgagacataagaaaaagaactggacattacacattttaatctaaatcaactttgacttaatgttttcgataataccccttactcttttatttttacataaatgcaaatgtaattcatgcaaataataataaaataatgacatawttatgatgctaagaaatataatgttaaaaataacaaaactccctctcgtgtcaaattgtatttctctgcttcaaaggtaaacactcttagcagtttcctaaatatcattatagtaaaaaaaacttacaaatacctacaagtagattttagttttgcttaataatatatattgacagttataagaacttaaagcacgagaacctgctatcattgtctaattttgaatcgtatgttcgaatgagtttttattcaagatatttattttagtggaaggagagcatttgaaactgatgtagaggg

SEQ ID NO: 145362 - DNA, 601 bp, Human
ttctcactttttgggcatttcagcttgtgttcctcaattcaccgtgtgtgtgtgtgtgtgtgtgtgtgtgtgtgtgtcattttggtatcagtcatgttagattacaaatcaacaactttctaaaactttttgtatcaagtcataaatgcctctgacatcggagttggtaggaggcagaggcataggcctgcgtgctattgtgaaatgtacaggaacttactcaaaacagtatccttcaacaactccagcttaattttttagtgagtaccttctcaaattcatacattctaaaataaaagayttttttacataaaaatctaccagatggaatctgaaaatcaaactgttttattactgtctcttctataattgcatgtaatacattttctgcagtctaatatgagcttgctgttttgtgctgtttgagacagatttcatcttgctgtttcactagagtaccgttaattttttcatgctatcattgaataaatctttttgacagtttggaagagagaaaaatagataaaagcacactgcatgaaactctgatcctgatttttcttcttttcctttatatttttattaacagctattaatttaa

SEQ ID NO: 145363 - DNA, 601 bp, Human
ggctaaaaacactttaaagaaaaaaaattctatgaatgactaagacattcgattatttattcagtagatttttttaataaaggagaagaatttcaactgttttgtttaaaaatatggtttcaatattaaatattgcactcctattcttaaaatattacagctaaattctttctgttcctcggcatacacaaaaataaaacctgtttcttgcacaataaggctgccactgaatttactatattaagttttgggtgtttctgtacttggacttccagggcccagtaattgaagtcttctagcrttccttccagctctttgctcttctgacacaattgggattagttagaccagcccagcttcataaactcagatttaataaggtgtttgtagaaacttgctgtttactgcatgggattcggtctcctccagtatgtctatgatggtcagcttgacagttagctgtcatgcatcttttcacttttcttccctgatctcccaagtactaaactatatttggccaccagtaactgtggctattcatgatttttttccaacagaaaaatgctttcttgtttttgcaaatgatagtgaacatcactga

SEQ ID NO: 145364 - DNA, 601 bp, Human
ttttgtttaaaaatatggtttcaatattaaatattgcactcctattcttaaaatattacagctaaattctttctgttcctcggcatacacaaaaataaaacctgtttcttgcacaataaggctgccactgaatttactatattaagttttgggtgtttctgtacttggacttccagggcccagtaattgaagtcttctagcattccttccagctctttgctcttctgacacaattgggattagttagaccagcccagcttcataaactcagatttaataaggtgtttgtagaaacttgctstttactgcatgggattcggtctcctccagtatgtctatgatggtcagcttgacagttagctgtcatgcatcttttcacttttcttccctgatctcccaagtactaaactatatttggccaccagtaactgtggctattcatgatttttttccaacagaaaaatgctttcttgtttttgcaaatgatagtgaacatcactgaaggaaaaatacgttaaattgtggagaaaaaaagtggcagcactatgtaaaaaaatggatccccatcataatctataatgatagaacataattggcatag

SEQ ID NO: 145365 - DNA, 601 bp, Human
ttttcacttttcttccctgatctcccaagtactaaactatatttggccaccagtaactgtggctattcatgatttttttccaacagaaaaatgctttcttgtttttgcaaatgatagtgaacatcactgaaggaaaaatacgttaaattgtggagaaaaaaagtggcagcactatgtaaaaaaatggatccccatcataatctataatgatagaacataattggcatagcagccctagagataataatgtgcagactactgttggctaatttatagtagcagatgtgttcctctttcaaasaagcatgagcataataaaaaatgaattgcatttcataagctcgtactatgtgctagacatcagcctaagtgctttacaagctttatctaatttaatgctcataagagatttcctaggcaagtattactatgcccacattttatataagaaaactacaacttagaggaaatacacaaaaagttacagaatgaacaagtgtcagagtccggacccaaacacagggaagcctgcctcctaaatgttctttataaggtatttttccatatatgtttccccacgtgaaagacctctctgtttcta

SEQ ID NO: 145366 - DNA, 601 bp, Human
accagacagtggtggtactcctgcatttttcctatcactttcctttttaagacataaattattttacgtctctgcttgaaacatttcagatgcacttacatggaatctaaatgtttctcatggtccacaaagcaaggcatgtttggccacctgcttacctctctaaggtatcaggctgtctgatccttctctcaaccagtaggaggacccacaatgcgtttcttcccattattttcaagtgtgctaccctgctcctgaaacagtcttcctgcatttcttcacctgtcaagtttagattatytttaatgcctcagcttcagtgttatctcctcaggaggagtgtcctaagcaccattattctccatcatagtatttgtttcttttgtagtacttatttgtaactatatgtgtttgttttctttgctcaaatataaaaccttttgaatgtagtgatcttcgtctctctgtcttcttaaccagtatattattggggcctgtcaaaggcacatatagagacaatatttttaatccataaatattatttattgcactctactgaaaattttgcaaccttttccacatattttaatcccttcaagaa

SEQ ID NO: 145367 - DNA, 601 bp, Human
attgtgatttttgctattaccttaattgcaaaaaccacagttacttttgcatcaacctagtacatatatgcccttttggtgaagctggttgaaaacattcaaatgaagtaaacaggagcaaaaagaaagagagcagggatatctgtgccaatgcagcatgagaaggtggccagaaaagctcagaaatgtatcagtttctgaactgtaggccatccataaagtgtaaagcttatgagaagagcagtgcagtagggtccagtgggaaagaaaaggaaaaagtgccacaaaaaaacaattgttktcacaactatttccacagatcaccaatacagtttttcatcagtcacattcctgttgatgataacacagatagccaacagacatttaagaaagcatgtatttttattgaagatgaattcattttatttaaaactaaataagtgctcagctttttggtttttgaaagtacactgaggtgggggatggagtatgccttacccctggttactgcatttaagtacactgcagttaaggacgttgatgtccttcatggttttatatttttattttcaaaagtgttcctaatgccaaagtaaaaagt

SEQ ID NO: 145368 - DNA, 601 bp, Human
aagagcagtgcagtagggtccagtgggaaagaaaaggaaaaagtgccacaaaaaaacaattgttgtcacaactatttccacagatcaccaatacagtttttcatcagtcacattcctgttgatgataacacagatagccaacagacatttaagaaagcatgtatttttattgaagatgaattcattttatttaaaactaaataagtgctcagctttttggtttttgaaagtacactgaggtgggggatggagtatgccttacccctggttactgcatttaagtacactgcagttaaggacrttgatgtccttcatggttttatatttttattttcaaaagtgttcctaatgccaaagtaaaaagtttacaagatactttaaaaatatttcacgcctgcttttaaaaatatgatgacaataatgtgccctaaacgataatccatataatgtacgttatgggctattcagactttccagaaaaaaatcgtaagctgatgcaatataaattgttaaaaggtatttgtagatgaataaaggtaattcattactttacatatttttaaattccaaaattcaacaatactctttttatttcattgta

SEQ ID NO: 145369 - DNA, 601 bp, Human; identical to SEQ ID NO: 28821

SEQ ID NO: 145370 - DNA, 601 bp, Human; identical to SEQ ID NO: 28822

SEQ ID NO: 145371 - DNA, 601 bp, Human; identical to SEQ ID NO: 28823

SEQ ID NO: 145372 - DNA, 601 bp, Human; identical to SEQ ID NO: 28824

SEQ ID NO: 145373 - DNA, 601 bp, Human; identical to SEQ ID NO: 28825

SEQ ID NO: 145374 - DNA, 601 bp, Human; identical to SEQ ID NO: 28826

SEQ ID NO: 145375 - DNA, 601 bp, Human
attttatgttcaagaggattttctgtgtttttcaaaaagagcaatcagcaaaagtatgtcacttaaccatgtaattgaagctattggaatatgcattttttttttcttgagacatgatctcgctctgttgcccaggccaaagtgcagtggtacaaacacggctcactgcagcttcaacctcctgggctcaagcaatcctcctgcctttgccctccacagtagctgagaccacaggcacgtacaccgcacccagctgatttttaaattttttgtagagacagggtttcaccatgttgcccargctagtctctaattcctgggctcaagcaatcttcttgcctcagcctcccaaagtgctaggatgacaggcctgagccacccaggcacggccagaatattctttcctgaacactctgctctgctcctttgctgaccgcaatctcagagtagctgtcagagaacacaggcagcgtttgcttttgtatatttgtttgtcccaccttgtgctgttctcctccctgtggaaggcacaggggattcaaatgtccaagaaggcgtgggttcctctcctgaaggagctggcaatctgggagagttttgc

SEQ ID NO: 145376 - DNA, 601 bp, Human
agacatgatctcgctctgttgcccaggccaaagtgcagtggtacaaacacggctcactgcagcttcaacctcctgggctcaagcaatcctcctgcctttgccctccacagtagctgagaccacaggcacgtacaccgcacccagctgatttttaaattttttgtagagacagggtttcaccatgttgcccaggctagtctctaattcctgggctcaagcaatcttcttgcctcagcctcccaaagtgctaggatgacaggcctgagccacccaggcacggccagaatattctttcctgaasactctgctctgctcctttgctgaccgcaatctcagagtagctgtcagagaacacaggcagcgtttgcttttgtatatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcatataaaaccaaagcactgaactaccttttcccccacagctgtaccttccttggaaagagagtagaacatcatgggacagaga

SEQ ID NO: 145377 - DNA, 601 bp, Human
gggctcaagcaatcctcctgcctttgccctccacagtagctgagaccacaggcacgtacaccgcacccagctgatttttaaattttttgtagagacagggtttcaccatgttgcccaggctagtctctaattcctgggctcaagcaatcttcttgcctcagcctcccaaagtgctaggatgacaggcctgagccacccaggcacggccagaatattctttcctgaacactctgctctgctcctttgctgaccgcaatctcagagtagctgtcagagaacacaggcagcgtttgcttttgtwtatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcatataaaaccaaagcactgaactaccttttcccccacagctgtaccttccttggaaagagagtagaacatcatgggacagagaaatccgatgtggtttgcagttcttctctgccagctagaaaaccaccaaatggtatgtttaaaaagagcctgttg

SEQ ID NO: 145378 - DNA, 601 bp, Human
caatcttcttgcctcagcctcccaaagtgctaggatgacaggcctgagccacccaggcacggccagaatattctttcctgaacactctgctctgctcctttgctgaccgcaatctcagagtagctgtcagagaacacaggcagcgtttgcttttgtatatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcwtataaaaccaaagcactgaactaccttttcccccacagctgtaccttccttggaaagagagtagaacatcatgggacagagaaatccgatgtggtttgcagttcttctctgccagctagaaaaccaccaaatggtatgtttaaaaagagcctgttggttgatagatgtgccccagggtggtcagctggtttagatccctcccagatggcacatggatttgcgggcgtcctctccccctttatttcatcccgtgcatggtcagctgaatatttcattctcatcagtattttaattccaggt

SEQ ID NO: 145379 - DNA, 601 bp, Human
caaagtgctaggatgacaggcctgagccacccaggcacggccagaatattctttcctgaacactctgctctgctcctttgctgaccgcaatctcagagtagctgtcagagaacacaggcagcgtttgcttttgtatatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcatataaaaccaaagcactgaacyaccttttcccccacagctgtaccttccttggaaagagagtagaacatcatgggacagagaaatccgatgtggtttgcagttcttctctgccagctagaaaaccaccaaatggtatgtttaaaaagagcctgttggttgatagatgtgccccagggtggtcagctggtttagatccctcccagatggcacatggatttgcgggcgtcctctccccctttatttcatcccgtgcatggtcagctgaatatttcattctcatcagtattttaattccaggtatgttgtttccttgataatttt

SEQ ID NO: 145380 - DNA, 601 bp, Human; identical to SEQ ID NO: 28827

SEQ ID NO: 145381 - DNA, 601 bp, Human; identical to SEQ ID NO: 28828

SEQ ID NO: 145382 - DNA, 601 bp, Human; identical to SEQ ID NO: 28829

SEQ ID NO: 145383 - DNA, 601 bp, Human; identical to SEQ ID NO: 28830

SEQ ID NO: 145384 - DNA, 601 bp, Human; identical to SEQ ID NO: 28831

SEQ ID NO: 145385 - DNA, 601 bp, Human; identical to SEQ ID NO: 28832

SEQ ID NO: 145386 - DNA, 601 bp, Human; identical to SEQ ID NO: 28833

SEQ ID NO: 145387 - DNA, 601 bp, Human; identical to SEQ ID NO: 28834

SEQ ID NO: 145388 - DNA, 601 bp, Human; identical to SEQ ID NO: 28835

SEQ ID NO: 145389 - DNA, 601 bp, Human
tctgtactaaaaatacaaaattagccagacatggtggcacatgcctgtaattccagctacttgagaggctgaggtaggaggatcacctgaacctaggaggcagaggttgcagtgagccaagatcatgccattgcactccagcctggacaacaagagcaaaacctcctctcaaaaaaaaaaaaaaaaaaaaaaagaaccttcgattatgaaaataagttatattgaataaaatttgggtgcttattcttagaatagacggtcaagtcttatcctgtttcttgggaataattttcccacacaratttgttagtgtctttaaacatcacgtcatgtttaacttgtagactacaaagctaaaaatgtgtaatttttacgaaaggattcaaggcatcattagatttcctaagaatatctcttaaatctttcctttaatattcaagtcattctcttttgacttgaatattaaaaacctgctgtttcaccatccttttccattttcagttgctctcttatttatttatttatttacttatttattttttagacagagtctcgctatgttgcctaggctggagtgtagtggcacgatctcgactcactg

SEQ ID NO: 145390 - DNA, 601 bp, Human
caagatcatgccattgcactccagcctggacaacaagagcaaaacctcctctcaaaaaaaaaaaaaaaaaaaaaaagaaccttcgattatgaaaataagttatattgaataaaatttgggtgcttattcttagaatagacggtcaagtcttatcctgtttcttgggaataattttcccacacaaatttgttagtgtctttaaacatcacgtcatgtttaacttgtagactacaaagctaaaaatgtgtaatttttacgaaaggattcaaggcatcattagatttcctaagaatatctcttaaatctttcctttaatattcaagtcattctcttttgacttgaatattaaaaacctgctgtttcaccatccttttccattttcagttgctctcttatttatttatttatttacttatttattttttagacagagtctcgctatgttgcctaggctggagtgtagtggcacgatctcgactcactgcagcctccgcctcccaggttcaagtgattctcctgcctcagcctcccaagtagctgggattacaggcatttgccaccacgcccagctaatttttgtatttttagtagaaatggggtt

SEQ ID NO: 145391 - DNA, 601 bp, Human
caaagctaaaaatgtgtaatttttacgaaaggattcaaggcatcattagatttcctaagaatatctcttaaatctttcctttaatattcaagtcattctcttttgacttgaatattaaaaacctgctgtttcaccatccttttccattttcagttgctctcttatttatttatttatttacttatttattttttagacagagtctcgctatgttgcctaggctggagtgtagtggcacgatctcgactcactgcagcctccgcctcccaggttcaagtgattctcctgcctcagcctcccragtagctgggattacaggcatttgccaccacgcccagctaatttttgtatttttagtagaaatggggtttgaccatgttggccaggctggtctcgatctcctggcctcaggtgatccactggcctctgccttccaaagtgctgggattacaggcgtgagccaccacgcctggcccagttggttgcttatttatagggcccacctttgccttgctgtgatttgatcagttttcccacgtcacactcttggacttcaagagaccctgcatatctagctacttctctaaccattacattgcca

SEQ ID NO: 145392 - DNA, 601 bp, Human
cctcccaaagtgctgggattacatgcatgagccaccgcacccagccaagtggtgaccatttcttaaagagtctgttcattgttgaatgcctttatttagtgcagcttcacctccttaacaacatcattactagggatttggataatgcatgttcagatgatgaaggtcgcttgtaggcacgtttatgtgagataaacagacttcctgatgttttgttctttaggtttttctttttgatactattttactgccatatgggcctaccatttagtgaactggatgtcatgactgttagctcttyatcctttcatccatacatgtttattgatcatcagggactggactgacactggggtctcaatatcgagcaacacagacacagccagtgccctcctggaggaagcatcttagtgggcagggtaggcgttaagcccacagagggaagctgagtatgcaagagaaggtgctgagcaccaagtggcagatgacagaaggtcagcccatccctggggccagccagggtctcccagaggaggaaatgggtgagttaagatctgaaagacaagtcagaattcactagacaaggggcatcaggagaacc

SEQ ID NO: 145393 - DNA, 601 bp, Human
gcttgctgtgtttgcctcacttttatagtacattcaacctagttcactggaaaaaccagtctcctagacatgttttctttgttcttctatgatgtctaacttagtccctcatagccaaagaaaacttgttaagagaatgagaatgtctatagtcatagcagcacctctgacagcccccaaatgtgcccagaggaagtcactgaaacgttagaggatcatgttttgctttgcatagaacaggaagttctgtttttgatgggagtaagatggcttcatagcctttattttttattttttattwttttattttattttttggtttttttgagacagagtttcgctctgttgcctaggttggagtgcagtggcacaatctcagctcactgcagcctccgcctgccaggttcaagcaattctcctgcttcagcctcccaagtagctgggattacaggacattgccaccatgcccggctaatttttgtatttttagtagagatgtggtttcaccatgttggccaggctagtcatgaactcctgacctcaagtgatccacctgccttggcctcccaaagtgctggcattacaggtgtgagccaccgcg

SEQ ID NO: 145394 - DNA, 601 bp, Human
tttttttattttattttttggtttttttgagacagagtttcgctctgttgcctaggttggagtgcagtggcacaatctcagctcactgcagcctccgcctgccaggttcaagcaattctcctgcttcagcctcccaagtagctgggattacaggacattgccaccatgcccggctaatttttgtatttttagtagagatgtggtttcaccatgttggccaggctagtcatgaactcctgacctcaagtgatccacctgccttggcctcccaaagtgctggcattacaggtgtgagccaccrcgcctggcccttcatagcctttaaatcagttgatttacttttaaatgctttcactcccaggagtgctcactgaaagacttgcggtggactctgttgaaagataatattgaactgacctagtggtcataatactgagcctgatagagaaataaaaatctagaatgattgcacttatatgtgtagtgttccccaaaagtcaaatatacagagatatagaataaaacaatggttagcagggacagggggaaagaaaatggggagatgtgggtcggaggatacaaagtagcagatgtgcaggat

SEQ ID NO: 145395 - DNA, 601 bp, Human; identical to SEQ ID NO: 28836

SEQ ID NO: 145396 - DNA, 601 bp, Human; identical to SEQ ID NO: 28837

SEQ ID NO: 145397 - DNA, 601 bp, Human
tctgagaattaactgtcatttgaagggtcagggatctctttgagaatcttccgaaagctacagacactccctccagaaaaacgaatatatggatatatactatttaaggggcttcacagaatcctccaactcatatttttaaaaggcccattcataggccgcccctctccagagatgctttttcttctctgcttctttatttagactgcaagtggtgctagcagccggtcttcgaattgttttataaatctgaggtagctagatctgtgccttaaacacagagactgttttgcctcgtggkaatgatggttcctggctttaatctgttcctcaagcttgtggttttgctgcagctacatagatttactgatgtataaattcagtaatagcagttctcagtcaaacagaaaggaggagatatgtttggggatatttttcaaagaactggtatgttttcttctcagaagatctcagaattgttcttattttttaagattgtaaggaatctccatgactgggctttgctgttcgtttgcattgttctatttcttttcttttcttttcttttctttttttttttgagaccaagtctcactctgtc

SEQ ID NO: 145398 - DNA, 601 bp, Human
ccttaaacacagagactgttttgcctcgtggtaatgatggttcctggctttaatctgttcctcaagcttgtggttttgctgcagctacatagatttactgatgtataaattcagtaatagcagttctcagtcaaacagaaaggaggagatatgtttggggatatttttcaaagaactggtatgttttcttctcagaagatctcagaattgttcttattttttaagattgtaaggaatctccatgactgggctttgctgttcgtttgcattgttctatttcttttcttttcttttcttttctttttttttttgagaccaagtctcactctgtcgcccaggctggagtgcagtggcgcgatctcggctcattgcaacctccacctctcgggttcaagcagttctcctgcctcagcctcccgagtggctgggactataggcgcatgccaccacaccatgctaatttttgtgttttcagtaaagatggggtttttccatgttggccaggctggtctcaaacgcctgacctcaggtgatccacctgcctcagtctcccaaagtgctgggattgcaggcgtgagccactgcacctggcctgttctat

SEQ ID NO: 145399 - DNA, 601 bp, Human
tcaaagaactggtatgttttcttctcagaagatctcagaattgttcttattttttaagattgtaaggaatctccatgactgggctttgctgttcgtttgcattgttctatttcttttcttttcttttcttttctttttttttttgagaccaagtctcactctgtcgcccaggctggagtgcagtggcgcgatctcggctcattgcaacctccacctctcgggttcaagcagttctcctgcctcagcctcccgagtggctgggactataggcgcatgccaccacaccatgctaatttttgtrttttcagtaaagatggggtttttccatgttggccaggctggtctcaaacgcctgacctcaggtgatccacctgcctcagtctcccaaagtgctgggattgcaggcgtgagccactgcacctggcctgttctatttcttttctctcagtttattgtcttccccttggttgtggagacagacaggaccctgggctgtggggagcgagaaagctgacgttctgtctctggcagcagccaggtcctggccacactgtcaggggcagaccggtttttcagtgggtgacaccaggaagatgatgtt

SEQ ID NO: 145400 - DNA, 601 bp, Human
ctgtgctattctctccacaattacttctccatgaacaggccttatggtttctggtcaaaatagtactttctcattcttgctttttcatgtagttttttaaaaagtcacaatttacgttctataaaatgcgtgaaagaggctggagcttcggtgagcagtcctacagaggccttatcccatggtcccctcaaagcccctgtgctctcaggactgtgctgatgtgacatttgtttaagggttttttggatttttatatgagaggattttttgtttgtttttacttacaatcacatcaaatagtttctggagaaatgacagtgactggggacttttcctttagggaagagtatctcctgtcccagcatctttgtgaggagaatgatgatttttcagacagctccacaagtgtagacaactttaaaaatcatgatacccagtgctgttaaggctatgttagccatgttataagtcctaagaagcaaggagaatgattagcaaagatcagtgaagggggaagcatacttctggttatgtcttaaataaccatgccttaatttaggtctgaagttacgcctaatcctgatgacgtgatggttgcctt

SEQ ID NO: 145401 - DNA, 601 bp, Human
ttcatgtagttttttaaaaagtcacaatttacgttctataaaatgcgtgaaagaggctggagcttcggtgagcagtcctacagaggccttatcccatggtcccctcaaagcccctgtgctctcaggactgtgctgatgtgacatttgtttaagggttttttggatttttatatgagaggattttttgtttgtttttacttacaatcacatcaaatagtttctggagaaatgacagtgactggggacttttcctttagggaagagtatctcctgtcccagcatctttgtgaggagaatgatkatttttcagacagctccacaagtgtagacaactttaaaaatcatgatacccagtgctgttaaggctatgttagccatgttataagtcctaagaagcaaggagaatgattagcaaagatcagtgaagggggaagcatacttctggttatgtcttaaataaccatgccttaatttaggtctgaagttacgcctaatcctgatgacgtgatggttgccttggttacaagccctctcacctggagattggcgcattctcactgtgcccctagagagttatttcatgcgaaagaaaccataactg

SEQ ID NO: 145402 - DNA, 601 bp, Human
aagatcagtgaagggggaagcatacttctggttatgtcttaaataaccatgccttaatttaggtctgaagttacgcctaatcctgatgacgtgatggttgccttggttacaagccctctcacctggagattggcgcattctcactgtgcccctagagagttatttcatgcgaaagaaaccataactgcttatgattaatgtgtctgttgttggctggtggcttggttttggctcctgaagccactcgttagtctatcacttctgagctggagaaagttggggtggtctttttttttttttatcttttaaaaatcattttgctttttaattatttcaacttttatcttagattcagggtacatgtgcaggtttgtacctgggtatattgtatgatgctgagttttggggtatgactgatctcgtcatccaggcagtgagcacagtatcttcaatccttgtttctctccctctctcccctgcctagttagaagtgcccagtgtctattgttgccttctttatgtccatgaatacccagtgtttagcttccacttataagtgagaacacgcagtgtttggttttctgtttctgtactaatttac

SEQ ID NO: 145403 - DNA, 528 bp, Human
tgggagccggaacacgggacagggaagacctgcctgacccctcatcctcctctgtcctcagtctccgtccctggtcccactctctcttgaaatgactgtggttgatcatccatttccattctgaggagtacagaagattttcctatccaaacttacctcccctcctttcttcccctccagcagcggacagccttctatctctttcttcacactcttgttagaatgccrttcaccaccttgcatttcactttcagctaaatctcgtaagggcagatactggttcattggccctgaatcttgaagttaatatagatatttcataatttggttatctggtgataatattcagctttcattgctgtaaaacatcaatgcactatttcaaaatatacaaaaaatgtggtcactgtgtgtactctgcttcatttcgtcctgtctcccttctttctgcactgatagggctcattttggaaggctttggtctgtaagactttctaagtaattttcaagcatgattcagaatggaac

SEQ ID NO: 145404 - DNA, 601 bp, Human
gattaagcaagaccctttctcaaagaaacaaaaacaaatgtctgattatgaagcttgtaccctaacccactgcactgtctgggattacaggtgtgaccctctgcaccctgccaactaatccatcttaactgttggaaacacttcccaaattcccatatttaataaaaatccccatgtcattctggctttcaaatcatacttttgggtagccttcaaatttcatcagtcatattgtgttcagggacctgtaagattggttcgatagcctgaaggttacagttttgtcagtgatattatagaygttagtcactgggtgctgagtgttttgtgtgtattatcttcttattcctcacagaaattctatgggacaagttcctcgcccaggatcatacagctagtaagcgacaaagccatggttcaagtatctgattgcaggccagggcacagtggctcccacctgtaaccccagcactttgggaagccaaggtgggaggatctcttgaacccaggagttcaggaccagcctgggcaacatagacctcttctctacaaaaatttaaaaaaaattagccagatgtggtagcatgtacctgtagtccca

SEQ ID NO: 145405 - DNA, 601 bp, Human
tccatctcctgaccttgagagtcgcccgcctcggcctcccaaagtgctgggattataggcgtgagccaccgtgcctggccagctcttttctttttaacactaaataatattccattgtgtggaggacatgggggatttgtttatcccttcatttactgaaggactcttggctgcttccaagttttggcaattatgactacagctgctgtaaacatctgtgtgcagatttttgtgtggacataagttttcaacttctttgggtaaataccaaagagtatgattgctggatcatatgataacygtatgttcagttttgtaagaagtcatcaaactgtcttccaaagcagctgtacccttttgcattcccactagccaagaataagagttcctgccacccacccccatgctcgccagcatttggtgttgtcagtgttctggatctgagccattctaataggtgtgtagtggtgtctcactgttgcataaattctcacttccctaatgacatatgatgtggagcatcttttcatatgcctgtttgccatctggatatctttggtgaggtgtctgttaaggccttgggtccattttttaatcgggt

SEQ ID NO: 145406 - DNA, 601 bp, Human
gggtaaataccaaagagtatgattgctggatcatatgataaccgtatgttcagttttgtaagaagtcatcaaactgtcttccaaagcagctgtacccttttgcattcccactagccaagaataagagttcctgccacccacccccatgctcgccagcatttggtgttgtcagtgttctggatctgagccattctaataggtgtgtagtggtgtctcactgttgcataaattctcacttccctaatgacatatgatgtggagcatcttttcatatgcctgtttgccatctggatatctttgrtgaggtgtctgttaaggccttgggtccattttttaatcgggttatttgttttcttattgttgagttttaagagttccttgtttattttgggaaatagtcctttgtcagatgtggcttttgcagatattttcttccagtctgcggcttgtttcttcattctcttaagcctcggatctttttaggccatcttgggtaagcctcatctgaaccatccctccccttttcatactcccttactagccaccagcaagggagaggtccctgctaactgcagaggtccccgttgagtttctaggcatt

SEQ ID NO: 145407 - DNA, 601 bp, Human
gcacccacctgattatacagctgccaacatggtgacctattgatgtcaccatcgcagatcagatgtgagctctctgatgtgaacaactaatctgttctgcaatacagaaagcaaatgttaaggaattcttacttttagcaaggacagttcaggactgaggtatctattagataaggatattaccaactaattctaagccttgatctactctcatgctacattcaactcacagcagacttgcgtgatgagaaatgagactgtggggtttaatgtagaattatatagatgagtgttgtaaccraagacaatcatatgattgaggacttcggcagagcaaacagaagttggttagatttccagagaaagtgccctttcagtctttaagacgcattgagatcctctaacaagacagggatggaaagataatactactcttcagtgtatttcatgaatctctgtgtccttgggagttccgtgagcacggatattactttctgggaggaggaatgccaccattgcacctgtgactgactctttgctatttccctagcattttcaaatctatcatcttgtttgacccttatgctatcctgctgaatat

SEQ ID NO: 145408 - DNA, 601 bp, Human
ttcatgtgctcatttgttcatttatttaacaaatgtgtattattaatatttgcttgctctacgcagttgcacactgccaggccagcacagcttgatacagattgggagagttaggtggtttgttccaaattctcaccactagtgagagccaagtctcaggacaagacccaagagcttctagactcctattctctgccccacatttctgcccctcctgaattcaggcagccattaatgcctccatccctctagctaccacttattcacctctgctcttcagagactgaaacaccacaatgayattgatgtcattagattgctttccggtgaatctggattatgacgtgccatggaaaaagaaggctgtttggcagttttcatccttgaacagtgtcagtcggtaaaggggaaaaaaaccaatcacagaaacctggcgtgctcacgtgcagagcacctgcaagctggtgtttgtgatgcagccaacctggcctggagagagggcttagtcaattctgtatggagagtgttgcttctgttactgttattattgtagtaggtactcaatctatctccactcaacccacagattaacccacacccg

SEQ ID NO: 145409 - DNA, 601 bp, Human
acggtagtgctagattagagcctcagtggggaaagttcccagagtaatgctcctaagagttgcccgcgccttcaggactggtgacataactgacatagcccagtggaaaatgaaaaattttccccttttgcaaaaattaataagaatttcatgatgacagcaaagcatttaacccagcgtggagctcttcagagcataagaccttgtgcggctgcacaggcccatggcgaccactctgctgccacttaagaattgccacgtattgtgtgattggcacatcagtataacttttttaaaaaargtttagtctctatcagtttactatatctcacaagagtcaccatgcatggatagacttgaccaatggttgtttttgtcattaattttaggtttgttaaagaaacacttgaagaataaacttgttttagaatctcctaaatctttctaggtaactgtcctttacatcttaacggtcaggaatttttttttttttttttttttgagagagtctcactctgtcgcccaggctggagtgcagtggcatgatctcggctcactgcaagctccgcctcctgggttcacgccattctcctgcctcagc

SEQ ID NO: 145410 - DNA, 601 bp, Human
ggtcaggaatttttttttttttttttttttgagagagtctcactctgtcgcccaggctggagtgcagtggcatgatctcggctcactgcaagctccgcctcctgggttcacgccattctcctgcctcagcctcccgagtagctgggactacaggcgcctgccaccacacccagctaattttttttatttttagtagagaccaggtttcaccgtgttaaccaggatggtctcgatctcctgacctcgtgatccacccgcctcggcctcccaaagtactgggattacaggcgtgagccactgygcccagccaatggtcaggaatttaaaggcctagtttttgcccttccacaagcctcacggccttccaaaaataatattctttttttttttttttgagatgggggtcactctgtcacccaggctggagtgcagtggcatgatcacagatcactggagcctcagcatctctgggctcaggtgatcctcccacctcagcctcccaagtagctgtgactacaagcgtgtgccaccacacccaactaacttttttgtatttttcatagaggcagggtttcaccatgttgcccaggctggtctccaa

SEQ ID NO: 145411 - DNA, 601 bp, Human
aatttttttttttttttttttttgagagagtctcactctgtcgcccaggctggagtgcagtggcatgatctcggctcactgcaagctccgcctcctgggttcacgccattctcctgcctcagcctcccgagtagctgggactacaggcgcctgccaccacacccagctaattttttttatttttagtagagaccaggtttcaccgtgttaaccaggatggtctcgatctcctgacctcgtgatccacccgcctcggcctcccaaagtactgggattacaggcgtgagccactgcgcccagycaatggtcaggaatttaaaggcctagtttttgcccttccacaagcctcacggccttccaaaaataatattctttttttttttttttgagatgggggtcactctgtcacccaggctggagtgcagtggcatgatcacagatcactggagcctcagcatctctgggctcaggtgatcctcccacctcagcctcccaagtagctgtgactacaagcgtgtgccaccacacccaactaacttttttgtatttttcatagaggcagggtttcaccatgttgcccaggctggtctccaactcctgg

SEQ ID NO: 145412 - DNA, 601 bp, Human
tggagtgcagtggcatgatctcggctcactgcaagctccgcctcctgggttcacgccattctcctgcctcagcctcccgagtagctgggactacaggcgcctgccaccacacccagctaattttttttatttttagtagagaccaggtttcaccgtgttaaccaggatggtctcgatctcctgacctcgtgatccacccgcctcggcctcccaaagtactgggattacaggcgtgagccactgcgcccagccaatggtcaggaatttaaaggcctagtttttgcccttccacaagcctcayggccttccaaaaataatattctttttttttttttttgagatgggggtcactctgtcacccaggctggagtgcagtggcatgatcacagatcactggagcctcagcatctctgggctcaggtgatcctcccacctcagcctcccaagtagctgtgactacaagcgtgtgccaccacacccaactaacttttttgtatttttcatagaggcagggtttcaccatgttgcccaggctggtctccaactcctgggcttaagcattcacccacttcggcctcccaaaatgccaggattacaggtg

SEQ ID NO: 145413 - DNA, 601 bp, Human
ccctcatgctaattgggggttcttagacaagtcctgccactgcccatcttgaaggacatcccacacaactgcccatgggagaaacagcatgaggcacagacctccttccaggactttggatttgttgctcatacttgaaatccttgtgtcttcatgggcttttccttgtgttttggtcttggcttctctagaggttacccagtgggtcaggggaaggctcctcaaaggaatttcctacatgcgtatcggtattttagtcaggccatccaaaacatgccttccaaattcgaggaaaatctcrtgtggagtggtaacaaaaacttcattttatttgtatgaattattactaagctgagtcacaatggagaagaaaaaggggtgaatcgtgaggagccattttgacattcctggcccctgatcaaatggaaggattctgtttgtgatgctgagtgttggggtgtttctagatctgcttggtttgtggcactttcctagaccaaagtctaggaaatttctgtctttaaaatggaagaatcgtaagagctagcaggttgcctaacatttgttggactttgtttgtttttcaaaaggcccgttgctg

SEQ ID NO: 145414 - DNA, 601 bp, Human
acatttgttggactttgtttgtttttcaaaaggcccgttgctgaaagactggccacatctagtcacccacaaagcaatgatgctagaaccccttagggacaaaacacccttcagagttcagaagggaaaagtgatttataggactttttttttctattttagttttgtgaatctgttttgtttccgggagtaattttaatgttaaggaagtggattaatctctactgaaagctgagcccacgtggccccatgatcctccagggctgagttgttagggaccatgaggaaccaaggcacccasggtgatggggcctcagatgtgagtccagagaggagagcagactgaggtctccttccttagctgtgcttgttctgtgttgaacacacacacacacacacacacacacacacaaatacacatacactctctctctcttttgtaacatctgaatcttgtctgtgattctgtaatcttggtgtgctctcttgccagtatcccagagtcccacctcacaagcaaatggtaaagcatgagtctgcccctaggcttgctcatttctcatctcttcctctcccctccttttctgttcctcctctcctc

SEQ ID NO: 145415 - DNA, 601 bp, Human
ctagaaccccttagggacaaaacacccttcagagttcagaagggaaaagtgatttataggactttttttttctattttagttttgtgaatctgttttgtttccgggagtaattttaatgttaaggaagtggattaatctctactgaaagctgagcccacgtggccccatgatcctccagggctgagttgttagggaccatgaggaaccaaggcacccacggtgatggggcctcagatgtgagtccagagaggagagcagactgaggtctccttccttagctgtgcttgttctgtgttgaaaacacacacacacacacacacacacacacaaatacacatacactctctctctcttttgtaacatctgaatcttgtctgtgattctgtaatcttggtgtgctctcttgccagtatcccagagtcccacctcacaagcaaatggtaaagcatgagtctgcccctaggcttgctcatttctcatctcttcctctcccctccttttctgttcctcctctcctcctcctcctcttcctctcctcctccttttcctcccctcctcctttcctgatcctcctctcctcctcctcctcttcccctcctt

SEQ ID NO: 145416 - DNA, 465 bp, Human
cctccagggctgagttgttagggaccatgaggaaccaaggcacccacggtgatggggcctcagatgtgagtccagagaggagagcagactgaggtctccttccttagctgtgcttgttctgtgttgaacacacacacacacacacacacacacacacaaatacacatacactctctctctcttttgtaacatctgaatcttgtctgtgattctgtaatcttggtgtgctctcttgccagtatcccagagtcccacctcacaagcaaatggtaaagcatgagtctgcccctaggcttgctcrtttctcatctcttcctctcccctccttttctgttcctcctctcctcctcctcctcttcctctcctcctccttttcctcccctcctcctttcctgatcctcctctcctcctcctcctcttcccctccttttcctcccctcctcctctcctcctcctcttcctacc

SEQ ID NO: 145417 - DNA, 601 bp, Human
ttccccatctctaaggttttgagattttggaggagtgaaggttattgagatagtcaccaatatttactgaaagcttataaattctgggcactccagcatttctgtatgctggacatacaaaaataagtaaatagccaggcgtggtggcacatgcctgtagtcccagctacttccaggcgctgaggtgggaggatcactcgacccctgacagtagaggctccaatgagccgtgatcacaccactgcactccagcctgggcaacagagaaagaccccatttcaaaaataaaaaataaaatacrtttttaaaaaatgacaagggcagacccagcccctgccttggagcttacagtctagaaaagaagacagaggcagagtgccatggctcacggctgaaatgccagcactttgggaggccaagacgggtggatcacctgaggccaggagttccagatcagcctggttaacatggtgaaaccccgtctccactaaaaatacaaaaagtagccgggtacggtggagtgggcctgtaatcccaactactcaagaggctgaggcaggagaatcgcttgaatccatgaggtggaggttgcagttagctg

SEQ ID NO: 145418 - DNA, 601 bp, Human
acaagatccacctgcctccaccttggcctcctaaagtgctgattataggctacagctaccacacccagcttactcatgcttgcttttaacatccaaagttacaactcatgataagctgctttcttccccatctctaaggttttgagattttggaggagtgaaggttattgagatagtcaccaatatttactgaaagcttataaattctgggcactccagcatttctgtatgctggacatacaaaaataagtaaatagccaggcgtggtggcacatgcctgtagtcccagctacttccaggsgctgaggtgggaggatcactcgacccctgacagtagaggctccaatgagccgtgatcacaccactgcactccagcctgggcaacagagaaagaccccatttcaaaaataaaaaataaaatacgtttttaaaaaatgacaagggcagacccagcccctgccttggagcttacagtctagaaaagaagacagaggcagagtgccatggctcacggctgaaatgccagcactttgggaggccaagacgggtggatcacctgaggccaggagttccagatcagcctggttaacatggtgaaacc

SEQ ID NO: 145419 - DNA, 601 bp, Human
tgttgcccaggctggtctgaacacctgttcccgtgctcacaagatccacctgcctccaccttggcctcctaaagtgctgattataggctacagctaccacacccagcttactcatgcttgcttttaacatccaaagttacaactcatgataagctgctttcttccccatctctaaggttttgagattttggaggagtgaaggttattgagatagtcaccaatatttactgaaagcttataaattctgggcactccagcatttctgtatgctggacatacaaaaataagtaaatagccaggygtggtggcacatgcctgtagtcccagctacttccaggcgctgaggtgggaggatcactcgacccctgacagtagaggctccaatgagccgtgatcacaccactgcactccagcctgggcaacagagaaagaccccatttcaaaaataaaaaataaaatacgtttttaaaaaatgacaagggcagacccagcccctgccttggagcttacagtctagaaaagaagacagaggcagagtgccatggctcacggctgaaatgccagcactttgggaggccaagacgggtggatcacctgaggc

SEQ ID NO: 145420 - DNA, 601 bp, Human
ccattaactcacaaatttttttttttttttttgagacagagtcttgctgtcacccaggctggagtgcagtggcagcccactgcagactttactatgggggttcaagtgtcctccccacctcagcttccagaggagctgggactacaggtgtgcaccatcactcccagctaattaaaaaggttttttttgtagagatgggggtttcgtcatgttgcccaggctggtctgaacacctgttcccgtgctcacaagatccacctgcctccaccttggcctcctaaagtgctgattataggctacrgctaccacacccagcttactcatgcttgcttttaacatccaaagttacaactcatgataagctgctttcttccccatctctaaggttttgagattttggaggagtgaaggttattgagatagtcaccaatatttactgaaagcttataaattctgggcactccagcatttctgtatgctggacatacaaaaataagtaaatagccaggcgtggtggcacatgcctgtagtcccagctacttccaggcgctgaggtgggaggatcactcgacccctgacagtagaggctccaatgagccgt

SEQ ID NO: 145421 - DNA, 601 bp, Human
gaattcttcccccatcttttaggtaattctaataccataagtccttttattcctataagtgctacatgatgttgtgttgggcttaacaagacttgatagatttcaaacaggggtggatttatgcaaagcaatctctgaaaattagagcaaaccagtcaacatagttaattttaatttaaatataggtggcagttacttgaaatcacagtaatacttagtttactacaattataggataataaaactctggataagtactcacacttgtaccattaactcacaaatttttttttttttttttgagacagagtcttgctgtcacccaggctggagtgcagtggcagcccactgcagactttactatgggggttcaagtgtcctccccacctcagcttccagaggagctgggactacaggtgtgcaccatcactcccagctaattaaaaaggttttttttgtagagatgggggtttcgtcatgttgcccaggctggtctgaacacctgttcccgtgctcacaagatccacctgcctccaccttggcctcctaaagtgctgattataggctacagctaccacacccagcttactcatgcttgctt

SEQ ID NO: 145422 - DNA, 601 bp, Human
attttctgtatatataataaattatacagataaatagtatacaacttacctacaattcactgttgattttccaccttcaaattcagaattcttcccccatcttttaggtaattctaataccataagtccttttattcctataagtgctacatgatgttgtgttgggcttaacaagacttgatagatttcaaacaggggtggatttatgcaaagcaatctctgaaaattagagcaaaccagtcaacatagttaattttaatttaaatataggtggcagttacttgaaatcacagtaatacttagtttactacaattataggataataaaactctggataagtactcacacttgtaccattaactcacaaatttttttttttttttttgagacagagtcttgctgtcacccaggctggagtgcagtggcagcccactgcagactttactatgggggttcaagtgtcctccccacctcagcttccagaggagctgggactacaggtgtgcaccatcactcccagctaattaaaaaggttttttttgtagagatgggggtttcgtcatgttgcccaggctggtctgaacacctgttcccgtgctc

SEQ ID NO: 145423 - DNA, 601 bp, Human
tagtatactaaacatgcttaagaaccactagtcttgaacaattttctgtatatataataaattatacagataaatagtatacaacttacctacaattcactgttgattttccaccttcaaattcagaattcttcccccatcttttaggtaattctaataccataagtccttttattcctataagtgctacatgatgttgtgttgggcttaacaagacttgatagatttcaaacaggggtggatttatgcaaagcaatctctgaaaattagagcaaaccagtcaacatagttaattttaatwtaaatataggtggcagttacttgaaatcacagtaatacttagtttactacaattataggataataaaactctggataagtactcacacttgtaccattaactcacaaatttttttttttttttttgagacagagtcttgctgtcacccaggctggagtgcagtggcagcccactgcagactttactatgggggttcaagtgtcctccccacctcagcttccagaggagctgggactacaggtgtgcaccatcactcccagctaattaaaaaggttttttttgtagagatgggggtttcgt

SEQ ID NO: 145424 - DNA, 601 bp, Human
gagcaagactccatctcaaaaaaaaaaaaaaaaaaaaaagtatatatatatatacacacatacacacacacacacacacataaaatacttacacttctggcaaacttctggctgacagataactggttttacaaaatcttacttctacctaatcgaaagaatggcctagcctcaaatgagacagcaacgtggtacttcaggcagaataaagtacaatcaattacacatatactatgaacattgataacacagaagccagtctgcagaccacgaggagtgttttaatgttttaagagtagtmtactaaacatgcttaagaaccactagtcttgaacaattttctgtatatataataaattatacagataaatagtatacaacttacctacaattcactgttgattttccaccttcaaattcagaattcttcccccatcttttaggtaattctaataccataagtccttttattcctataagtgctacatgatgttgtgttgggcttaacaagacttgatagatttcaaacaggggtggatttatgcaaagcaatctctgaaaattagagcaaaccagtcaacatagttaattttaatttaaa

SEQ ID NO: 145425 - DNA, 601 bp, Human
ctgggcatggtagcgcttgcctgtaatcccagttactcgggaggctgaggcagaagaatcgcttgaatccaggaggcggagcttgcagtgagccgagattgtgccactgcactccagcctgggtgacagagcaagactccatctcaaaaaaaaaaaaaaaaaaaaaagtatatatatatatacacacatacacacacacacacacacataaaatacttacacttctggcaaacttctggctgacagataactggttttacaaaatcttacttctacctaatcgaaagaatggcctagcctmaaatgagacagcaacgtggtacttcaggcagaataaagtacaatcaattacacatatactatgaacattgataacacagaagccagtctgcagaccacgaggagtgttttaatgttttaagagtagtatactaaacatgcttaagaaccactagtcttgaacaattttctgtatatataataaattatacagataaatagtatacaacttacctacaattcactgttgattttccaccttcaaattcagaattcttcccccatcttttaggtaattctaataccataagtccttttattc

SEQ ID NO: 145426 - DNA, 601 bp, Human
tcattttcttcctaatactttgatctatttttctcaattttctacagcaaatatacattacatgtatatcaagaaggcaaatcataaaaccatgctgtttttatatttaaaatttactgtagttattcaggaagattctagttcaatacaaagttaacaaatatggttaaaatgaaatcacaatttcatatagttgagagagcaaacatcaatgcaagatattatcttagtttctttatcacatagaaaggtgataaagaaatgaatggtggctcaggcctgtaattccagcactttggggaggctgagacgagcaggatcacttgagcctaggagttccagaccagcctggccaacacgacgaatccctgttctactaaaaatacacttacttctcacattaccaaaagcatgctagtcacctctgaaaaaccttgcaacctgttaaaattgcatttataatcccaataagctaattaaaaaaccatttcaagactcaaataaaaacttaccctttattgagtactagactttcctcttcggcttctgaaagtattatcacgttagtgggtgtctgcggctcacgtagtgagtaaattct

SEQ ID NO: 145427 - DNA, 601 bp, Human
tagttgatgaggcagacatttaaccagaattactataccatgtgataagtgcaacaacagaaggatttatggtgtacaaaggaatgacaaaaagatacaaagataatgaagaaagctataaaaaataaatgagaaaaatgagaaagaatgatttctgggaaggggattgttgagcattccaagctagagatcagtttatgcaaagtcctggaaacatgaaagacaaagaactaagaacaagaaaacttatttagtatgatgggaggcaaagtacaaggtggaaggcaacggcaaaatagcyagacagacatccaggactggcttatgaagtacacagtcttgtgtgctatgttaaactatttgaaatctatctgccgggtaacagtatatcactagaggtttaaatcaagcgatggagcctcactttacaaatcagtctggtattagggaggaagacatggaagggtccaaaatgggatttggggaaactatttaagaaaataagccaggcagatggtgaagtaggcagatgatgcagttctgaagcagggacagaggaatgcagagaagggtgtataatcaggggtgtccaatcttttgg

SEQ ID NO: 145428 - DNA, 601 bp, Human
attccacctctatcctaacagtgcactgttattctgaagacaaaacgtctctcttcctttaggaagatgtttgtgaaaaaagccaattcagtgattccaaggctctttgtatctgtccctgaagattgcaatatagagaccagaaagtaacatgcagactggtggaccaagtaagttgggcaaccttctaacttctttccacttagactgctaagtgtgcttcagctacttttttaactgtttaatttccaaaatatcagaagttccataagtaagttaaaattccttctcatatattaarcattcatattgggtcaggaactatgccaggtgttgaagatacaaacaaccacagcagcctgcacttaccgtgtggtcatcttcttcttccccttctagcacgacacagtgatacagcattcctgattcagtagcgatcactaagatattggggacacagggtaagcagagtacagcacacgcatcataaccatagttatcttcagccgcaggatgcatgggcaatggacccaacagctttccaatatttccagggctaaagaaggagtaaaaacatatttgggaaatgttgacagtatgc

SEQ ID NO: 145429 - DNA, 601 bp, Human
gtcaatcctggaatcccaggacttttctgactgtaaaaaaaagtgttgtaattttgatcttgcatgttaatttgaaaatgtacacaattaaaaacaggcaaaaagctgggtcagggccgggtgcggctgttcttgcctgtaatcccagcactttgggaggccgaggcaggtggatcatctgaggtcaggagttcgagaccagcctggccaacatactgaaaccctgtctctactaaaagtacaagaaatcagccgggcgtggtggtgggtgcctgtaatcccagctactggggaggctgaygcaagagaatcgcttgaactcaggaggcagaggttgcagtgagccgagatcacaccattgcactccagcctgggcaccaagagcgaaactctgtctccaaaaaataataataaaaaataaataaaaaaattgaaaaaaaagctgggtcaaacagtactttcaaattcttaattccacctctatcctaacagtgcactgttattctgaagacaaaacgtctctcttcctttaggaagatgtttgtgaaaaaagccaattcagtgattccaaggctctttgtatctgtccctgaagattgca

SEQ ID NO: 145430 - DNA, 601 bp, Human
agtttcaaagcaagctccaactcaacacattcaaacacatacagagaaggaatgaggtcaatcctggaatcccaggacttttctgactgtaaaaaaaagtgttgtaattttgatcttgcatgttaatttgaaaatgtacacaattaaaaacaggcaaaaagctgggtcagggccgggtgcggctgttcttgcctgtaatcccagcactttgggaggccgaggcaggtggatcatctgaggtcaggagttcgagaccagcctggccaacatactgaaaccctgtctctactaaaagtacaaraaatcagccgggcgtggtggtgggtgcctgtaatcccagctactggggaggctgacgcaagagaatcgcttgaactcaggaggcagaggttgcagtgagccgagatcacaccattgcactccagcctgggcaccaagagcgaaactctgtctccaaaaaataataataaaaaataaataaaaaaattgaaaaaaaagctgggtcaaacagtactttcaaattcttaattccacctctatcctaacagtgcactgttattctgaagacaaaacgtctctcttcctttaggaagatgtttgt

SEQ ID NO: 145431 - DNA, 601 bp, Human
gcgactacaggcgtgagccaccgcacccggccttttttttttttttttttttaaagcaaattatcccagaccctgattgagtcagttttggtagttttttttttttcttggaatttgtccattccatctagattatgtaaatggcatacatttgttcataatattcctttataatcttttatttctgtaaggtcaatagtaatatccctgcttttattcttgattatagttagtctagctaaaggcttgtgaaatgtggttgatcttttcaaagaacctttcggtttcactgattttctcyatcatttttctattccaaactacttttctgaaatctattaaatctatttttcctctgaaatctattaaaagtgcagagagttagtaaactcacctgatccaagaaatttgtgaagtttatgaatccaagttagcccaacactatgtacaccagcttcatgagtacagtgatatcttgaaggacacttgggatctgcaaatggaatgattaatgatacaaaggtagccagtggataactaaaaaaatttacctcaaatttgttggctactccacattagcctacaaacgcatttgttgatg

SEQ ID NO: 145432 - DNA, 601 bp, Human
ctacaggcgcccgccaccacgcccggagaatttatttttgtatttttagtagagatggggtttcaccatgttagccaggatggtctcaatctcctgattttgtgatccacccacctcggcctcccaaagtgctgcgactacaggcgtgagccaccgcacccggccttttttttttttttttttttaaagcaaattatcccagaccctgattgagtcagttttggtagttttttttttttcttggaatttgtccattccatctagattatgtaaatggcatacatttgttcataatattccyttataatcttttatttctgtaaggtcaatagtaatatccctgcttttattcttgattatagttagtctagctaaaggcttgtgaaatgtggttgatcttttcaaagaacctttcggtttcactgattttctctatcatttttctattccaaactacttttctgaaatctattaaatctatttttcctctgaaatctattaaaagtgcagagagttagtaaactcacctgatccaagaaatttgtgaagtttatgaatccaagttagcccaacactatgtacaccagcttcatgagtacag

SEQ ID NO: 145433 - DNA, 601 bp, Human
gcccgccttggcctcccaaagtgctgggattaaaggcatgagccactgcacccagccttttttttttttttttgagacggagtctcgctctgttgcccaggctggagtgcagtggcgtgatcttggctcactgcaagctccgcctcccaggttcacaccattctcctgcctcagtctcccgagtagctgggactacaggcgcccgccaccacgcccggagaatttatttttgtatttttagtagagatggggtttcaccatgttagccaggatggtctcaatctcctgattttgtgatccrcccacctcggcctcccaaagtgctgcgactacaggcgtgagccaccgcacccggccttttttttttttttttttttaaagcaaattatcccagaccctgattgagtcagttttggtagttttttttttttcttggaatttgtccattccatctagattatgtaaatggcatacatttgttcataatattcctttataatcttttatttctgtaaggtcaatagtaatatccctgcttttattcttgattatagttagtctagctaaaggcttgtgaaatgtggttgatcttttcaaagaa

SEQ ID NO: 145434 - DNA, 601 bp, Human
actaatctactttctgtctctgtacatttgtctattctggacatctcatataaacagccatacagttgtttgtaactggcttctttcacttagcatctgttcacagttcatccatattggagcatgtatcagtacttcattccttttcattgttgaataatactctgttgtatagacacaccacattttatctatccattcatcagcttatggacacttgggtatgtggcttctgggctatgatgaataatgctgctgtgaacactcatgtaccagtatttgtgtggatacaggtcttcayttctcttggaaatatactcaggactggactatcaggtacatggtaactctatgaataatcatttgaggaactgccagattgttttccaaagactgtaccattttacatttctataagcactgtataaaagtccccattttttcccacatcctcaacacttgttaatgtccatctttttcattttagctatactagtggatatgacgtgatacctcattgtggttttgtggtatcttatttccataatgactaataatgttgtacatctttttatatatatgctatttgcccaactgtatc

SEQ ID NO: 145435 - DNA, 601 bp, Human
acaaaaattagctggacgtggtggtgggcacctgtaatcccagctactcgagaggctgaggcaggtgaatcgcttgaacccaggaggtggaggttgtggtgagccaagatcatgccattgcaccccagcctgggcaacaaagagtgaaactccgtctaaaaaaaaaattgtatacctatcattaacaatttggaatattttcatttccccaaaagaaacccacataaccattagcaatcactcctcagtttctaccaaacttcccagacctaggcaactaatctactttctgtctctgtasatttgtctattctggacatctcatataaacagccatacagttgtttgtaactggcttctttcacttagcatctgttcacagttcatccatattggagcatgtatcagtacttcattccttttcattgttgaataatactctgttgtatagacacaccacattttatctatccattcatcagcttatggacacttgggtatgtggcttctgggctatgatgaataatgctgctgtgaacactcatgtaccagtatttgtgtggatacaggtcttcatttctcttggaaatatactcaggac

SEQ ID NO: 145436 - DNA, 601 bp, Human
cgaactcctgacctagtaattcgcctgcctcagcctcccaaagtgctgggattacaggcgtgagccaccacgcctggcctcacctagctaatttttaaatttttttgtaaagggtctcactatgttgcccaggctggtctcaaactcctggcctcaagtgatcctcctgcctcacctgacaaagtgctgggattataggtgtaagccaccatgcccagcctacatgggattttattatgtattttccttgttcacttttctttttttttttttttttttgagatggagtctcactctgtcrcccagactggagtgcagtggcatgatctcagctcactgcaacctgtgctgcccgggttcaagcaattctcctgcctcagcctcccgagtagctgggattgcaggtgtctgccaccatgcctggctaatttttgtagtttttagcagagatggggtttcaccatcttggccaggctggtcttgcactcctgaccgtgtgatccacccacctcgatctcccaaaatgctgggattataggcgtaagccacagtgcctggtttcactgttcacttttcaagctggtacagtttgctatccttc

SEQ ID NO: 145437 - DNA, 601 bp, Human
ttttttttgtttgagacggagtctcactctgttgcccaggctggagtgcagtgacatgatcttggctcactgcagcctccacctcccagggtcatacgattctcctgcctcagcctcctgagtagctgggattacaggtgcccgccactacacccagctaattttttttttgtattttagtagagacggggtttcaccacgttggccaggctggtctcgaactcctgacctagtaattcgcctgcctcagcctcccaaagtgctgggattacaggcgtgagccaccacgcctggcctcacytagctaatttttaaatttttttgtaaagggtctcactatgttgcccaggctggtctcaaactcctggcctcaagtgatcctcctgcctcacctgacaaagtgctgggattataggtgtaagccaccatgcccagcctacatgggattttattatgtattttccttgttcacttttctttttttttttttttttttgagatggagtctcactctgtcacccagactggagtgcagtggcatgatctcagctcactgcaacctgtgctgcccgggttcaagcaattctcctgcctcagcctc

SEQ ID NO: 145438 - DNA, 601 bp, Human
caggtacatgctaccacagtggctaatttttttttttgtttgagacggagtctcactctgttgcccaggctggagtgcagtgacatgatcttggctcactgcagcctccacctcccagggtcatacgattctcctgcctcagcctcctgagtagctgggattacaggtgcccgccactacacccagctaattttttttttgtattttagtagagacggggtttcaccacgttggccaggctggtctcgaactcctgacctagtaattcgcctgcctcagcctcccaaagtgctgggattayaggcgtgagccaccacgcctggcctcacctagctaatttttaaatttttttgtaaagggtctcactatgttgcccaggctggtctcaaactcctggcctcaagtgatcctcctgcctcacctgacaaagtgctgggattataggtgtaagccaccatgcccagcctacatgggattttattatgtattttccttgttcacttttctttttttttttttttttttgagatggagtctcactctgtcacccagactggagtgcagtggcatgatctcagctcactgcaacctgtgctgcccg

SEQ ID NO: 145439 - DNA, 601 bp, Human
gccgaggctggagtgcaatagtgcgatcacgactcactgcagccttgacctcgtgggctcaaacaatccttccttctcagcctcctgagtagctgggaccacaggtacatgctaccacagtggctaatttttttttttgtttgagacggagtctcactctgttgcccaggctggagtgcagtgacatgatcttggctcactgcagcctccacctcccagggtcatacgattctcctgcctcagcctcctgagtagctgggattacaggtgcccgccactacacccagctaattttttttttgtattttagtagagacggggtttcaccacgttggccaggctggtctcgaactcctgacctagtaattcgcctgcctcagcctcccaaagtgctgggattacaggcgtgagccaccacgcctggcctcacctagctaatttttaaatttttttgtaaagggtctcactatgttgcccaggctggtctcaaactcctggcctcaagtgatcctcctgcctcacctgacaaagtgctgggattataggtgtaagccaccatgcccagcctacatgggattttattatgtattttccttgttca

SEQ ID NO: 145440 - DNA, 601 bp, Human
aaagttacacgttacactgaagatctctccaacttgcacataagccccagctatctttgtttgcctagcccagtgctaacaaattaagtgcttagaaactgttgaatgaacagaactaccgagtctctctcaatgaggcccaatgtcaatgtcacaggaaatcacttggcacgcacagcgtgtatctctctcagtcttccttcccacttcagtgaagacactggaaactgagacctcagatgggaactgtcattctgccaacatgctctcctagcggctcccatgcccatcccacctgcaygcctacaacacacatctgcccccgaatgtggatgccgcctcctctcacaccttctgaaaattgtaccatcaactgtgtcgtttcaaaatctccctattatctacttcccctcagcttgcaaactcatgtctcttccatttaaaatactctcatttcaatataatgtccagttccccttaacctattctttctcgccatccctttagaaccagcagtctttaaacagcagttgaaaacactagttccccttccatagctcccatttacctttttggacaagacatggagacgatatctgga

SEQ ID NO: 145441 - DNA, 601 bp, Human
gtagcgtgctgctgactgtaatctcaaaagttacacgttacactgaagatctctccaacttgcacataagccccagctatctttgtttgcctagcccagtgctaacaaattaagtgcttagaaactgttgaatgaacagaactaccgagtctctctcaatgaggcccaatgtcaatgtcacaggaaatcacttggcacgcacagcgtgtatctctctcagtcttccttcccacttcagtgaagacactggaaactgagacctcagatgggaactgtcattctgccaacatgctctcctagyggctcccatgcccatcccacctgcatgcctacaacacacatctgcccccgaatgtggatgccgcctcctctcacaccttctgaaaattgtaccatcaactgtgtcgtttcaaaatctccctattatctacttcccctcagcttgcaaactcatgtctcttccatttaaaatactctcatttcaatataatgtccagttccccttaacctattctttctcgccatccctttagaaccagcagtctttaaacagcagttgaaaacactagttccccttccatagctcccatttacctttttg

SEQ ID NO: 145442 - DNA, 601 bp, Human
tatcagtaccataacctcaaaagtggtggcttggaaacctttaatgcagctccacactaaagtctagagcccatgtgactaagtcactcaggaatccctaactgtagcgtgctgctgactgtaatctcaaaagttacacgttacactgaagatctctccaacttgcacataagccccagctatctttgtttgcctagcccagtgctaacaaattaagtgcttagaaactgttgaatgaacagaactaccgagtctctctcaatgaggcccaatgtcaatgtcacaggaaatcacttggcaygcacagcgtgtatctctctcagtcttccttcccacttcagtgaagacactggaaactgagacctcagatgggaactgtcattctgccaacatgctctcctagcggctcccatgcccatcccacctgcatgcctacaacacacatctgcccccgaatgtggatgccgcctcctctcacaccttctgaaaattgtaccatcaactgtgtcgtttcaaaatctccctattatctacttcccctcagcttgcaaactcatgtctcttccatttaaaatactctcatttcaatataatgtccagt

SEQ ID NO: 145443 - DNA, 601 bp, Human
gcctgggctgaagttgcttgggacatcctatcagtaccataacctcaaaagtggtggcttggaaacctttaatgcagctccacactaaagtctagagcccatgtgactaagtcactcaggaatccctaactgtagcgtgctgctgactgtaatctcaaaagttacacgttacactgaagatctctccaacttgcacataagccccagctatctttgtttgcctagcccagtgctaacaaattaagtgcttagaaactgttgaatgaacagaactaccgagtctctctcaatgaggcccaaygtcaatgtcacaggaaatcacttggcacgcacagcgtgtatctctctcagtcttccttcccacttcagtgaagacactggaaactgagacctcagatgggaactgtcattctgccaacatgctctcctagcggctcccatgcccatcccacctgcatgcctacaacacacatctgcccccgaatgtggatgccgcctcctctcacaccttctgaaaattgtaccatcaactgtgtcgtttcaaaatctccctattatctacttcccctcagcttgcaaactcatgtctcttccatttaaa

SEQ ID NO: 145444 - DNA, 601 bp, Human
gttaaattacaaagcagcaaatgcaatggaaccaagagcaaagacatgacaggtccgcggccttctcaggcctgggctgaagttgcttgggacatcctatcagtaccataacctcaaaagtggtggcttggaaacctttaatgcagctccacactaaagtctagagcccatgtgactaagtcactcaggaatccctaactgtagcgtgctgctgactgtaatctcaaaagttacacgttacactgaagatctctccaacttgcacataagccccagctatctttgtttgcctagcccagttctaacaaattaagtgcttagaaactgttgaatgaacagaactaccgagtctctctcaatgaggcccaatgtcaatgtcacaggaaatcacttggcacgcacagcgtgtatctctctcagtcttccttcccacttcagtgaagacactggaaactgagacctcagatgggaactgtcattctgccaacatgctctcctagcggctcccatgcccatcccacctgcatgcctacaacacacatctgcccccgaatgtggatgccgcctcctctcacaccttctgaaaattgtaccatcaact

SEQ ID NO: 145445 - DNA, 601 bp, Human
ccaaaatcctcgaattggagctggctgcctggaaaaacacagtcatagttaaattacaaagcagcaaatgcaatggaaccaagagcaaagacatgacaggtccgcggccttctcaggcctgggctgaagttgcttgggacatcctatcagtaccataacctcaaaagtggtggcttggaaacctttaatgcagctccacactaaagtctagagcccatgtgactaagtcactcaggaatccctaactgtagcgtgctgctgactgtaatctcaaaagttacacgttacactgaagatctctccaacttgcacataagccccagctatctttgtttgcctagcccagtgctaacaaattaagtgcttagaaactgttgaatgaacagaactaccgagtctctctcaatgaggcccaatgtcaatgtcacaggaaatcacttggcacgcacagcgtgtatctctctcagtcttccttcccacttcagtgaagacactggaaactgagacctcagatgggaactgtcattctgccaacatgctctcctagcggctcccatgcccatcccacctgcatgcctacaacacacatctgcccccgaat

SEQ ID NO: 145446 - DNA, 601 bp, Human
atccaaaatcctcgaattggagctggctgcctggaaaaacacagtcatagttaaattacaaagcagcaaatgcaatggaaccaagagcaaagacatgacaggtccgcggccttctcaggcctgggctgaagttgcttgggacatcctatcagtaccataacctcaaaagtggtggcttggaaacctttaatgcagctccacactaaagtctagagcccatgtgactaagtcactcaggaatccctaactgtagcgtgctgctgactgtaatctcaaaagttacacgttacactgaagatcactccaacttgcacataagccccagctatctttgtttgcctagcccagtgctaacaaattaagtgcttagaaactgttgaatgaacagaactaccgagtctctctcaatgaggcccaatgtcaatgtcacaggaaatcacttggcacgcacagcgtgtatctctctcagtcttccttcccacttcagtgaagacactggaaactgagacctcagatgggaactgtcattctgccaacatgctctcctagcggctcccatgcccatcccacctgcatgcctacaacacacatctgcccccga

SEQ ID NO: 145447 - DNA, 601 bp, Human
ctcaagtcacaggtgctttttaaactttttatatttttaatttatttatttgagatgcagtctcgctctgtcacccaggctggagtgcattggtgctatctcggctcactgcaacctccacctcccaggttcgagcaattcttctgcctcagcctctcgagtagctgggattacaggtgcccaccaccacgcctggctaattattgcatttttagtagagacagggtttcaccatgttggccgggctggttttgaactcctgaccttaggtgatccgcctgcctgggcctcccaaagtgcygggattacagctgtaagccaccgtgcccagcctaacttgagacgagtctcactgtcgcccaggctggagtgcagtggtgggatctcagctcactgcaacctctgcctcccaggttcaagcggttctcctgcctcagcctcccaagtagctgggattacaggcatctgccaccacacccagctaatttttttttgtatttttagtagagatggggttttgctgtgttagccaggatggtctcgatctcctgacctcgcgattcacccgtcttggtctcccaaagtgctgagattacaggtg

SEQ ID NO: 145448 - DNA, 601 bp, Human
agacctcacaaggagccggggtgggagtggcagggtgggagggaaagggttagtcacacagaatttgaaaaacaaaaccaacaaagccaaaaacagctgacaaggtcttttagttattattattatttacaaattctgtacgaatttgagggcttagaaatttggaccaaaaggggtggggagtttttcccttccctccatgtagctctgtgagacctcagcacaaggagagataagccaagaatgctgcagctagaagattgcacctggtgggagacaacccacagatgccacagcaggkgccagtcccttctccagctttgcaggtaggataggccttgacagtgtccaaaaggactttattagctcacatgaattcccttcagaggtcccaggatcactggcaaaggcttctggcagaggctggagggaccaccatattatagttaatatgattctattataacccagactggtgtaacctcgattagtacttgttagaggagagcatcagcagggttcttgcccattaagaggagggactgtgcataatggagtgctgggaattgccccacctgtggagtcaacacacccaaggaga

SEQ ID NO: 145449 - DNA, 601 bp, Human
tgggaccaggagagttgcaaagtgaagatcataatgtgtcttagatgaagttcttggcaaggagatggggtgagaattcagaatagagcactatttctgtgctggaatttgtcatctgatggggctgccagagattcatataggagacctcacaaggagccggggtgggagtggcagggtgggagggaaagggttagtcacacagaatttgaaaaacaaaaccaacaaagccaaaaacagctgacaaggtcttttagttattattattatttacaaattctgtacgaatttgagggcttaaaaatttggaccaaaaggggtggggagtttttcccttccctccatgtagctctgtgagacctcagcacaaggagagataagccaagaatgctgcagctagaagattgcacctggtgggagacaacccacagatgccacagcaggggccagtcccttctccagctttgcaggtaggataggccttgacagtgtccaaaaggactttattagctcacatgaattcccttcagaggtcccaggatcactggcaaaggcttctggcagaggctggagggaccaccatattatagttaatatgatt

SEQ ID NO: 145450 - DNA, 601 bp, Human
ggttcctgcatggacctaatgttcttttgtcatagcaccttggaaaaaataatcagtggctgcatttcttaaaaataatacacttcccagtgaatgaatcatgtactaaaatgattgcttttgatttatttactcattttgtttttcaaagagtttatattcatttctcagaaaattatggaggataatcaaattgtcatgcatttatatgtaaaaagagcagcacagatgatatgtggtaatgacctaaatttgtcttgactagtttaatttcctactttctctgccataagtaagaatstatgctgagactaactcaaaaatattaaaatatagcagggctccaggtatgaagcaggatatggtcatgataggattcagccaaatctagaggactcatgggaccaggagagttgcaaagtgaagatcataatgtgtcttagatgaagttcttggcaaggagatggggtgagaattcagaatagagcactatttctgtgctggaatttgtcatctgatggggctgccagagattcatataggagacctcacaaggagccggggtgggagtggcagggtgggagggaaagggttagtcaca

SEQ ID NO: 145451 - DNA, 601 bp, Human
tgccaagtagacagataaacctgttttctgacttactataggatgggcaagtaatactcatgaatgcttataatgtgccagataacaacacttggcactccacatgacattttatttaaccctcgccaagattctttggggtagatattgtaattccatgctgaactaaggttcaacgatcacactgctagcgtgtggtagagttgagatttgtccatgtataaactctatcagagtatatatttttaaaatttactaccctgttcccaacatttaaagcagtacttggcatagagtatatggtcagtaacatatttgagtgagtaaggttcttctttctgttctttctaatattgtttgtatttatatatcttataaaacactaaatctttatcttaggcataaggttccttagcatagaaacttctttctctttgccttgttcccttttctctgttctctcctccttgcctggaactggatattttgactcctgccccagtgggtgaatgtgtttacaattttcctgcagccctcatctctcttgctaataaacagcactggaactaaaatgtccacctgcataggtgaattcctccat

SEQ ID NO: 145452 - DNA, 601 bp, Human
ctggcctgctcttcatcttcatcttggaaaagtcagaataagctgttgagcattagaataagctgtctaagactcatatttgacattaaccaaatgaaaaaggagaagctgttgagaataagctgttgagcattagagtgtctaagactcatctttgacatgaatcaaatgaaaaaggagaagttgcccctggggaagctggttaactaggaccacccaggagcctcaaacatgacacatctattgaggattttgtttgtttttttaatctcagtgacaaaattccaggatatctaactarttttattttatactttcctgctcttgctttatattttgaaaaataatttgtttctctttttttgtttttttcctttcctaacttgttgatttccctattattttcatttcttctgagcggattttgtcagtctttctttagtgtcttattgtattttgaaattttattttcaaatttattctgagtggtagctttattcttgtgttttcttcttctgcactccttgtttctcatctagcacttttacagttgcttccagccagttcctagttcctggttcagatgggtcttatcttgaca

SEQ ID NO: 145453 - DNA, 601 bp, Human
cgggtgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagaaaatctttctacattatatatttccatattttttctaagattaaaattttttcaagtgtagagctttaatatttttgtataggaatctaacactttttttttctcaaaatgaatagccaaagtgccatgctttttaaattgaatgagctcatttttgcctagtaattcatgttgctacatattttctatgctgaagttctcaaatgcagacacataagcttctggtctctttattttgtcctctccctctcccactgctgccttctaaaaataagttcttacagaattatgctctttt

SEQ ID NO: 145454 - DNA, 601 bp, Human
ggccgggtgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaraaagaaaatctttctacattatatatttccatattttttctaagattaaaattttttcaagtgtagagctttaatatttttgtataggaatctaacactttttttttctcaaaatgaatagccaaagtgccatgctttttaaattgaatgagctcatttttgcctagtaattcatgttgctacatattttctatgctgaagttctcaaatgcagacacataagcttctggtctctttattttgtcctctccctctcccactgctgccttctaaaaataagttcttacagaattatgctct

SEQ ID NO: 145455 - DNA, 601 bp, Human
aattatttctggcttctctatggtttaattggtccacatgtctgtttttatgccactgccatgctgttttggttcctatagctttgtagtatattttgaaatcaggtagtgtgatgccccccagctttgttctttttgttcaagattgctctaactatttggggtcttttgtttcaatacaaattttaggatcgtttgagagctctttaatgggtagggtagccatctgccccagttttctcaggacagtgttattgtagagtttcctttctcattagtatttcctttcattttcaaaagygtccctctttggctgataaattaaacaagcatcctattgatgggttcatcccaggaatgcttccttcctctaattccttttctctattgtgtgatttttcttggtcgtgcttgggtatgtgaaagaatgcaggaaagcattctttcccttcaaagtccttaggcattaaatagcagaaggttaattcaaacacaacaccaagtattttcttttaaaactatcctattaaagtatatagggttattttttactttaaaatcaaagatctgtgaataatcttgctaagaagaagaaaagtat

SEQ ID NO: 145456 - DNA, 601 bp, Human
tatctggtaggaaaaaggttgcctatttgctccgcctttcaaatattgctttgtcattcaagaatcaacacttagattgtgcatttggacttctcccctctctgcccctctgcctggtccatgaaccagcagcgtcagcataatctgggcacttgtgagaaatgtaggacatcaagcccttccccagacacactgaatcaatcagcattttcaggctcacaaggtgatccttatctaggttaaagtttgagaagcactgggctacatccttttccagaccttccctttcatctttaaatcyggttccatacacttgcttccaagtagtttccttttgcctaagctgaatccctggattcataacccatttgtaaaacttgtctaccttttgatttgcagttcaaatttatgtctcatcatggagtttaccttgaacacacatgtgcattttgtattttttcctaggagtcccagtggattataatttcagctagctaaggcaccatatctgcatgtctttgatagctgccttcccagaatttgtgaaaattgcccccttttttcacatctgaagaaaaccaaaggtctggaaaaggaggaa

SEQ ID NO: 145457 - DNA, 601 bp, Human
ttacaagctattagatgagaaaaaacaagttaacaaaaagtgcaataaagtattatagatgcttgaatgatacctctccaaaatataattgagattttaaaagtaagtggggtgataattttttttcctagagggattgggaaagtcttcttacaggagctgatccttgagtttattattgaaaaatgaataaagatttaagttttcattttcccttatctcttttgcagtttggctcatggaaataagccctattgactgctgtggtctaaacgttggtgtcccccacccaaattcataygttggcacctaaaaggaaccaaatatgttcactccaacctcttgaatggaattagtacttttataaaaggggcctgagagagctcccttgccccttccatcatgtgaggatgcagcagcaagatgccatctatggagcagacagcaagcccttaccatacactcaatctgccagtgccttgatcttggacttcacagcctccagaactgtgagcaataaatatctgttgtttatttacccagcttaatgtattttgttgtagtaatctgaatgggctaagataccctattttaccaatac

SEQ ID NO: 145458 - DNA, 601 bp, Human
aggaccaggaatctgttttgctagccaaaccaggactctattttgctaaccatcacgtattttgcacctagcatagtgctggtacacagtagagagcttggtaaatagaattgaaagaatgagggagagagggacaatgaataagctatggtctctgagctcttatatcccaattttctacactctgtcctctacttcctagtctcccacctctttcaactcttactctaggtataagtatttcagtatattaatttgccagtgcttccagagtcgggaagctgtttttttttttttttttctccctggttctatacctgcctgtgaatttttcttttttttctaactttgaaaatccagttatctcggtcctccaaaatgctggtattccacagggttctgtccatagtctttatagtctccttgttttatccatccaatgactgaatttgaaagattcaactttatgggactaaaataatgcctggcacatacatgggggcactcaatgaacctttgttaaatgaatgtagactacaccaagatctttatttccacacagataagtcttctgagtttcagactgatatgtccaactgtt

SEQ ID NO: 145459 - DNA, 601 bp, Human
atttccttgctatttcatttattactcattgaaaaattatccatatgcaccaaaaatattataggagcagagtatatattaataaatgcttgataaatttttccctctttgcacctcttcaattctcaaatatcaggcctttctaaataggtcctatatttttctgtatcatagagccgtgtttggttttttcgtagtatatacattacgtaaatactgtttgtttacgtgcttattgttttctctattataccatacattctgatgaggaccaggaatctgttttgctagccaaaccagractctattttgctaaccatcacgtattttgcacctagcatagtgctggtacacagtagagagcttggtaaatagaattgaaagaatgagggagagagggacaatgaataagctatggtctctgagctcttatatcccaattttctacactctgtcctctacttcctagtctcccacctctttcaactcttactctaggtataagtatttcagtatattaatttgccagtgcttccagagtcgggaagctgtttttttttttttttttctccctggttctatacctgcctgtgaatttttc

SEQ ID NO: 145460 - DNA, 601 bp, Human
aaattgataattacccttgaaattaaaagtaggcaagtggacaacttttatattttataaaatgttcatttatgatgtctttcaaagtttatatctatctctttacattttgtagtgattggataatagaaaataattatatcaatttccttgctatttcatttattactcattgaaaaattatccatatgcaccaaaaatattataggagcagagtatatattaataaatgcttgataaatttttccctctttgcacctcttcaattctcaaatatcaggcctttctaaataggtcctatatttttctgtatcatagagccgtgtttggttttttcgtagtatatacattacgtaaatactgtttgtttacgtgcttattgttttctctattataccatacattctgatgaggaccaggaatctgttttgctagccaaaccaggactctattttgctaaccatcacgtattttgcacctagcatagtgctggtacacagtagagagcttggtaaatagaattgaaagaatgagggagagagggacaatgaataagctatggtctctgagctcttatatcccaattttctacactctgtcc

SEQ ID NO: 145461 - DNA, 601 bp, Human
atgataattttgctatattaaattatatctgcatttttaacataatttgctaagcttggcttcgtttcgataaaaagcaaaaattgataattacccttgaaattaaaagtaggcaagtggacaacttttatattttataaaatgttcatttatgatgtctttcaaagtttatatctatctctttacattttgtagtgattggataatagaaaataattatatcaatttccttgctatttcatttattactcattgaaaaattatccatatgcaccaaaaatattataggagcagagtatayattaataaatgcttgataaatttttccctctttgcacctcttcaattctcaaatatcaggcctttctaaataggtcctatatttttctgtatcatagagccgtgtttggttttttcgtagtatatacattacgtaaatactgtttgtttacgtgcttattgttttctctattataccatacattctgatgaggaccaggaatctgttttgctagccaaaccaggactctattttgctaaccatcacgtattttgcacctagcatagtgctggtacacagtagagagcttggtaaatagaa

SEQ ID NO: 145462 - DNA, 601 bp, Human
caggaggcggagttgcagtgagccgagatcgtgccattgcactctagcctgggcgacagagtgagacttcatcttaaaaaataataataataaaattgtaaaacaaataccctcaaatgagacttaatattttaagcaattttcagtcaacaccattcagagattagtaaaggacctagaactttaagcaaccatttgcagcagtatttcttaaagaatactttgaaatacatttaggtacataatctttttttttaaaagggttgtgtaattgattaggttgagaaaacagaattttgamatactagaactttctctcctataggcctttgcaaaaacctttaaacaatagtgtataatgtcatttttaaagagggggatatcatatactacatatttttcagatttacttaattattaaaaacttatttttatttaatttttaggtggagcacttcatgagagtggtattcaagataacttactttaagaagcacttggctaaactgaaacacaaggctgtgctgaaagaggattataagagtaaatgcccctctaaaaaaatcaaacaatagctaatagaaggaatgggaatgttgga

SEQ ID NO: 145463 - DNA, 601 bp, Human
gattatttactttggtggggaaaaataacattgcacaagaaagacattattatgctgctcttaattttgaccttcaaccgcataatctttccattttgttgagaaaaatgtagatgtgtttgaatacaaatttagacatgttctatattcttactcaaaaatggtgttaaggaaaagtataccgaaaaaagagtactcagggttattaaatagctgagtaacatcaggtaagtgcttttctattggggctaatttgtttatgcatctatagtggaatggcaatgactgtgatttgggaacrttttcaatcaagctccaacttactactgtcttcatcatgacccattatgctgtaactgcagtcacacctttatatattgaatgattttactttcaaaattactttttataaggccaggcatggtggctgatacctgtaatcccagcattttgggaggccaaagcaggtggatcacttgaggtcaggagttcgaggccatcctggccaacatagtgaaaccctatctctaccaaaaatacaaaatactagccaggtgtaatggtgcatgactgcaatcccagctactctggaggctgagac

SEQ ID NO: 145464 - DNA, 601 bp, Human
ggcgtgaattacttatttgattatttgctctgcacaaaaatggtctgttcagcaggtaaactggaagcagtaaatgcagtacttaccatgcaggatttacaccaaccatcatcaccattttcagagcaattctcttgtgcaaattccatttttctatggatgttgctaaacagataactccaattagcagtaagtgaaaatccttgaaataagcagatgccacctgaaataacaattaaacccgtgattatttactttggtggggaaaaataacattgcacaagaaagacattattatgcwgctcttaattttgaccttcaaccgcataatctttccattttgttgagaaaaatgtagatgtgtttgaatacaaatttagacatgttctatattcttactcaaaaatggtgttaaggaaaagtataccgaaaaaagagtactcagggttattaaatagctgagtaacatcaggtaagtgcttttctattggggctaatttgtttatgcatctatagtggaatggcaatgactgtgatttgggaacgttttcaatcaagctccaacttactactgtcttcatcatgacccattatgctgtaa

SEQ ID NO: 145465 - DNA, 601 bp, Human
agtggcataatggacagaacttctgccccactgtgaagtgcattacatcatcctctggaacagtgagcagagggtcaggaaaaagagatacatttctgtagcaccctaaaaggcatggagccccacttcattttaagagtcagatgacgtcgttttggttttttttgtttgtttgtttgtttgttttgagacagagtctcactctgttgcccaggctggagtgcaatggcgtgatcttggcttactgcgacctctgcctcccagattcaagcaattctcctgcctcagcttcccgagtagstgggattacaggtgcctgtcaccatacccggctaaacttgaactccccacctcaggcgatcgcccaccttggcctcctaaagtgctgggactacagggatgagccaccgtgcccggccgagataatgtcttaaacacatatgtgttatacaatttttaagtaaaaaaaaattgaaaatttgtctcgtctgagtcatttttttttttgtatttagcaaaacaatttgcaccataaatgaaaaacacagatgtgtctacgccctagaatgaattatgcaatataagtcaatacaatattcta

SEQ ID NO: 145466 - DNA, 601 bp, Human
aaattaagaacttttaacttcttaaggcattgtcaaaacaagaaatctttgtataaaaaatgccaggatcagataaagcttctggatggtgaaaatgccttaaattgaagagccacttagtggcataatggacagaacttctgccccactgtgaagtgcattacatcatcctctggaacagtgagcagagggtcaggaaaaagagatacatttctgtagcaccctaaaaggcatggagccccacttcattttaagagtcagatgacgtcgttttggttttttttgtttgtttgtttgttttttttgagacagagtctcactctgttgcccaggctggagtgcaatggcgtgatcttggcttactgcgacctctgcctcccagattcaagcaattctcctgcctcagcttcccgagtaggtgggattacaggtgcctgtcaccatacccggctaaacttgaactccccacctcaggcgatcgcccaccttggcctcctaaagtgctgggactacagggatgagccaccgtgcccggccgagataatgtcttaaacacatatgtgttatacaatttttaagtaaaaaaaaattgaaaatttgt

SEQ ID NO: 145467 - DNA, 601 bp, Human
ctaaaatggttcctatccagatgttgatttctgtctgttcatgaaagtttatcaaaccattacaccatgctactgcttagtcaagcaaaataatttatagaaaaggaagcaagtggcaggttttaaaatgcatatgtatctaactacagctctaatataattttgtatataattatttagaaagaatcaaatttatgtaccttttccaactccaccttgcttgaaattttccctgtatcattattgtatctgaaaaatacattgatccagttataattttattaaaatataatttggaaaratcccaatcaaaatgtcagtattccttaccctggaactggttttgttttctctttcctctcatttatttcatgtccattaacactttctgcaaaacattaaataaaagaaaaacaatttaaataagggattatcattgggtttgcctgtgtgtggatgcgaagatggaagcattagtagaaattgaaaataaaaaattcactgtgtactaacataacagtcatcttattttataaatacaaatatcctcccaacactttttcactgcatcagagcagttagtcagagccagaaataataa

SEQ ID NO: 145468 - DNA, 601 bp, Human
gggtaaggaaataatctatatatcaaacccccaaaacatgcaattcacctgtactacaaacctgcacatgtacccctgaaactaaaataaaagttaaaaaaagaaaatgaagcaatattctgagactggaattatatttctttaaactaccttggctaactgccattatcctgattctggtaaaaagagaaaataatgatactaattttcagagcctaaaatggttcctatccagatgttgatttctgtctgttcatgaaagtttatcaaaccattacaccatgctactgcttagtcaagmaaaataatttatagaaaaggaagcaagtggcaggttttaaaatgcatatgtatctaactacagctctaatataattttgtatataattatttagaaagaatcaaatttatgtaccttttccaactccaccttgcttgaaattttccctgtatcattattgtatctgaaaaatacattgatccagttataattttattaaaatataatttggaaaaatcccaatcaaaatgtcagtattccttaccctggaactggttttgttttctctttcctctcatttatttcatgtccattaacact

SEQ ID NO: 145469 - DNA, 601 bp, Human
ccttccctcttttaatatctagaatggctacaactcctccacctgtatttgacagaagcaactcatgaattctgcattgattttttttagtggcaatggaagcactaaagataacgagttgtaattacatgaataggagttgctccaagttcataacctggaagaaatgacgacgatgcccctaatgaaaatcagtctattaggccagcaagattttaataagagaaggatgaaaaaaacctacctatcaggtactatgcttattacccgggtaaggaaataatctatatatcaaaccccsaaaacatgcaattcacctgtactacaaacctgcacatgtacccctgaaactaaaataaaagttaaaaaaagaaaatgaagcaatattctgagactggaattatatttctttaaactaccttggctaactgccattatcctgattctggtaaaaagagaaaataatgatactaattttcagagcctaaaatggttcctatccagatgttgatttctgtctgttcatgaaagtttatcaaaccattacaccatgctactgcttagtcaagcaaaataatttatagaaaaggaagcaagtggc

SEQ ID NO: 145470 - DNA, 601 bp, Human
ataaatatatatgcaattcccatcttaaaaaatccttaatatattctgtagctaatggcttaaaacttatctttgtattcattttctctttacatagaaattgctctttcctagaagatttctgtaattaacaagagggttttctttttcctattgaactgcctgttaatgcattccatggccagatgaagaaatatatgtcccactttcctattcctaatgccatagttactataggagtatttctatgtgggatttatttttcaggtcttgagatatattgctcccagtgcaatctagyatagtatttttatattgatttattctggggaaatgaattctatgggatagtttacagagatctccttccctcttttaatatctagaatggctacaactcctccacctgtatttgacagaagcaactcatgaattctgcattgattttttttagtggcaatggaagcactaaagataacgagttgtaattacatgaataggagttgctccaagttcataacctggaagaaatgacgacgatgcccctaatgaaaatcagtctattaggccagcaagattttaataagagaaggatgaaaaa

SEQ ID NO: 145471 - DNA, 601 bp, Human
ggaattatttctatctctaaagataatatcttcataaatatatatgcaattcccatcttaaaaaatccttaatatattctgtagctaatggcttaaaacttatctttgtattcattttctctttacatagaaattgctctttcctagaagatttctgtaattaacaagagggttttctttttcctattgaactgcctgttaatgcattccatggccagatgaagaaatatatgtcccactttcctattcctaatgccatagttactataggagtatttctatgtgggatttatttttcagrtcttgagatatattgctcccagtgcaatctagcatagtatttttatattgatttattctggggaaatgaattctatgggatagtttacagagatctccttccctcttttaatatctagaatggctacaactcctccacctgtatttgacagaagcaactcatgaattctgcattgattttttttagtggcaatggaagcactaaagataacgagttgtaattacatgaataggagttgctccaagttcataacctggaagaaatgacgacgatgcccctaatgaaaatcagtctattagg

SEQ ID NO: 145472 - DNA, 601 bp, Human
agttagaatggcgatcattaaaaagtcaggaaacaacaggtgctggagaggatgtggagaattaggaacacttttacactgttggtgggactgtaaactagctcaaccattgtggaagtcagtgtggcgattcctcagggatctagaactagaaatactatttgacctagccatcccattactgggtatatacccaaaggattataaatcaggcacataaagcccatttctaatgtattattctataacatacctggcatactgttaatttttcatgttttataggaattatttctatctytaaagataatatcttcataaatatatatgcaattcccatcttaaaaaatccttaatatattctgtagctaatggcttaaaacttatctttgtattcattttctctttacatagaaattgctctttcctagaagatttctgtaattaacaagagggttttctttttcctattgaactgcctgttaatgcattccatggccagatgaagaaatatatgtcccactttcctattcctaatgccatagttactataggagtatttctatgtgggatttatttttcaggtcttgagatatattgc

SEQ ID NO: 145473 - DNA, 601 bp, Human
ccacaatgagataccatctcacaccagttagaatggcgatcattaaaaagtcaggaaacaacaggtgctggagaggatgtggagaattaggaacacttttacactgttggtgggactgtaaactagctcaaccattgtggaagtcagtgtggcgattcctcagggatctagaactagaaatactatttgacctagccatcccattactgggtatatacccaaaggattataaatcaggcacataaagcccatttctaatgtattattctataacatacctggcatactgttaatttttcaygttttataggaattatttctatctctaaagataatatcttcataaatatatatgcaattcccatcttaaaaaatccttaatatattctgtagctaatggcttaaaacttatctttgtattcattttctctttacatagaaattgctctttcctagaagatttctgtaattaacaagagggttttctttttcctattgaactgcctgttaatgcattccatggccagatgaagaaatatatgtcccactttcctattcctaatgccatagttactataggagtatttctatgtgggattta

SEQ ID NO: 145474 - DNA, 601 bp, Human
tattttatagctagatgaagtagatatacattcttccatataatcagtgttaaattatatagggtaaatctatcaaagaacagctgcagtttattataattgtaacacaaattatatatacatttattcctgaaaatatacctataattgttaaaaatcaaaacatatcataaatgtataatatataaaataatgctttcatgcatgtcttataaagaatactttagtgcagcaaaaaactattcctgtttttatataaagctaaatttttgtgcattgcattctggaaagaccatagaaycaacattcaaaagcctcgctttcctttcctaaactcagatattaatctttattgccaaaaatgcatctccgttatcttttctctattgaaaggttattcttacctctgagttctgcattctaatcaatggcatcacaatctaccgctccctagtttagagcagtggaggcatctcctacatttttttccctcgtccccaatgtctaattaataaaaaagctcagttgctcagttaatcaaaaagctcaccactgactttcaggttgtcccaaaggcagaacttatcatattgccccgcag

SEQ ID NO: 145475 - DNA, 601 bp, Human
cattctctataaaccactgcatgaataaaaggaaaccctaggttgagtcaggtaagggttgagcagtactaattactgcctttgccatccaacttctcccagtttaggaaaatagaagaataatgaaggagagccagcttttgtttgttacgtgatctaagctaaaatacctttttcatatctgatctaggagccagatattccagaattaatatctccttatttggcagaactaatacccctagtttctaatattatgaaccatgtttattactgtacttacaagactcctttgaatttytggagaacattaaaaagtgttgtcttgtacaattggatttcaaccataaggattttcacccctaaactaaacaatacctaattaaaagcaagatgtaatttattcaaggatatttttactttgaacttttccctttgaggaattacaacttatattaaactaatgaaaaacaattatctcagatttttcattaaaagtatactgattttccaatctctttcatttgtagatgcctgaaggtttagaaattgagctgatgtaaaactctgggctgtctctttgagtgacattaatgcttgc

SEQ ID NO: 145476 - DNA, 601 bp, Human
accaaaaaaattaagatagatgaagaggtgcacagcaaaatgataaaaggttaatcaatcacacacacagaaacattctaaatgggttcagaataacataatttaacaatgcagaggaaccaaaatggacagaagtatcagaagaaatagaatacctgcatgatagaaggagagtttaacaaaacagtctcatcagttgctgaataaaaagagacaaaacttggtcagagcacagagatttgagaagcacaactagtaacttgatcttacagagttttgggaaacatcgaacctaattagytaaaaatgtacaatttgttttaagcacaatgaaaaatatttattatagctgactatgtgctagtccgaaaagctgctttaacaagttttagagaactgttatatagaccacagtttctgaccgcagaaaaattgttagaaaaaatttaaaagtagctaaaaatctaatttattttaaatttcaaaacacatttctaagcatcttttgagtgaaaaaaatctagtataatggaaatcagaaaacacaaaactgaaaaatatggaaaatagctaaagtaatagaagcaaattcatatcctta

SEQ ID NO: 145477 - DNA, 601 bp, Human
aaaacatcacgtgaggatgcaatgagaaggtagccttgtacaagccagaaagagaggtctcactagaaaccgacccagataacaccttgatcttgtacttggctagcctccaaaactgggagaaaatataacagatttgtattgtttaagacacagttctgtactattttgttatggcaatccttgctgtctaacaatatagaaaatgattggacaattaaaatagacacaaagtatagaatagaccacccatacaagtgtgtgtgtagcatgaaataaaagaaaataactgcataggaaygcaggaagaaaagatggaaagaatatttggaaaaaataaaaagctggcagtagaaattattctaaatatataatgtcacaaataatttaaatggataaaacatgtcgggtagaggtaaaacttttcaaacataataaaagagatacacctaaaatataaggacacagaaatattgaaagtgaaaggatagaggaaatgccaggtaaataccagctttataaaagctggtagtgtcatgaagtgttgaaagtgaaaggatagaggaaatgccaggtaaatactagccttataaaagctggt

SEQ ID NO: 145478 - DNA, 601 bp, Human
acacacatcattaaagcaaccaaagagaaaagattgcctacaaaggaataataatttgactgatagctagctgacttttaaatagaaaaaaagaaagccaaaaggcagtagaaatatataaatatatttcaatgtgcaaaataaaaaataataacctatctagcacactataactataaaaacatgtttcaagaattatagaaatctatcaaacaaaaactgtgaatttaacaccaaaatcactctctgaaatacattcaaaagatatattcaagaagaaggaccatgaccccagataggkggtctgagaagcaaaatacaatggtgaacaaagatattaataaatatgaacataactctacagagcactgattttaaaaaataatacaattatgtaatttatggaggaataatagactagaactaaaaaattggaaaatggcatgtaaatagaaagcgatggtctaagttaaaatatcctaggctctttatactgttcaggagaaaaaaaaatggattatatttaaatgtttatatattaagtagacatgatattaatgactgaattatgtctctcaatattcgtatgttgaagctctaa

SEQ ID NO: 145479 - DNA, 601 bp, Human
cacaaaataagtggtatgtaaataagatagggaaataagtttaaaaattcttatgagtcatacaaagtggcaattgaaatttgaggcttaacattaaatagtttactataggaaagacttcaaacacaaaccagaaagtgatgcataatttgaatattattaaattgataataagaatggaaacttaaaatatgcaatgtttatatgatttccctttgccaccttaaaactttcaaaaatataaataaagaaaaaattggatttcatataaaagcttaactgtaaatatatgcatatatayagaattattaaaagacactggatgatataaaacaaaaaaatcaaaacagaaacaggttaatatgtttgccatgctttatgccttatgaattaaccacacattttttattaataaggacctttaaaatatacattattgctactgcacatgagctgatgtttatgcaaatatcatcaacaatttataaaggcattaaaattcagggtaaaaattctacagtaaatgctaacactaatatatcataatgcaaattaaaggttaagaggaggagtttttgaagtggaatggtgaatgcaccat

SEQ ID NO: 145480 - DNA, 601 bp, Human
ataagctgatgtcatcaccatcactataacaacaaacacttatagtgtccttagcatgtaataagcactgtccaagttaaaatcaattaaatgttttaattcatttacgtcttacaatacaatgaggtgggtaaaattatgatgtcattttataaataaaagacatagagaagttaagtgaattgttcgaggtcccagagcctgaaaatgacagacttgggttttgaaaccatgcagtcttgctttagagctcatactctcagccactttgctgtaatgtattgcttgtcctcctcaaaamcattatcttcctcatcccgtcaaattctgtcaattgtatctactgaaatatgcctggactctgttcaattttctccacctccactgttgtcaccctggtctcagtcaacattatctctggcctaggttaatgaaatagtgtgtttatagatcttcttgcatcaactcttgcctgttacagactcattctacagactgcagcctacaaaatctgaaagattttgtaatctaaaagattacaagaatctaaatgtagttaaggaatatataaacacttattatcttttgtcttcttgtgttt

SEQ ID NO: 145481 - DNA, 601 bp, Human
cttgaggtcaggaattctagaccagcctggccaacatggtgaaaccctgtctctactaaaaatacaaaaattaaccatgcttggttgcaggcacctgtaatccccactacttgggaggctgaggaaggagaatttcttgaacctgggaggcagaggttgcagtgagtcaagattgcatcactgcactccacactccagcctgagcaatagagcaagacccgtctcaaaacaaaacaaaactatatatatatatttgaatatatgtgtgtgtgtgtgtgtgtgtgtatatatatatatatatgtatatgtataatatcttcaataaaactccaatctgaaaatgttcaggaccaaggctattacttcttttgtcaaacctagtttgtcaggatcacttatataagctgatgtcatcaccatcactataacaacaaacacttatagtgtccttagcatgtaataagcactgtccaagttaaaatcaattaaatgttttaattcatttacgtcttacaatacaatgaggtgggtaaaattatgatgtcattttataaataaaagacatagagaagttaagtgaattgttcgaggtcccagagcc

SEQ ID NO: 145482 - DNA, 601 bp, Human
gctgttgaattaattctatctctacagtccttcaactgcactggcaaatctaagtcaataaagtatgtagttatgcccagttatggtcctctcctttctttacttccatccttattcagtttagattccatggtacaccatttcaataaattttcttaaaaaaactccaaactctctttcttgtcttttcttgaatggtagttctttatgaaaattccaactgatttataaacccaaccattctctctctccatgtcatgtctgcttctgagtagccagctactgttgttaaaaattacaygcacagtagagcagatgggatcattcatgatcacaaacatccagtgctgtaatgatgttgctcctctaccctactgtgtttgcataaccaaattactctacctgtttccacaaggaaatataaaaccttctttattatctctatacgtccctcttaatggtccttctcagtctttacaagtagctttgcctcctacttcacagagaaaatagaagccagcagacaatggtatcactgtgaaatgtagaaacctacttgcatttgccccatcttcctgttctctacataattaatagagtc

SEQ ID NO: 145483 - DNA, 601 bp, Human
tgacattctttgagtcttgtatttcttagagaatctgtgcatgcacaacattttgcaaataatttcagaaaattcatagagtctatgaatctacttcacagagagtagttttcctgcctctaaactctaatttttctgtgaacccaaatcctgttcctaggctttctcaattgtgtctgtcttcttgaaattctgattattatctgttcttttagtagaaccagtctgagtgcacatatgacaccatggactttcatactattgtttcaatgatacttacatagcgcaaaatatttttacwtagtttacttcattgaattctcacaataaccctatcaactgtgactattttacatatgaaaaaattaagtcttgggagaatcatggacctttttgttgttaaattcataatgtggccgggtgcaggggctcatgcctataatcctagcactttgggaggccaaggcaggtggatcacttgagatcaggagtttgagaccagcctggccaacatggcaaaaccccgtgtctactaaaagtacaaaaattagctgggtattacggtgcatgcctgtaatcccagctactcgggaggctgagg

SEQ ID NO: 145484 - DNA, 601 bp, Human
cattcatgatccaggctgagatttttaacagccatggcaaaagtagagcagtggcaataacaacagctaacattattgacaagttactatgtgccagaccctctgctagagccacatgtgcattatggcatttaattaattcaataatgttgtaagttctagtatcatccccattttacagaaaaggaaactgatagtcacagaagttaagctaatatatggtgagcttgaaatctgaattgaggtctaagtccaaactctgccgtgtcaaaatttcttccatagtatttaccatattgcratcttacagagtaatatgaattacttgactgtatcaactaatttcatgtgaatgatggaaaccagcagttctctaatatcaacaaagatgaagcataagaattcggtctggatattagaaaaagaaattcacagacaggaactaagatgtggaatcccttctcttggagaattcatgagaaaggatataagtcattttcaaaaagatgtcaggtgcatttcttgtcttaaattaggggatacgttggataaatcctcactggtactgtgagtttcagaagcctctcatttataaaccaaa

SEQ ID NO: 145485 - DNA, 601 bp, Human
attttgagaaatatccaaatattttgcccatttttaattgtattattagatttttccatatagagttgtttaagctccttatatattttggttattaatacttcgttagatggaaaacttgcaaatattttctctcattccgtggatttatctattcatgttgttgattgtttcctttgctgtgcagaagcttattaacttgatgtgatgctatttgtccatttttgctttggttgcctgggcttgtggggtattattcaagaaatttttgcccagacctatgtagtggagagtttaaccratgttttcttgtagtagtttcatagtttgaggtcttagcttaagtgtttaatttattttgatttcatttttgtttatggcaagaaataagggcctagttttattcttctacatatggatatccagagttcccagcaccatttatggaaaagactgcctttccccagtgtatattcttgactcctttgtcgaaaatgagttcactgtaggtgtatggatttgcttctgggttctctattctgttccattggtctatgtgtctgtttatataccagtaccatgctgtcttgattactatagc

SEQ ID NO: 145486 - DNA, 601 bp, Human
atttgtatgtcttattttgagaaatatccaaatattttgcccatttttaattgtattattagatttttccatatagagttgtttaagctccttatatattttggttattaatacttcgttagatggaaaacttgcaaatattttctctcattccgtggatttatctattcatgttgttgattgtttcctttgctgtgcagaagcttattaacttgatgtgatgctatttgtccatttttgctttggttgcctgggcttgtggggtattattcaagaaatttttgcccagacctatgtagtrgagagtttaaccaatgttttcttgtagtagtttcatagtttgaggtcttagcttaagtgtttaatttattttgatttcatttttgtttatggcaagaaataagggcctagttttattcttctacatatggatatccagagttcccagcaccatttatggaaaagactgcctttccccagtgtatattcttgactcctttgtcgaaaatgagttcactgtaggtgtatggatttgcttctgggttctctattctgttccattggtctatgtgtctgtttatataccagtaccatgctgtct

SEQ ID NO: 145487 - DNA, 601 bp, Human
aaatagcaagaaggagccagtcatgtgaataactgggaaacagcattccagacggaggaaatagcaattacaaagtccttgagttaggaatgagtttgtcacatttgtggagagataggaggccactgtggctgtgggtaatgagtgaaggtgagtgtgacatgaaagaagtagtcaatatggatcagatcatgtataaccttgtagccagtccgaaagtatgcggattttattacaaatgcaataaggactaattggaacgtagtaagttagtaacgtgacatgatctaattagtaattracataaaacagaatggctcctggatgcattctcaggattgaaggcaacaagagtggaaacagtgtgtgatgttcaggatgtggtagacagagttccaagatatgcctcaaatttctgcctcctggtgtacatgccttgtacgatctcctcttctgtgtggatggaatctgtgaatatgatgagatatcactcctgtgattaggttgcgtagtgaaaaaagtgaagggattttacttaggtaatcaaagtccctagcaattgaaactgagttaatcaaaagcacgaactatcccgggtagg

SEQ ID NO: 145488 - DNA, 601 bp, Human
tccaagaaggaagtcctggaatatactcatcattaaatagagtacttttaccccttgtctcctgtcttgattctggaactgcataattatcactgcatcccatataagcaagagtggatgtgttttgatttttgttctctatatttcatctttaaggaagtgcttgtggaaaaaacccagtgcagttcttggctttaatgagtattaaatgcacaagaaatgggtgttcatgaggtatttgcgttttgttgtcaatactccatcagtatatgaacaaggaaagacacataagcagaaatgrgaacaggtgaaaattagtgggactgaatgtctgttcccatttcaccttggtggctggaattcttggccatgtgaaagtactctgatccagcctaggtcatctcccatggctgttttcctttctgtttcttctaccccaaagcacagcaaccatcgaaccaggtatatggtagctctttcttcctagaaccaggtggtgctttggggcacagtcaaatggagtaactctgagccagataaaaataattaaaagttctgaagaaatcaacaacttttcttttttatcttacctacttatttt

SEQ ID NO: 145489 - DNA, 601 bp, Human
tttatttagcctattaacatgaaatatttacttacttgaatcctaggaaaagccactgaagccagatccaggataagagtagaatgataagggcagctgggaaggaaaacgtaaaccatgatccaaagttgaggcaacgacagtcaggatagcgtctgtgtgaaaacatggagacgtgttcagggatggagagacaggtggaatcctttctgattgtcacagggaagcagcagtccacctctttcctgtgtttctgtccaagaaggaagtcctggaatatactcatcattaaatagagtamttttaccccttgtctcctgtcttgattctggaactgcataattatcactgcatcccatataagcaagagtggatgtgttttgatttttgttctctatatttcatctttaaggaagtgcttgtggaaaaaacccagtgcagttcttggctttaatgagtattaaatgcacaagaaatgggtgttcatgaggtatttgcgttttgttgtcaatactccatcagtatatgaacaaggaaagacacataagcagaaatgagaacaggtgaaaattagtgggactgaatgtctgttcccatttca

SEQ ID NO: 145490 - DNA, 601 bp, Human
caccacgcccagctaatttttgtatttttagtagagaaggggtttcacaatgttggccaggctggtctctaactgctgacctcaggagatccactcccctggcctcccaaagcatttcacttttcaaaggaagtacacatagctggcttcagtctctctggtttggtgaataacatgctgttttattcataggtccttgaaattatttaaataaaaccccacaaaaataaatttgagctgttttgtttttcaggaaaaaaaatactcaagatttgatatacagcgacttcacctttctttwaggagtattgttaaatgagtagaatttacaggctgcattttagattttgctctggagcccttcataattttaaatgctggttgtcatctaagttatgtaactcattggtacttatgacctaccagctttgatcccagccaagataatatgttgaggttgtctttgaatgcatgtatttgacattttagtggcatcagtcggtctttattggtcaacatttttttttttactttgacttctatgtgttcaacttaggcccagatgtgttagaattatagccttggaagggatcttactgat

SEQ ID NO: 145491 - DNA, 601 bp, Human
gagtttccttagaaacaattttccacccagtacattgcatatatagtttatcattttggttgcagacaataaatagttaagtcgaaagccaaattggcattgctacaaatgaaggttaatgccttcacaaaggaactgacaaagcctatgacaatgcatcaaactctccatttaaataattgaatggcactgacagatgagctcctcttctcaggtatgttgggatcatttataatgggtgagttaactgtgttaatacccaacatactaatcagaatgtatgctagtttgccaggggagyggctgataatttccgtctgtcaatctaaaatctctggaggtaaacaccttggcagacagaaaaggacactgaaaaattagctggagcatgaatctgtgcagtgtttaacagatagtggacaccaagggaactgtttaaacataccactcatcatgatttacagactttgcctagtgtatgcacttcatgggatttttttcctcattaagagcacatttcaatatatttgccttttatcttcttaatttctcctttttaaatggtgtgccattttaaaataatgacaatggttgcatatat

SEQ ID NO: 145492 - DNA, 601 bp, Human
gatcaattaggaaataattgctttttacaatctcagttaaattactgactagtgccagtctcaaacttttaccccttgtcatgacataaatactattataagaaactaattaatgcgccacctagagagcaatctgtagaagagaaaatcatagtaaagaaggagatgagtttccttagaaacaattttccacccagtacattgcatatatagtttatcattttggttgcagacaataaatagttaagtcgaaagccaaattggcattgctacaaatgaaggttaatgccttcacaaaggwactgacaaagcctatgacaatgcatcaaactctccatttaaataattgaatggcactgacagatgagctcctcttctcaggtatgttgggatcatttataatgggtgagttaactgtgttaatacccaacatactaatcagaatgtatgctagtttgccaggggagtggctgataatttccgtctgtcaatctaaaatctctggaggtaaacaccttggcagacagaaaaggacactgaaaaattagctggagcatgaatctgtgcagtgtttaacagatagtggacaccaagggaactg

SEQ ID NO: 145493 - DNA, 601 bp, Human
tgatcaattaggaaataattgctttttacaatctcagttaaattactgactagtgccagtctcaaacttttaccccttgtcatgacataaatactattataagaaactaattaatgcgccacctagagagcaatctgtagaagagaaaatcatagtaaagaaggagatgagtttccttagaaacaattttccacccagtacattgcatatatagtttatcattttggttgcagacaataaatagttaagtcgaaagccaaattggcattgctacaaatgaaggttaatgccttcacaaagsaactgacaaagcctatgacaatgcatcaaactctccatttaaataattgaatggcactgacagatgagctcctcttctcaggtatgttgggatcatttataatgggtgagttaactgtgttaatacccaacatactaatcagaatgtatgctagtttgccaggggagtggctgataatttccgtctgtcaatctaaaatctctggaggtaaacaccttggcagacagaaaaggacactgaaaaattagctggagcatgaatctgtgcagtgtttaacagatagtggacaccaagggaact

SEQ ID NO: 145494 - DNA, 601 bp, Human
ttgtgtaagtatagacagaaaggacattttctttcgtaaagtatctggggcaagcctatacattcataatcaccttcatgcatacacttcaatgcctgaatatgagtgaatggacagtgctacatttatgatcaattaggaaataattgctttttacaatctcagttaaattactgactagtgccagtctcaaacttttaccccttgtcatgacataaatactattataagaaactaattaatgcgccacctagagagcaatctgtagaagagaaaatcatagtaaagaaggagatgagtytccttagaaacaattttccacccagtacattgcatatatagtttatcattttggttgcagacaataaatagttaagtcgaaagccaaattggcattgctacaaatgaaggttaatgccttcacaaaggaactgacaaagcctatgacaatgcatcaaactctccatttaaataattgaatggcactgacagatgagctcctcttctcaggtatgttgggatcatttataatgggtgagttaactgtgttaatacccaacatactaatcagaatgtatgctagtttgccaggggagtggct

SEQ ID NO: 145495 - DNA, 601 bp, Human
agattcttatggattatctcttggaatgtttatgagcagctcagttagtttacattttgtgtaagtatagacagaaaggacattttctttcgtaaagtatctggggcaagcctatacattcataatcaccttcatgcatacacttcaatgcctgaatatgagtgaatggacagtgctacatttatgatcaattaggaaataattgctttttacaatctcagttaaattactgactagtgccagtctcaaacttttaccccttgtcatgacataaatactattataagaaactaattaatgygccacctagagagcaatctgtagaagagaaaatcatagtaaagaaggagatgagtttccttagaaacaattttccacccagtacattgcatatatagtttatcattttggttgcagacaataaatagttaagtcgaaagccaaattggcattgctacaaatgaaggttaatgccttcacaaaggaactgacaaagcctatgacaatgcatcaaactctccatttaaataattgaatggcactgacagatgagctcctcttctcaggtatgttgggatcatttataatgggtgagttaact

SEQ ID NO: 145496 - DNA, 601 bp, Human
agtaaaataaactcaccataaataccatttgacccagcaatcccattacttggtatatacccaaaggaatataaatcattctgttttaatgatacatgcatacatatgttcactgcagcactattcacaatagcaaagacatggaatcaacccaaattcccatcaatgatagactggataaataaaatgtggtacatatacactatggaatactatgcagccaaaacaaggaacaagatcatgtcctttgcagggacatggatggagctggaattcattatcctcagcaaactaacacagkaacagaaaaccaaacaccacatgttctcactcataagtgggagctgaacaaggagaacacatggaaccagggagaagaacaacacacactggggcctgtcaggggtgtggagggagggagagcatcaagataaacaggtaatgcatgtggggcttaatacctaggtgatgggttgataggtgcaacaaaccatcatggcacacgtttgcctacataacaaacctgcacatcctgcacatgtatcatggaacttaagataaaatttaaaaaagaagtaaaactctattacatttttttctt

SEQ ID NO: 145497 - DNA, 601 bp, Human
tgatcgcagtagaacactaaacactgtaagaactagatgtgtcaataatttgagagcatcagtgcagtttgaaaaagccctttctcctctttggggtctctcagcttcttttcattttacctggcaaattttagttagacagggtatgtgttttatcatgttgagttatagtctataatctccatagcttagcaaatttggggccctaatcaagtgttataaataccttgcaagcaattatgtgcttgtttgcttttcaacagctacttgcagtgtaaacagcatttctctcttctctgtstgtgtgtgtgtgtgtgtgtgtgtgtgtgtgtttgtcttaccttattggcccaagcttttggtattcttgcttaatcacctcagcacaagctttttgttggactgttttggttttgccacatttgaacatctccttaaaactgcaaagaataattaagcctgtaagcaagaaattcttttactaccacctccctgtaaggaagatatttttgtaaaacgtcgtcatcttcacacaatatgaatctcccttcatgcaatatgaatctccccgttaataacagatatctgtgcttttcacctc

SEQ ID NO: 145498 - DNA, 601 bp, Human
tgtctaggatgacagaagttggattttaaaagggggaagcattattttttatgttgatctagatcctaccacaaaaccacaaaatattaattaaatattacataataacttgatttaaataactgaatgtctaaacctctcaaaatgaaaagttttatttctaagggaatcaaaaagtttataaaaatgaagctgatgctttaaaacacaccaccatattgacttgtgtggtcattaggaatttggactcagacttcgcacccttcagaaacattgacaatgcctataaaaccagaaggtkctgattcagggagggaagaatttctttattgtatgtgggcaaaatacatatgacctaaacaattttggtttctaccccaaaatacaatttttttttttttttttttttttttttgctgggggatttgagacaggaagtccaagtaagacatgtgctgaatttagaaattagagtagttcagtgaaagatagattgggaacacaaatctcacaactgagttatttatattgacatataggatggtccttaatttagaaaattatgctatacccttccccctcacttcacacaactcagcaa

SEQ ID NO: 145499 - DNA, 601 bp, Human
aagctctaaccatatcatacaaaggaaagcaacctacttaattttttgcaccccatgaaattcaatcaagaatattaattgttggagtggtttagccaatgctcacaaatgatcaccatataaattaagactgattcaggaacagatggggtcttagaatcaccagaccattgtaacaaataagacagattcccagaagcctcaacaggaaagaacctggagaccagatataactgaaataggcattaataattagcatttagtgttaaaagtcagcaatattaactagtgcatttctgtrgcctgagaagaaatatgtaccatgctaaagattcttttactatcttgcaactcagtaatatgtatacactaccgaagcttctctacttctataatttatttgaaaaatctaaaaagccaaagaaatgccgtatctttctcaatctagcaatttttaaagcagtctactttctttaagtatagacacattttctttcattactagttaaaaatctaccttaccataatttatcttacaaactggaccgatatttataattttattataccttatttcttttatttcagttataatttttgg

SEQ ID NO: 145500 - DNA, 601 bp, Human
tatcacacctgcttctgtgtttataagctctaaccatatcatacaaaggaaagcaacctacttaattttttgcaccccatgaaattcaatcaagaatattaattgttggagtggtttagccaatgctcacaaatgatcaccatataaattaagactgattcaggaacagatggggtcttagaatcaccagaccattgtaacaaataagacagattcccagaagcctcaacaggaaagaacctggagaccagatataactgaaataggcattaataattagcatttagtgttaaaagtcagmaatattaactagtgcatttctgtagcctgagaagaaatatgtaccatgctaaagattcttttactatcttgcaactcagtaatatgtatacactaccgaagcttctctacttctataatttatttgaaaaatctaaaaagccaaagaaatgccgtatctttctcaatctagcaatttttaaagcagtctactttctttaagtatagacacattttctttcattactagttaaaaatctaccttaccataatttatcttacaaactggaccgatatttataattttattataccttatttc

SEQ ID NO: 145501 - DNA, 601 bp, Human
ccacgtatacacatgctgacatactaggccaaagtggcaaatttcccttttagataagcttacagatttgttaaacaatttcttctttgaattatttaatttaataatattgatcaagatttgaagttgaaacattgctagagcatggaaagccccatataattgatttataacatccttctattaaattgtggcaaggcgtgatatttctgtgttcctctaaagctcttctataaattgtgaaaaggaattgatctgttttctgagatatcacacctgcttctgtgtttataagctctarccatatcatacaaaggaaagcaacctacttaattttttgcaccccatgaaattcaatcaagaatattaattgttggagtggtttagccaatgctcacaaatgatcaccatataaattaagactgattcaggaacagatggggtcttagaatcaccagaccattgtaacaaataagacagattcccagaagcctcaacaggaaagaacctggagaccagatataactgaaataggcattaataattagcatttagtgttaaaagtcagcaatattaactagtgcatttctgtagcctgaga

SEQ ID NO: 145502 - DNA, 601 bp, Human
tttgttcatgtgttgtaaatacaatgaatgctgtcacagaataccttttctttatttttattactatcattatttttagagaccgagtctccctctgttgcccagggcagtggcacaatcatagctcactacagcctccaactcctgggctcaagtgatcctcctgcgttggcctccagattggccaccacacctggctaatttttttaattttttgatagagctggggtctcaccatgctgccaaggcttgtttcaaactactggcctcaagtgatcctcctgcctcagtctcccaaagwgctgtgattgcaggtgtgagccaccacatctggcccttttatttcagctgtgatcctaggatatggctatgtgaggtttatttagcttttgttccagaactactttgagaatgtaaatactctttctcttgaaattcatcacctttttagatcctctgcatttattaccaaggtatcataatgaagcagtgtcttccaagttctttttcctctgtttgccaatagtaagattaattttgaagtgagtttaccatgggtcaaatagtatcgcttgtagcagagccctagccatgatacaaa

SEQ ID NO: 145503 - DNA, 601 bp, Human
tatcttgttaaaatgtaaacatctctgacatgtacttcttatttaaaatttaacatatttatatattatttgtcatttttaagccttgtatgaatgactttagcagggagaagaggttttgaagaatgaggggagagagaaaggtgggtaggagcaaggctctttctaagggagggaattcagatgtggaaaccagggaagctaaagccaaacatggattcctcagtacttgccactgccagacctcagggctttgactgcaatgatcagagtccttggggtcccataggaatcaatgctycatattgcatcacctccttaacacacattgagatattctaatctcaagtgaaaaacaaagtacatttgtttctatgctgtgctggtcacatatgtcctggaaatctgatacattagtcatttatagattctgacaagagtcaagtgggccaacacaactacataaatcccagttccatccccataagaacaaacaaacaaaaccacaagtctactagttaatttccagacaattacaaattagttgtcccacattgacaagataggaatctgactactcaaaacatgctgtgttgtaaag

SEQ ID NO: 145504 - DNA, 601 bp, Human
atgaggttcttaaagtgcttataaaaggattatcataaagatttctctttatatttggcttctgatctctccattgctttgttgataaagaagttcatttggagacatattctgcccatttaacatgtgtataacaggcagccttctacatggtaagattttaagtttaccaataagcttccttcctatcatcttcccccaaatccaaaccaaacccatcctcactgataactgaaattatgtcaccaggtttcttactttaaggtcatatatcttgttaaaatgtaaacatctctgacawgtacttcttatttaaaatttaacatatttatatattatttgtcatttttaagccttgtatgaatgactttagcagggagaagaggttttgaagaatgaggggagagagaaaggtgggtaggagcaaggctctttctaagggagggaattcagatgtggaaaccagggaagctaaagccaaacatggattcctcagtacttgccactgccagacctcagggctttgactgcaatgatcagagtccttggggtcccataggaatcaatgctccatattgcatcacctccttaacacacattg

SEQ ID NO: 145505 - DNA, 601 bp, Human
atgcaaaatgtccataatattccattggttccaatagcatcttgtagcattttaattattatccattaatatttgaacattttattagtttttaggtcataaggaggatcatgatagattcaccaagatttcggtttaaaaataattcaagattcagattaaataaagtattatttatgaggttcttaaagtgcttataaaaggattatcataaagatttctctttatatttggcttctgatctctccattgctttgttgataaagaagttcatttggagacatattctgcccatttaacwtgtgtataacaggcagccttctacatggtaagattttaagtttaccaataagcttccttcctatcatcttcccccaaatccaaaccaaacccatcctcactgataactgaaattatgtcaccaggtttcttactttaaggtcatatatcttgttaaaatgtaaacatctctgacatgtacttcttatttaaaatttaacatatttatatattatttgtcatttttaagccttgtatgaatgactttagcagggagaagaggttttgaagaatgaggggagagagaaaggtgggtaggagc

SEQ ID NO: 145506 - DNA, 601 bp, Human
ataacttaaaaaaatcctttgggtaatattatagaatatatttcaataaattataacattgtcacttataatggtactcattcattcactcactcattcatttatattccactaacatctttgccaactgtgaatagcacagtgcattagactataatattctttgctatgcaaaatgtccataatattccattggttccaatagcatcttgtagcattttaattattatccattaatatttgaacattttattagtttttaggtcataaggaggatcatgatagattcaccaagatttcrgtttaaaaataattcaagattcagattaaataaagtattatttatgaggttcttaaagtgcttataaaaggattatcataaagatttctctttatatttggcttctgatctctccattgctttgttgataaagaagttcatttggagacatattctgcccatttaacatgtgtataacaggcagccttctacatggtaagattttaagtttaccaataagcttccttcctatcatcttcccccaaatccaaaccaaacccatcctcactgataactgaaattatgtcaccaggtttctta
